United States Patent 6,812,339 (POLYMORPHISMS IN KNOWN GENES ASSOCIATED WITH HUMAN DISEASE, METHODS OF DETECTION AND USES THEREOF) - sequence listing, part 68

SEQ ID NO: 16423 - DNA, 167708 bp, Human
tcaaaggctagtacttaagggtgtgttcctgttagagaattttaatacttaatttgttttcaagtgtttgtgtaataccaaatctccttgccaactggaagagggactgtccttgaatcctgttctgaataaaatattaaaatataatcccttcttcatatatatatatatatatatattttttttttttttaaagaacttcagggaatgtgaagtattgtcatttgataggattatactttgttgctagcaaaggcaatagcatagccttcctgccaattgtttctcttcctccagaaggagttctttcctttacccacaggataaggataaagctgaaggtttttgtttctgaaagcccaaacagcaagccaaagagaaagttcaaacaaatattgtcagtcttttaaaaatgtcattgcttatgtaaattagctgacccttgactgctggtgagcctcaagcatccttgatttggttggatgttaagtcaggttttatttatatttggtatatggtatctagaaagcacttatcatgaagaatctcacttcatttaaggttagtgcttttttatttgttttggttctaggtttttgttttgttttgttttagattagcttcactatcttgtgatttccagaggctgatgtattactgtgaaacattccgatatgatttttccttattttttctttttactgttacacatcttcccatcaaattcatttgagattcttggaacgatgtttatagttactgactaaaataaaactttaatctctttctttggaagtacagtatttttatattgtgaattatacagttttaatttatgccttcagactaaaatttgcaggtttgataacatagttttaaatatattcagtcaaaatatgaatattttcaagtttaacctagttgagtcctcttataaaacgttgagctgtaacattagttcttcatggcctctcatttgtattaatgtgacgttcttgatcataacctttgaagataaaattcatttggggggcagctaagattctccctactctttctaattatgttgtaaaactccaaacttaggaaaggatatcttttggaaggcatgccttatgagtacaaaattattattttgcttatgagatgcaggatttttaaatgggcatttacatcttgtgtatcatgttagctgtagagtttttgtttgttttaaaataattctgagaacttgggcaattctgtgatgatccttgggagctcttggtaggagatatcattcctcttggatctgtagctctgtgatgcatgtatataagcatgcctttgttctcaaaagtctttttctatctgattactgtggtatccagtgctttgtctttgcctctcttcgttttttgttttgtttttttccttgcgccttagccggtcatttgtgtgatgtttacattcagcagagaggtatttagagcatttttggtgagagaaaggagtgatagaggaagtaaagagaaattcagactggggtggctgtgagggataaaggggggaagaagtaggaaaagaaaacaggagtgggtccaagggaggaagagcaagcaaagacagaacaccggctctacaggggctgcgccgtgggggttcctgaaatcttgggggctggctgtgggggagggagctcaacagaccagcattttccccaggcttgggcgcaaccttgtgaaactactaatgtattaaagaacctcagctgggatttgctgaggacaaatgctgtaacgtgttagtcatccattatctgcttctatttttgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtgggtgttcgttgttcgggtgctttctgtgcatgctgttgagaaatgtaatcacttttatgaacctgagtgttggcaaaatagacggggttgatgttctttgctggaatgacttggaattttaccacagtaacttcttgtgaagtcccccgtgcagaaaaagcccactgcattgtagccaagcagttctggctttcaaaactccaattagaagttgtgatttccaaaactaatcactccctctgggggaggtatttcaggaactacaatatattcgcttagttttgaatgcctgcttgtttataacagctcgaagaataaaatataaggatacatcagtgtcgaggagaagcagatcatagactgtaatagctcacaaggaaacactgagctgtatacaaacgcctcataattactttattaaatatttatgtacttgtacatttgtaattcacatcgcagtcttttatttcttcctcctaacagctctgcctcctagcaagattatggttggctttcttgtttctagctagtaattctggacactgaaaatagttacagaaatttttactgggtcatggttaatatttctgccattagaaaattggcatgcctgtgataatttgtaatgtattaatactatatcttcattaacttgaaacagatatatgttttgacatatttttatatgacataattttttataaattttcaataaaaacaagtttttattgaatggagttttaaatgtagcctggttgattgcattggttatattttatttacaaattaggtatatattgttattggactataaaatgaaaatctgagtatgtttacgaacattgtgtagtcatcacatctttagagttttcattgggtttaaatcaatcatctttaaggtcatagaattcctttctttccccttctcatgttgagtttagattccattatgttcaagaatattgaaattgccctcttttttaaggtttaaagaaactaccagaccattttccaatgaatgtcttggtaccaccagacccgtagttcctattgattcatcagattttgcattggatattcgcatgcctggggttacacctaaacaggtgagaggaattttgtctttcattattcacttgttctggatacaatctataattaaagtaaggaaactgcatttacagctgtaggaacttctttaaacgtaggcatttgctttcaagactccagctaaggctagaataattgaatattttaaagagggttaagtctttcaaggtgaatctttcacttaaattttgtttttaaaattttacttatattatcatttgtggtttgaaatggaatgtcgaaaatttacattttgagattctctgtggagtaatagcctctgtaatgcagcatgcaagtacgcattaaaatatgaaaaattattctaataaaggaaaatgatattgagcagctgcatttaagctagtttgtttaaatatccttttattgcaaccacaagtcaagaaataaaaacgtgtttactgctaagaatttgaaaaacaaaacattccactcttttaaaagttaagaaaactgttcatacaggtggctgattgtgagttttctttaacctgacttgctcgttgtaagagatgtattttgaaataatggcaaagctcatataaatgtgacttatagagcattttgtgtagaactaggttgctgctagggctttccctcttttaggtacacgcaagaagctcaaacccactgctgtcatgtgtgcaaggtgtttcattaagcataaaaaggccagaattaattatgctttgcagccaggcagtgcagggatttatgtgtgtcattaaaagatagtcctctccttttgaagggctgcagagacagggaaagacctggatattgtagagctgcagtggctgatgactcattgttgcagataacattctatttttcttttcttttttattttattttcagtactaggaaaataaagtattcgtattctacttattaggcagaattccctttgcaattgacatccagaagctttagagaatacacatgggcctttttttgggactaagaattggcattcatttatttgaagacctgtgtatgattgtctataactaactaccactgtaaaaatgactttcacttcctcctcatccccaaatgaccatgcagatgactttccatgcattcagttgttactgtgctagcttttaatttcataagctttttatttagtatttaaccgcaaaaagtgtaatgagattgagactaggagagaagaacaacagttgctcacttatgaagtgtgcctcttttctcacttttaaaactgggtttcccccctgtatttgcttgaactgaatgtattttttttaaaatatccactaattgggttttcaagcactctttccccacaagaatatcattattttatcaaatagtcttttgtttggttcattattattgttattctttcttctcattatttaagagtaataacatttaaattacttaacaataataatgggcaactgtgatggggtcagtaatctcagaaagagatcttagaggaattgattataaaaagtcatggaggagctccattttcataaagtaaaatgtgttcatttttataatcctataattatcaaaataactccatggggaaagaacatacattgtttaaataattgctttttattttgcactatctgtattcaccttggcctcatgcagtgcatatttgctggttgcctttccagcaaatagctggttgcctccttgctccttctctgagactatgtgattcccaagagcttcctacccagactccagagatggaacacatggaccgtgattgataattgactgtatcccgcctccctttccgcaatgattggttcaaaagaaagtgtgtgatttagaccattcaaatcttaggacttttgctgagaatgtatttttctgttgcatgtgagcagtaggcttgtcttgctagggtctgctgaattcatgagggagccatgcctataataaaactaacaccatagagggcaatgcagagagattgaaagaatgtagtgcttggtgacgtcactacttatgcagtgttcagttatgttagcctttctggtttgaataaagttgagttgggttttgtcttacttgcaactgaaactactgggtaaatgattcagttgctctgcctgacagctcagaactgcttgttgaatatttcttccatttttttcccatcactctctgttgaccatgtgccatgagtatgtaacttggttcagctgacatacagatcttatactttgtaaacttttatgagaaatggtagactatccattgaatatgcccaggaagaggtggatacagaaccttcagaacctctttccttctgaatttggtgttctagtgaggaagaccaagagctctgatgccgtaagtacttttgaagaaagtattattttcttaaaatgaagataaaaccaaagttttacacaagtccttaagaggaaaggaggtgaaaaaaagcaagacagaataatgaaaacgtattagagggaagaaacaaaaggtagaagggaaataagaagagttgaccgaaaaacaaaatgaaaaaaaggtccaagaaaatggaatgatcaagaacaaaaataaaaggaaaaaaatcaggaataactagactatgaagaaagaacatctaaaaatcataaaagaatagaggttgaaggaaaatgtaaaaacaaggaaagacattgagttaaatggcagaggatttttttttttttgatcgcagacaatcaagaagagcaacaaaatttaaagaaggaacagagaagaacttgagttgggaattgagagacatcatgttgattaaagaaatgtattcattccacaagatttttttaaaataaagtacatcttaagttttggcaataatgaaagctatatcaatacatcttatgtgtatcctttctttggaaaacttgagattgttaggtaggcttagatagagaaacaagcagatgtagaacagaggtggaaagaaccttagacataatacagatagtgcaactaactaattttacagatggaatacaagcctagattagtgtcttatcaaggatatccagtcatgtcaggcctctgagttgccattctgccataccacaggactttaaagtggcaattaaaaatttctcccattaaactagatccagtgagtctgggaaaagtggtttattatctgttgcaatatcaattttataatcaaagtaagcttattctgtctcttctctgacttaaaaaatttgaaaatagtttccatccttttttagaaatggataatcagtgtttaatctctgttaataggtgtttttccagcctttgggaagattagagagaagagtaggcaggttttaaatagcctatcatagagataaagtcaggatctggtgttccatggcactggcttcaaatccagcagagccatgaagtggtgatatcttgagactcctcttttagcactgtttctttcttatttgattccctttctcacccaggacccactggacttttgctgtcaccaactctcatatcaaaaaacaaaagaatttgataaactgccagttcatggtcatagtatggtgatatcaatttgacatgttaactatccctttggtgttggatttcaaaataaataaaggtataattacaatggttttccataatgtttattgcctaaatctaactcaaatccaggggttaaacagatgcattggggctgggctgacagcatctggcctcagctcttgcagtctcaactcaaatttgtttcttaactggctagtcctgttccttcttctgtagaaaggataataatagtttattatcccacactaccaaggttgttctgaagactgagtgacataatgttcagttgccttgcacatgataagaactcagaaaatgtatactaatattattattacttgtgttcagggaaatgtgaatgcaccttgacactagaaagaaattgctaacccttaggctttcagcaatggcttcatggagaagctaagacattgcaataattgtgaaggagatgaaagtgaaccaaatgaagaaaatagaaagtacaaacctaggcaagagaaacctggataaagtactcaaagaagtaaatctttcagtgtccttaagtattcataagtagttgttttcattaaaaatggacctatcataagagaataaaaggaacactgagaatagatatgcttttctcagaaattcttatacatctttatattgcttggaggagaagttattaaaagaactctcatcggtttgaaaccttttattttatatatatataaaatatatatattatatataatacatttatatatattatatatatatatgtatatttgaaataagccttgattttttttcagtgtctactttcctaaggactttatacattgaccttatttaaaaaacacttttatctaatgtaagtactttcaaatcctaggtttatgtagcattctatttatttgctatttgctcaacttaggtcctctgtgttcttagcttaagaacttacaagtgcaaacaaatttgcaaaaactaaatgattttaccaaattaaatatcttccttgagcctaatttcttaaagccttatattaattgaatttctttcaatgaagatgttttaggctgtcattagtgtaatcattttcctcccttattttggcagtgatgatttgagaactgtgaagaaatacatcttaccctttctgaacctcttgcaaattcttgtctcattcagcatttgtcttttaaaggactcttcagatcatgcattgaaatcagaaagcagcctatccctgtgtatctaagcacatatatctattgccaggaatcagaacaattctgagtttaagaatcacagcagataccccagagcaacaggttgaaaaacctgaaattagaatcttaagttattacttattttaaaatattgatgaaagaatgttgtcgttgaaatgaaaccagaatgaacaaaatactcctacaaaatgttctcaaaatcttcccactgtgtttcactttgctgttttctcaaattaacagtcattagaaaacgttaagtaacgtactttaacttcttcattttctaacatgaggaagagattcccttgcctccacaatacatgtataatctgtaaaaagaacccagctttcatgggcttttctttctgcactcctgtaaggaatcagttttaaaatatcaaaccataatcataacatcatttataagtggcagttgctcagaatatctgttttatcagaggtaatatacaagttaaatgcagaattgtttttattaaattcagaatgccaattaaattagactttgtatgtatgttacttagttgttcagaagcttggcttttgtctagttttcaggctacaataacgttaggtctatatattttttaattccatcattgtgtaaaaaagatgtacgtatcctcagtcagtgctaaaaactcagagtaaaattagcaacggggcctacttgagggtggagggtggacggagggaaaggatttaaaaactacctacagcctactatgcttttacctgggtgagggaataatctgtacaccaaacccccatgacatacaatttacctgtatagcaaacctacatatgtactcctgaacctaaaataaaagttacaaaaaaaaaattagcaaggactccagaaaaaaatgatactttactggaataagtttttagtactttaggggttgtgatttccttatcttttctctagttgttagtatataatatttgtattcttttgaaattaaaatttcagtctttctcttggacataagaataaaaggaagggagacaccccacaccaccatttttctgtttcccctcataggctagcttgactttgagtttaaacctcactgcagaaggggagaaaaccaacagccttttgggcaccagctggtgggatatctattatactctttttgagaaaatggatccaagctcttcgcgaagcagctgtgcgattgctgggaagtgcctaaagaagatccccatccaactccaggagccccatggatttccttatcacctctgtgtggtcagcagccatggtccagcctaccttccctagtgctgtgatctgtccaccactacaggcccgaccctcgtctaattgaatctgtacagcagaatagacatagcaaatgagggttacttcttgagtcaaatacatttgattgggaagagctgcctggaaagtgttaagaattatgagaccacattgggacttgatgggaaacggtgcagcgacccataaacaacatctgccacgaatgtgaaagataaaagtcgctccagtggccagcctctagaaagaagaatcctgggtgaagattgattgcattgtcattgtcttaaaatgaatatgagtcgtggcttttagtgtttcgttttcttctattttttttctcctttcagagaaaataaaactagcatggtgatcttcctattgaaggaggcatattgagaaacatcctaattctagactagcatttactttttatttagaaagacttatgcaatgtgtataaaattacaagatttgtgaagagagcaacaaaataaaatgctgtatctcctccctccccaaattgagaaactaatattatcttcattttaccaatgggaaagctaatagcaaagaaaatagcatcgttattagaaaggatggccaccaagccctttttttgtttatttagctgtgacacattcattcttttttccctttctattttgagagctcaggattgatgtcatttaaaacaatacatgtcaaaatctcagattagatctatttgtatatttactctgctttgtcggcaagtgtcaagtatatgaattaagtagattacaaaaatgttaaatggcttttgtaaacgacaaattaaagtcacttgtcatccactgtcaattgtttaagtttaaattatgatacttcctctttatttttactgaaacttatttaacgttctcttagggaagatacgattgaactattaacaatgtttttttttaataatagaaacatgctacatatctgggttcagaactgcaagtatgagtatacattgaccattttttcctttctttataaaaaatgagaaacagattttttatttcttataaaaaataagaaattgaaaattattttcaatcaattttgagtatgtttgaattaacatgatgcttgagaatattttaaaattagctacagtgtaaaagactccttatgatcacctattttctcaataaggttcagagtccttttgctttttattttttttcctagtaaatattttaaaggagaaaacatacttagtgagtattcattatgtaacactactatattgggcactttacgtacattgtctcattaattcccataaaaagtctgtgttcaaggcattattatccccactttttatattaaaagttgaaactaaaagagattaataacgtgttcatagcaaatagccggtaaataggagaacaaggatttaaatacagatttacttgaatctgaaacccatggttcattttgtaattctgtgctgccaatctgttaatgatctgtctcccacagaattttagtatatgtgtttttatgtgtgcaggtgtgtgtctatacacacacacatatatttttattctacatatattgtagaatataagctctcttttattaaacaaaatatatgttactggcttcatcctaaattattatcattattattattattattatttgaggtaggatctcactgtgtcacccaggctgaatgcagtggtacagtcaaagctcactgctacctcaacctcctgggctcaaaggatcctcccatctcagcctcctgagtagctggaactacaggcacacaccaccatacccggcttaatttttttatttcttttagagatgaggttttgctgtgtttcccaggctggtatcaaactcctgagctcaagtgatcatcctgcctcggtctcccaaagtgctgggattacaggtgtgggccactgtgcccagcccatcctaaatccttgaataactttttcttatatcttctaatgcatatgtagaaagacatgctactaatctgaattctggcaagatattcttggtcacttggctgttaaaagatgctttgcaatgaagaattttttttgttgttattcttgtctaaatctaaactagaggtcagcaaattctttcttaaagaagtgtcatataataaatatttttgacttgtgagccatataggttctgttttgactgttgtagttagaaagcagctatagatactatgtaaatgaatggcttggctttgtctcaatggaaaactgtgtttactagaagaggcagccagcccacaggctgaagtttcccagtcgctgatagaaacaattgaatatgccatttaggctaataaatggatttaacctttggcatctcatgaacaatgtcttctgacttacagaacagaaagaataaaaataccaatgcaaggttaacagtgctttgatctttgttccttagttacctattcagttttcatgagtaaatgattataaacaagagttctcttatttggaatatcgtatttcagagctctccacctcactagatggcaattcccgtggtataatttctctcggccaaatacactagagtctttatttatggttcttttctccctcagagcctgtaaacaatatgctagtaaattcttttcatcctgtcttccaaatatcttccaaattccagccttttctcacaacagccatcttttcaactctggcccaagcaccatcctctctttcctggattattataatatccctcctaactgacctaccttgtacccgtgtacccctgcaatctgtgctccactcagcagccacaaagattctattaaaacagaagtcagagcacattgctcttctactaataccattgaagagtttcctgcaccactcacatttaaagcccgagactatatagctccttccaaagccctgcatctttcctggcctcctttcccacttttgtgtctctcatccctcatttctgtgttataaatagtgtcatagataaacaaagctggacactcctaaagtggtagggacagattttaatcaacaatggattttacagaagtaactgggcattttaaagggagaattagggagtaggaaaaagtagtatgtgggggctcagtagagtcagggaagtaaaacattacaaaaggttagttggcgtaaacccgatggggccagctgtgtttgctagctggaaattactgaagctatgattccatcccgtcacagagactggaaggcaaaggctctattctcaggtattggctagagcaaacagtagatttttttggcagccttgagtcttgtcttctcaagcaagcactttaagcggagctagagtcatcttagggatatggcattgagctgttagaaactgttagtgtttgttcaagtctttgtaagccaaggtgaaggcctagtcaagaagagggcttggaggagcctggctatggtttagtcaaggagataatatttatcagtcattatagatacaaaacaaatcagaactctgtcccaccacttgctggctgcaagaccttaggcaagatacttaaactataactttagttttctcatctgtaaaattgggataataatagttcctatctgataggattgcagttaagtaaattaatatgtgtaaaacacagtaaatgctcagtaaatttagttattaacatttctgccctgaactgcattacaatggattagttaagaaatgttagcaagtagctaatgcaaggccctatatgataaatacattagaatacttgaaataaagaattacagaggatcaacctgggaataaagagagtaattgcaacaatattttagtcaggactgcaatcataattttctagagcacattatggaaacaggttagaatctacatttctctcttgctttatttagaaaatatttatggaggcagcaggatttgaagaatgtagttcaagaggtagggagagagacttggaaacaaaagtttagaattcctgtaaagctaccattctagaaatacggctgtaaacagatgaagtattcagaacctcaacttttataattttgtctttaaaagaaactagtaattattaaaggtacaatttgctaagagagaaaaatttatacactatagtcataagataccatcactgtcaaacatttaaaataaaaattcaaattgggctgcatgcagtggctcacacctgtaatcaacactttgggagactgaggcaggaggattgcatgaggccaggagtttgagaccagcctgggcaacatggagagatccccatctctacaaaaatttaaaacaattagctgggcgtggtggtgtgtgtctgtagtcctagctactcaggaggctgtgacaggaggctcttgagcccagggagttgaagctgcagtgaactatgattgtcacactgcattccagcctatatgacagagtgagaccctttctcaaaaaaaaagaaaaaaaattcagtgaagttggttaaaatctctatatataattataaaggaataatccctctataattattaatacataaatatccctctgtaagatatttggtgtatcaaatagatctcaaaaggcaaatatataatatttgaatatttcagtcaatagaataattttatatatacagtcatgttcttcataatgatgtttcaatcaaagggactgaagattataatggagctgaaaaagtcctatcacctagtgatgtagctttcataacttcatcaggaacatttttgtggtgatgctgctgttaacaaacttgctgtactgccagttatgtaacagtatagcacatacaattctgtatagtacataatacttgataatgaacgactatgttactggcttatgtatttactatactatactttttatcattatttagagtgtactacttctacttcttaaaaaaaaaataaaggtttattttaaaagagcctccagcaggtccttcaggaggtatttgagaagaaggcattgttgtaggaggtgacagctccatgcatgttattgcccctgaacaccttccaggaggacaggatgtggaggtggaagatagtgctattaaataatcttgacctgtgcaggcctaggctaaagtgtgtgtttgtgtcttagtttttaacaaaaatgtttaaagtaaaaaaaaaaattaatagaaaaatgcttatagaataaagacataaagaaaatatctttatacactatgtaatgtttgtttttaagctaaattttattatatgagtcaaaaagtttaaaaattaataagtttataaagtaaaaagttatagtaagctaaggttgatttattattgaagaaagaaaaattctttttttttttgttttttgtttttgagacggagtctcgctctgtcgcccaggctggagtgcagtggcaagatctacgttcactgcaagctcctcctcccaggttcacgccattctcctgcctcagcctcccgagtagctgggactacaggcgcctgccaccacacccagctaattttttgtatttttttagtagagacggggtttcaccatgttagccaggatggtctcgatctcctgacctcgtgatctgcccgcttcggcctcccagagtgctgggagattacaggcgtgagccaccacacccaaccagaaaaatgcttaaataaatgtgttgtggcctaatgtacagtgtttataaagtctacagtagtgtacagtaatgtcctaggccttcacattcactcacctacacacccagagaaacttccagtccttcaagctgcattcatagtaagtacctgaaatggtttggatttgtgtccctgcctaagtctcatgtcaaattgtaatccccaatgttggaggaggggcctggtgggaggtgattggatatggggtcatgggggcagatttcccccttgttgttccagtgacagtaagtgggttctcatgaaatttagttgtttaaaagtgtgtagtacctccccctttgctgtattctccttctctggccatgtaagacgtgcctactccccttttgccatctgccatgattgtttcctgaggtctccccagccatgcttcctgtgcagcctgtagaactgtaagccaattaaacctcttttctttataaattacctagtctcaggtagttctttattagcaatgcgagaatggtgtaatacagtatcctatatatacaaataccattgtgttacaattgcttccgatatttagtgtagtatcatgctgtacaggcttacagcctagaagtaatagtccataccatataacctaggtgtgtagtagattatatcatctaggtttgtgtaagtacactctgatgtttgcacaatgacagtactgcctgacacatttctcagaacatatccccattgttaagtggcctatgactggctgggtgccgtggctcacgtctgtagtcccagcacctttggaagccaaggaaggtggatcacttgagcccatgagtttgagactagcctgggcaacgtaacgaaatttcatctctacaaaaaataaaaaaattagctgggcatggtggtgtatgcctgctttcccagctacttgggaggctcaggtgggaggatcccttaagcctgggagatggaggttgcagtgagctaagagtgtgctgctgcactccagcctgggcaactgagtgagaatctgtctcaaggaaaaaaaaaaagtgacatatgactgcatttaacacatagtaaatataatctaacatataaatgtagataaaatttatatttggggaagagaatataaattctttcccaatacatagagaatatttataaaaattacatagcaggatattaacaaattttagttgactataataattagaatttttaaactcatgtccactcataattcaataaaactagaaatagaccaagaaatgatgtcatggaagacttagctacttagaaattaaggaccattttttctgcacaatccctggaacaaggagaagatcaaacctgaagttttaaatggtctagagagtaatgactctttagtagtatccagtaaggaaaatcctggataataaaacccatgagaccctaatgaagtactcagagaaaaattaatagccttaaaatgaaaaatagaatgaaaatacaaatacaaagtcaacttaagaaatgaagataaatattaaaatcaataaaaagaaatgaagtgatacaagctaaaaataataaataggtttaaaaatggaaaacatcaacaaaataaattatttctttgaaatgtcctttaaaataaactcatggcaagccaagcatttcttaaatgccaaaaattatgcattattaaaagttagaaaagataaaaggaatttttagacactgttatgtgcaactgtgtgtcagtatattttataatcttgaggaaatggatggttttctagaaaaataactgaaatttatataagaagatatttaaaaacttaacagaccactaactgtagaagagactggaaaattaaaaaataatttttatacatacacacacacacacacacacacacacacagagacttctaaagatgagaattatttaaccaaaaacactgagaaaaacacgcatatggcagaaaaagagttaaaatactatgtatataaagagttcctatagattttgaagaagacaagcagcccaaaagaaaagtaaattaggaatattaatgtaacagaatgacaaaaattcgttcatgttaataatcagataaattaagggaaaaaagttactatttttttttacccattaattttgcaaaaattcaaaagagctatgatatacagagcttttaaggatgggaatacatgggacagtttcatacattgctggtgggagggtgcactgctacaagctttttaggaaagtagagttatcttctaaagtaaaactactcatatccttaaaattttgggagatcattctatggaattttatgcaataaatgaaagtctgagttagaactacatcttttgccctagaaatattgccattatatattaagtgagaaaaacaaaccacagagtcatgtgcaaaagtgtgatcctatctttttttttttttcaataggttttgggggaacatgtggtgtttctttggttacgtgaataagttttttagtggtgatttctgagacttacctgcatctatcacctgaccagtgtacactgtacccagtgtgtagtcttttatccctcatctccttcccaccttttctcccaaagtccattgtatcattcttatgcctttgcatcctcatagcttaactcccaacttatgagtgagaacatatgatgtttggttttccattccttagttacttcacttggaataaaggtctccagttccatccaggttgctgtgaatgccattatttcattcctttttgtggctgagtagtattccatcgtggaatatatatatatatatatatatatatatatatatatatatatatatatatatatatatacaccacattttctttatccactcattgttggatgggcatttgggctggttccatatttttgcaattgcgaagtgttcaagtatctttttttgtataatgacttctttttctctgggtagctacccagtagtgggattgctggatcaaatggtagttctacttttagttctttaaggaatctacacactgttttccatagtggttgtactagtttacattcctaccaagcagtgtaaaagttttcccttttttaccacatccacaccaacatctattattttatagattttttttattgtggccattcttgcaggagtaaggtggtatcacattgtgatattgatttgcatttccatgattattagggatgttgagcattttttcatgtttcttgtccatttgtatatattcttttgagaattgtctattcatgtccttagccactttttgatgggactttttgtttctttctgatttgtttgagttccttgtagattctggaaattagtcctttgtcaaatgtatagattgtgaagattttctcccaccctgtgggttgtctgtttactatgctgattacttcttttgctgtgcagaagccttttagtttaattaagtcccacctatttatctttgtttttgttgcagttgcttttgggttcttagtcataaagtctttgcctaagccagtgtctagaagggttttttcaatgttatcttctagaatttttatggtttcaggtcttagatataagtctttgatccatcttgagttgatttttgtatagggtgagagatgaggatccagttttgatcttctacatgtagcttgctaattatcccagcaccatttgttaaatagggtcctttccccactttatgtttttttttgctttgtcgaagatcagttgactataagtatttgggtttatttctgggttctgtattttgttccattggtctatgtgcttgtgtttatagtggtaccatgctgttttggtgagtacggcctcatagtatagtttgaagtcaggtaatgtaatgtctccagatttgttctttttgcatggtcttgttttggctatgtgggttcttttttggttccatatgagttttaggattgtttttttctagatctgtgagcaatgatagtggtattttgatgggaattgcattgaatttgtaaattggcagtatggtcattttcacaatgttgattctacccatccatgagcatgggctgtgtttccatttgtttgtgtcacctatgatttctttcagcagtgttttgtagttttacttgtagaggtctttaacctccttggttaaatatattcctaagtattttatttttttacagctattgtaaaaggggttgagtccttgatttgattctcagcttgatcactgttgatgtatagcagagctactgatttgtgtacattaattttgtatcctgaaactttgctgaattcatttaccaggtctaggaactttttggatgaatctttagggttttctaagtatacgatcatttcatcagcaaacagtgtcagtttgacttcctgattaacgatgtgaatgcccttgatttctttattttgtctaattgctctgattaggacttccagcactatgttgaacagaagtggtgaaagtggccatccttgttttgttccagttctcaagggtaatgtgttcaacttttccccattcagtataatgttggctgttggtttgtcataaatggcttttattaatttaagatatgtcccttctatgccaattatgctgagggttttaaatataaagggatgttggattttgtcagatgcttttttgtgtctcttgagatgatcatgtgttaatcttgcctcctatctgccattttccttttttctctaagtgtgatcctatcttaataaaaataaataataacaaaaatcccaatatacatgtgtctgtttggttatatagttttaaactagcaaggagtaagttataaagagtcacatcagcctaaaaacactggttcccttggcgaggtagcaatggaggaatataacagaaaatttggggaatatatgttattttatcattgagaagatcatctattattttatagttgttaaaaattaataaagaaaaaacaatatcaccaacaaaaaggatacagctagatatcatgtgttttgatataactccctacttttaaaaatctctagagggattttccatacagagcctctaattgataaatgtttcattcctattcccctgctttgcaccggtgctattaaaagagcctgattaattaaagaatttaagaaatttggtacacatttggaaacaaatagatccagatttgtagaaggtcattcttctattatagtccgtctgaagatatttgtggaaggcaaccatgcatatcttttccacattagcaacaaaagtgattctctttgcacttattagccaccagaaaaattctctttgtttcacttattttcagatttatgtagtctgaattaatatttcaataaccctcttcaagaaaagcatttggaactattccacatgaatgttgcattctttaagcaaaagtgcagaacatactttttcaaggcacagattgcttttcatagataatgtcttctccttaatcatgtataaagggacgaatctgatgtacacattagagaaatggctctgtcttagcaggcaaaagtcacctcattcaacaaagctcacagcacttttaaagaggagggtatataaaaatagcaagtacatttctttgtacaatgtgtcatactcccaccctcagcgaatccagtattaaatgaaaacatttgccatggcaacatcgatttacaaagggcaaatgatgtttctgagagattggagtatttcctttcatagatttcagaagcacacacagttaacactttagcaaccttgtttaataactatatatatatataactataaaagctttacttgattatttttaagtattggagataaaatccaaaacaaaacaacaaactcctaacaaaaactgccatcaaagtagattcaagcaggaaaaaaatatcactagaacattttagccttcactatttatgggaataacaattatttcatgtggtaagctgtgctaaattaaatctgtgaatgatcattttgctatgaaaatgaaaattctgtttatcttaccatttctacagttgacgttatcagttataatatttagcctcctcattttggacatctttaaaatattttatctatttttcataaatgctaaggcagaattcacagattgcagttgtagtttcatctatttgactcagactatgaaggcagacacagtagatgtaagaaagaagatagattggtagcctgagtaaatgcaagtattgaagaggtgaccttagtggggtcaaacaagtttagaagttaacaaatagtctctatattttttctcagcttgtcataaccactccatgatacaaaatggagaaaattgtggccagaggtgaggaaattaagtacctgccctaaatagtttatagtcaagagcaaaaaatttgtcttactcatttctttaactctgccagaggtgaatactgttctactatctaacctttatttaatgggcacagtaagctgggatctagaagcttatggcttctgagtgtaagggaacttctagtccttcagtcaattatggcaggagtcagttgaaatgaataaggtgtttcatacagttaccgcccacagcattcaccagtgaagcaaacaaaagccaaatctagcactgttttaatgttttcaagtctactgttgtttgaagactgcaggttctttggaagaccttgtatcatttattttctcacttgcctctttcttgaacatgcattccccacgattcaaaaatatcaattgtcaaaaagtttataaatgtataaatctgagatagtttccttgcatttgcaaagcaaatcctccagaagatatttatcatggttaagaatttatagagaatagagattagcaaacctgtgatttgctgtcctgtttacatttattatgaaggataacattaattaaattaagaatgatctcttcattgtggaagtcagttccagaaattattgagaatgaggtttttttgcgagataaattcaaaccttctagcaaatcccaaagatattataatgtacatatgagtattaatagagttaattcaggcatatataatatttttatagtaattttgcggagtattgaaatgttaacaagactgaaatgattttccaccccttcttttttttaaataccagtctgccacaacatttttcctcttaggcttttatgttgccattgttctttacattcatttttcagtatttaaatatctgtcactgtaatgttacagaatacgtattctttctctgtaaacctacctgaccctctcacagtgatctgatctgagcaccctgttgtatcactcttatagaaccattatattgtcactaattatagtgattattttttatgttttaaatatcttgcactaaaggatctctgaaaccaatgactgcatcttactcatctttgtgcatatttttggttagtgtatactcaaacttagcaaacatcacagtctgtatttacaagaagccagcttctgtctgtcctgtgggaaagatattgtttgcacagtattctgtattgtgccttgcacatagaaggtactcagtgagtatctgttgattaactgatctcccttgaatctacacctagttatttcttctgttcttcaatacaggtaggaaagtaagttggatgatgacccatatagtatcaaaaagattgtctatcttgttaggactatattctcagtgccttgcagagtgccaggtacttagtagacattaagaaatatttgttagggattgatatttaatgcttattgctatggcttggatgtggtttgtccccaccagaactcatgttgaaagttgattcccaatgtggcactgttgggagatggggatgtttgggccgtggaggcagatctctcatgaatagattaatgccctcacatgggggtgagtgagaatggattagttttcaggagaatgcgttgttcgaaattgtgcctccctttgtttctctctcttgcctcctctcttaccatgtgattttgcacaagctttttctccattctgcttttattcatgagttgaagcagcctgaggcccttaccagatgcagctaccgaatcttgatccttccagccactagaatcatgagccaaccttttttcttggtaaactactcagcctcaggtattctgttataggaacacaaaatggactaagacagttgtgttcttcagtcaaagcacagagcacattagcaagtaaagcttgattaggcagttagacttcaaagaaatttatagtgtagtaaatatttcatcttcttggttaacatggttggaaccacattagactatttacctctttagtggtctaaattctaggtgtatacaattactttaatttttttccttcaaaatgtctttcaaatttttcccttttcctctctgttccagctgcactggtttctttgatttccttgcacttactacatttcctctcaagtctgtgcccatgttgtcttcttgctaagtttactcttccctccctgtttaacctggtaaataccttctcatctttcagatctcagcctgggcatcactttctcaaagaagcttttcctgaccacctccaattccccctattcctcctgttccccgcatcctccaccttttagagtgctatggtagctctcctagcaccccatgcctctttttcagggtaaccttcacaaatgcagtttcacatttgttagcatcgttattcaattcatgcctatatttcttcaccagactgcagactatggagggcaggaagcacatcaggttttgctcatcattgtatctcatcagtctattccagtgtatggcagtagccgactcaatatgtatttcagggataaacagacatacggggcatatgggtggatgaatggacgaatttccactgctactctccaattatagacttaatccagacagcaacacttcctggtctgttccagctccattgcttccccctgcccattgtatcctccttgcacattctcagttccaccagtgtgtctcctaaaggactgcacctataatttcatgccccatacccctctcattcagcatgactaacatcacatttaaacagatctaaattctaatttaaatcaaattaatattctctaaattagacaaaattctcaaatcaaatctaaattctccttatctcccaaggccttttattatctggttttattcagtctactcaatttcctttctcagaactccctaaaatgtcacctctgtacctaatagtccagttaccagactgtccctgcctccaccacacttactcccatctcagggtttggttcaggctgtattttcaggtcccccaagtgtcttcctcttaactttgtttatctgaattcctcccttcctgtgtgaaaacttaatgtctcttttctgagcctctctgatgctgagagaagtcttggttacctccttttgtttccttttttttctttaaaataatgcttttatttaaaataccctttttacaaatattaaaattttattgaattaatatgctaaaatcacatgaacacttggcaccatttgaaatgtaatcctatccatggaatagaatgcaaacattaactaaatgtaaaagggggacagatttaggactttaagaacatgttttaaaataaaagtttttaataaatttcagtactccttttgttttttgaggtttccactttataatttttaaaatactaagaactgccaaagagaagtataaaaacagggatgtattttatgtgctggatattctccactggcctctccagatgtccttcccacccttcttcagcctgctccacgctccaggaggctgacctttatggactacattaatgggctcccttgctctctggctttcagtggctttagtttgtgggaggaactggcagaagactgggcagcaggaggataaggaggtcagagtatttatttccttggttccttttctggtaggcagcaggttggcagtaactgggtttctctaatgatgccatagctcctatcatctctcatggttataacagtttctggttttggtaactcttcctcttcttggctcttaggtttttgggtggtacagtttgctgctttataaatccctggggtgttttaacatccctgcatgcttcccttaacctagccgtctttgtccttgcttccttggttaaattcttctgaattgccccctttatttgtgtcttctattttttttaatggaacattgatatcatttaaatattaactatagcaaattaatgctttcattatagaaatgatacagtgtggttatggaaggaatatcatcttttttgattcctatcttgtgtctctgactctgcatgatcttgttaggggaaaaagtctggccaagtggccctcctccttagcccccttattgggcctgtctagaaccaagtcagcggtttccttggtccccttattgggcctgtctaggaccaagtcagcactttggtctctcccgtctcagaattcctactacttttttagtccttacaacaaggcttaacacttcaccatttcctaatggcagactttgtctcatccattagattctaaagtttctgagtgaaaagagtatttttatatctatttttatgcccctggagcaatacatacatagcaaaaaagatcttaaagatccttttctttccttttccttgtaatgtatttgtgaagaaatcagggtatttattcgatagagtatcatacattttaggttttgctgattgcatcactagagtatcatttaacatgtttctctgttctttttcttttttgtgctggtgcatctagaggctagatcagatttagattagagtttttggcaagaatgtttcatagatggtggtatgtattaccagcagaaggtaatctgattgtctctcttcttgtaatgttaatactacctattaatgaggaaatgtgaggttgataatccattataaagtcttttgtcagcttattatctattgcttttagttgccataaatgatcatcattgccgtggttaattagaagttacgtatgataagtattcttctcattccttctgaatttgtcagtggaaatacatctatacaaggaaactttccctcgtaagctatttgatcacctttaaatacactttatgttgcttacatcatttttgttctataattgctagatataaaacttttcttgtaacacctactcatggtcattggactacagaaatctaattatatattgatgataatttagaattgtttaatttaattgtacttaccatgatgtgtggatttgtgcatgtgtatttgtaagcctgagaaaacataagaaaataaagccgattttaaagcattgtaattttgttgttgaaattaggaattttccgaggaggtttagggaagaatacaatgtactaaaatgtagtatttatgtttctaatgtaaaattaacttatgacaggtaaaaacatatctggaaaatgggcatttgcagttcctacagctatttggttcatatactaataaccccattaactgtgtgacaagtatccactgggagtttagaagacaacctttgtagagtccttccttttcttgaattattaatattatctttgaatggaagttgcaaaattgcagtgggataaatttagtttgatagacttaaaaagcataaataaaatgcttaaaggaaaaaatgactcaatgctctagagctgtttttataggatcaaatcctttataaaaggtttttagtcatgaaacagaacaaaattcaacaaactaattcaactaacattcactgcatacccagttcctatgtcaggtagtctttgggaacacaaagaagaataaatcaaggcgtcaccccttaaaacacaatccaatagcaggactagcaaaaaaggagttttgttgtaattgcctaatactgaagtagaaatgtttacgacatataaaggaaaatccaagagcaggccaaagaatgtttttatatttgattttatagttcctcttaaaagttcaaagctaaggatgcaaatctgttgaaacgtttcttttatgagttagaagtttaagggaaatgaataggtcacagaatcactgtgagggaggtagggagaagcagaataactttgcccttgaccattatggttaaatatatgactccatcactaaacataagtaccccatgtctgtttcacctctcctttgaaaggaaaaaagtataatttttcagaaggcacagtttcttcatattaacttagaattgaattggctttccatctcttatttctgtcaacattatcaggcttgctaaactgggaatgggcattttatcattctgtcttcttatatcttagtagctagttaagagactcagtggaaactgcctagatgagtatatttaattgatgatagatgaaaagacaaggatttcaaaaattctgaacaggtcaatacattgaaatgggcctggttacctgaaaattatctactgatgaataaacttagaatgctgtcaggacctattgtttgcctacttttcagacatctcctgttctttcttgcctaagagaaattcccttttgttccagcattggccttccctttcctgattagactaagccaattctggtcattccttttctcttcctaatgattgctttagagatgggcatgtggtataattctggccatttagatgtgaggtgaagtcttttggagctgaagtgcttctgggaaagtgtcattcttgaaaaggaccttaaggaagagactttccctcccctagcctttggaaattgcattgggcattgtgacaacgacatactgaagctactgcaaccatcttgtgatcatgaagggaggcaaatccatgaaataaaggcaacatgctgaatatgacaaagctgaaagatggaaagaacctgattacttgatgacgttgtttagttgctggatgaaataatcattcttgcatttgttctacttctggacttctcattatgtgagagactacatctctgttggtttaagtcattttaagttggtcttctgcaatttgcagccaaatgcattcttagtgatagtaaacattttcttagacctcttacatgtgactgagatgccatgtgtttaatttagtattatctttgtgatatgtcccgatgactgtatgcacaataatcccaataaagaaaagagctatttctgataaacactttcatagccataacagtgcattgccattttgctttttaaaaatcattgtaccaattttaagtgtcaccagcaatgaaataaaaatttaagcatctttcaagttgaaaattctgctaatagttgccatgagtacatacatttatttgagttttacaagattatttgcatattttacatactgtctttaacaggaaccatttcaggcaatgttatatggtgctgataccagttatcaatgcgtaacaaatagtaaaagtgcaaataatacatgaatacattaattttcaaattgtcgtttgttatatatgtagcagagtctcacagtttatagactattcttcaagtaggcaaagaaaataaatattttactttaaaaaattgatctaatttagcttattacacctgtgacctctgggtatcaagggaagaaaaccttcaaaatatcagttaaaggtatctcactttcttctggttcaagacagtcacctcaactttttagtaagctatacctcctcttcccttttttatttgtcagtacagtatttggttgatggaaagggaggtcttacatgaatggccttgggcagtggaagaggtcttaaatgaatgggattcattgcctctgtttccttaattggtgtcaatttcaataactgtgattatgaaattaacctccatttggccagaggaatttcttttacttcttccttttatttagaaaggtattcccctatgtcatgctttctccctttcccagcttagctttagccctgccaacctccttggagccataacagaatgcttgctggggaaccaaatatgatttatgtgggagaggaatgtgaatacattcaaaatactagtattacaaatatgtaaaacctgaaaacccaaaaccttgcacagaactgtaacatttataaatatgctgaagtctgttgggttgtttctaaaagtcatctactttaacattgtagtttttattcttttcttactctttcatgtgaaaagtatctgcttttgtagtatatcacttcactagttcccagtgcatcataagaagttaaaatcactgtgtgctgaaagggtaaattaggtgtttaggttcctaagtttgtgttggtatcactagtctatggaacagaaatagtttccagggttggaagtcaacaagcatccattgaaattctctacttggtggcatattcttgctggagtctgtgtaatatcaacattgctttaaataattttccttaccttattttattttgactatttgagatttttaaattaacctattgactcatcctttttcttttgttgtctcaagctcttcggtttttgtcgctgtttttattgtttgtttttcccttgatgttttgtctttcctgtttctcaatctgccctagtccctgtgatcatcaccaaaggaactggtgggaaaactttgtggtgactgctatgtaccattgctgcaggcatttcttgaatggggtcagtgtagatgacagcactagagatcctgggggtaaataccatggacagcgagtgtggctagagctttacatagtcttgggaagagcttgaactacgagaagagtacccacagggtctcagtccttctagggggagccacagagaagaagaactgagttctttaaaatattaataagttagggatattaacacaaaaggtagatgtccagatattaatattgtattatagacatgcctataagaacacagcttacttatggattttgattatccacattgtcaactaccctctccttaaaacttctctttctttgtcttccaaggcatgtggctaccctgatttttctctgaactccttggccgctgttacttggccagccagttcacagctctgtcacttctctttcccttttttctgtctactctcaatacgctgcctcctctacacacattgcccaattactatccaatttttatgtttcctaaatttacatctttaggccaagcctcacctctgaactccagaccttgacccaactgcccctttgacatttacagatggattttcaaaagctgctcaaattcatacatgttcagtgccaaattcattatcttctttcaaacctggtcatccgtgttttatgtctcagtgaattatatcaccaatacattcagttatgcaagccagaaatccaggagttattctcaacactgcctccttaccttcctttcaaatccactccccagtcatgtctattttaccttttaaatgtctctagaatctgccctcttttctccttctctactgtcatcacctagctttaagctacaatttttctgaatagttacatggcatcttcactaacctcatctggttaatttccatgtcattttcctacaaaaaaaaaaaatgtctgtggctttctgtggctgtcatgaaaaacaaaacaaccaaaattcttaaatgaactacaggccctgcattgtgtgccacatctacatgcccagtccaatttaaaacatgttcctctgtctgtgtgtactggcttttgttttttctgtcacaccaagttctgtctaattacacggcctttgaaaatactatttcttacgctaaaacattgccaaccccccttgacctagagcatttcctctgaattattagcttttgtagcaatctatatttcttctttgtagcacttaaaacagtaaaaatttaacatttatgtgtaattatttctttgctaaactagtagactaagttttatgagggcagagactatgtatacttttgctcacagttttgtgaatgtagaacagtgtctggttcctgggaattactcatatatgtttgctaagtgaatgaatggatgggtagaagaatggctttctgtgcagccattgaaagagatttaaaggtaggcaagtattaatgagatgactatggcaagatatattagaattagaacaggcctggggggaaaaaaacacagaaattgagaagaccactttgttttctgatggttcattataaatgtcaagagaatagaatgcaactttggcagtaagatagtggacagacccattcaagtctagagcttctctcctatgaagctgtattgtctcagtatcaaatataagccacttagcacagaaatatggtgtttggggtagtcattgaggagcctttgctgttctgaagtgtccacaaacagatttgatacatacagttagtttctaatcatttgtattaaaggagaggaacatcagtgtgaataaatgttggcaccaggttcagaagattgactgattccgtattcaggggaacttgatgaaaagcatgaaccactagcttaaagttgggaaaggtgagtaatggagatcgtcagcactccctgttcagaatagcacagtttccttcatgtaactcccgagtccccatcacagggaagccaaggaggtttccaccgctatcgccaccctgttgtatgataggcaattaatgatagtagattattagtatgttcctttttgtttactcataagtgaaagtatgtgaaagctctaagacagctgttccctcaccaaaatatttttccctcatcgtttgctcatacagatttgtaattcccatagaagagcgcttgccaggagagtcacttccatttgaactacttggtgttgagattcttctcatcatcagccacagtgtgattatagtttaaaaatgcaaatgggattctgggatgaatcaactgaaggataaaattcatatgaaaaagtgatctgtataaaaccctaattaggcagcatctatgatacagcctttcttaaactgtgagtttattgccaccaaaagaagtagataagtgcaaaattcaacaactatttctagagctcccagtatgtgtcagatataattctaaatacctagaatgctagacagacactgttacaagattacattctaggttgggaaaaatgttgataggggatggaactagtatagtggtaaggacaaaagcgaagcattttggagaatcatttgggaacgttttaacataaaatcttcactatgactgtttcttccacagcctaagaaatatggtaacatctttaaaaaattaaatggtaagaaaaagaaaactgggaaagggaaacaaggatagactacatataatagtgatagtttaaggaattttatctgttattaagtgtcttaaattctggcttcagagagatggattatttaaacttgagtttttttgcttcagaaaatcttttatgctttggtataattttcttttgctctagcttccttttatactaggatgaggtggagagtacaaacaccacggagttagtgtgagcctcctatgcatgcattaaaaacactttgggagacagcgatttgattcttttacatagttggatcacataaaataaaactttgaaaaataattttccaattattttcttcctctcataatcaaaattctggccaaagaggcttgaccactttccatacgttttccttgttggatgggtagaactaccaacgctcttgaaatttccattagtttttcccaaaatgcagttattcaaaccctaaatgagtaatatgtggaaacgtaggactttagggttccttaccagtttgtctgggttggatttaaaatgtacacaatcaggggttggtatagagactattaccaactttctgattagctactctgaggtacaaagtcacaactgccaccacaagatgtttccactggttctgggttttgattactcctattgcatatatttatggtgtacatcatgctgttttaatattcatatacatggtgaaattattactatagttaagcaaattaatctctccatcatctttcacagttatttttatttttattgtttggtgttttggttatttaataagtgatgacttagaaaagttaccagagaccatactatacacaatataatatttctatgacttatggcctatttacagggaacaaccaatttacaaatagccaaagaaataagcaaaagggccataaccagataaaactgcatcatgttatctatttgtacacctctttgtgtcatcacattgaatagtctttaagaaaggtagtctgggaggattctgtacaataaaaggttattattcaatcaggatcaaatcatagtattcaacactagaataggaatgatatctttggtttccccaaacaaaaattactggttttatgtgaacagttttcatatgtaataatatacagagattttgtttgtctcataataatttaaataagcagttgattttattaacgtccttttccatagaaaccactacatctctattcgcaaacaactaaatcaaaataaagaatgctatgagagaactaactcttggttaaaaatggggagtaataggatattataggagtgttatagtaataaagcctttttatttctagcacactatcttcttttgtcagaaaaatgtacttttcttggatagttcccagtagcatcagtaaaaaggcatcagcaatatcatatccctctcgattcagattcggctgatgtgccaaaatagatagcactgggcaccatggctatgtagattcatattatttctccctttttgtatatctgagccttatgttagcagtttgaatctttagtattttacagacagtcccctggcaccaagctcagatacagtgttctttccacagagagaaaaagaggattcatgatgatgataaatggaaaattgtgaatggttgtgctggtagtttgggttgaattatagaagcatccttactaggacagtgtgttcataggaagactattataatgggcaataaggtgctgtctttatctcttcagaatgtgtttcagagaaacattgatctgagttatgtatatattttcaaataactttgcagaaacaaaatagtgacaaaattaaatggctgtggctctaatctagttcattgcagttagtcaccaagcttttatgaaatgttctcaggtgctattgaaaatgtagggtacttggactaaaacttcctgttaaattttatgttactttgattcccttatttctcccattaatcaactaaacaactaaaattgtgtctaagaactgacaacatttttttagagaggtttgaaaaataccttttaacagctatctttccatagtagaagagaagtgctttaataacctggtacaaatttcatttcaccaatttccagattgttttttaactgcaaacaaattacttaccatcttcagcttcatttttccatgcgtaaaatggtgtctgtaatacctaccgaatagtgttatcatggaaaataactatgatagaaacttctaattgtgtatgatacttgtctcctgcagagggtctccttcctcccttcctttccctcccctccacttccctcccctaccctccctttaccccacctctctctttcttcaactggctttaacaacttaggaaagaaatagtggaaatgggaatggattatcattattagacaagttgtaagccaaaaaatacaaattgctagaagaaagacattttcaaattattctcattttaaattgggtggctgatggtaaaaaataataattatagtatggatctgatgaattataagtataaatagcaggttcctttattctctgtattatatgtgaccatcattgacttaattttttaaatcaagaaccaacttgctgaatttgatatatctatgtatgcctataacttccctattccaaaaacaatgagataacttataataaaatcaaagatagagtaaaatcgaaacctgttattccaaattaaaaagaagttctgtttccttttcatcataaccttttgatcctttttcattataaatatatgcttagctgctttaaatttacttttgtttttatatttgcttttaagtcattatttgtcacattgctgggaatgatcttgaatatattagtataatgcacagagtgcatatattcagatcccagctcctgcactttttggtgtccaagataaataagccaacaccacttaaagtggtaaaatagattttattcagtagttactattgcagtagggaagtgggtccagtgtgaagtgaacctaactttgacaaaacaaaagggaggagaccttttagaagctggggtgtggtgagggaaaggcactgaaggatgtgaaagggagctggtccatgtggctgggccatctgggtttgttatttgggaggagaagcaaacttattgtatctttatgacaggaggcagtggtgtcgattagaacaaggtgcccactggactgagagctgtgcggttatctccctgaatgtaagaagacatttttgggtggtagaagatttacatctcaaaggagcagagaaaggatttacagttgcaagctttctgaagtaactgctctaagagagggtttatgcttgttaccaggttttggctagaacaaataataaaatctcctggaagcatctccttgaagggtgataggatcacatgaggggtgcagctgtgacctgttagaaactgtgctaatgtgtttcttcaggtctcttaatgtgtgtgtgtgtggggggggggcgggggggaagagggtagacaaaatcagcacaaatccttattagcaaaataaagttgaatctattataaagacttctaagaaatgaaacaatgctgaaatgagaagaaaatggcatatataaaagtagtaactaagaatagatcacatctcagtaatttttcaaattttaagatatttgtttgatgtgtacttgaacccccttgttttttaacacacaagtagaaacataggtacaaaattcacaattttttggtgctaattgttaggtttagaaatgccaaatgatttctatccatgttagtggaatctgatcattccagctctgtgcagtaataatccaggaagcatgaattattaaaagagtgcagcctgtatttgtattgggcatattattaacaatagcacatactttattgtgtatggatttccattaaggaagtggagtacattgaatctcattctccttaaattgtaatttttatcactaaaatttcttgatgttaatatatttgatagtgaaaaaatgaccatttagatgagaccaataactagaaaagaaataatagcttgagttaatgttgatttcttcaatgtattacataaaaaaatttaaagtaagggagggcaaccaaaaataataaattttaagaccaacttttattcattgtacttctctaatatttgaggcatttgtaaagtgattcaggaaattaaatatttaattttgcaaatagcaaagatggtcaaaactaacttctaccattttaaaatcaaatgcattaaattgttctactctttttataaaagcatctaaaaatttgccttttaacttagagagtattagaaatatcactcatgatgattggctttataaataggatctaaagttgtttaggaaagagtcttagacaaacttttagggtatctaagttctggacttagcctttccattaacctgccactcagccctcagaaggaaaactaccctcactgactactttttacagtcatagaagccacgttttaatagttattatttcttccttactagcaacagtttaatttggattttttaatcttttttttaatagtccgatacatacttctgcatgtctatgcgaataccagtggatgaggaagccttcgtgagtaagtattaattggattgggggagtagcagtttaatggagggcagtgatttgaaatcagtgaaaggttctctttgagggttatgagcatattaatcttttactgtcagtttctaaaatgcatttatcatgcctaatgcagaaacaaactagagagagccactgagaggcaagattataaactgtatctggagagattcatgagtaatagtaattaaggagttgcatgcagatgttgatggccgccaatactgtgtggtcccatttgtatagtattggctttctgtctgtggcaggatgcttaattccactccactcaacagacagtttatttacctgctggttcatgctataaatcgactgcacttagaatcaacattggtgaatgtaagattttacctgtcagacaggtagatggatagaaaggaagggaaggagagagggaggaagggatgagaagggaaaggagagccagaaaagaaaagaaatggaagaaagaacatttatgttgttgtttgtattatagaataagagaacgcttaaatgacagattcttccccaactgagcctttaaatcagagaggaaaagtgacaaagcaccatctgtttccttctaggttgtttccatttaaacatcccttatgacagacatttaactgtttagggaagagctgtgattggcaaattattcatgtatttggcttttctctgcttcattttaaaacatttgagatgttgattttggagagaaagtgttggtagtagtactttggtcccttgaaactaatcttcaagtgggctgtctgaactggctattatgtgaattgtgaaatgtgtacagtagccttggggcagtctgaggatgaatttttatgaggtgtttcccacaggaatggacattatagacctgcaaagccagagcaatgtgcattttttattcacacacattggtggcaattacaacagcaaatacaacctttaataacactctcaacaaaatttgctgcatagttaattcctaagaatgaaagaccatacaaagttaaacattgatgatgttgttttgtataatatttggacattaccaagaaaaagttaggaagccaagttcttctatatcctgaactatctttaaagacaaaaataatttaagtttctaattgtagtgctttgagtaacactaaatattatttagaacatacattcataattaaaatcctagccataaagctttccttaatttcatattaacacacttggccacctaagagaaaataatatttactcgcaaaaggaatttcccatgaatttttttttcctaatttatattttctatgtccaagttcaggggttgttttgagtcctgttttcacaccagctatgaagagaaggccaccctacacacctgtgtaaatatggtagtcatgtgttacagcagtattacacatctcacattaataggtttgtttctggagattggtggtagtatatgattttagaaccagtgactgtaaggactataaatatatatcctgtgtgttattgctctcctactataaatgtgtttacgttcacataatttaaaatgaaaaaatacaagtgagtatattcagtcaagtaaaatattcacaggaaacacataaaggtctatattagaaccagagtgctaaatgttttcatactttcttaggcacttttcttctaagattaaactattccaagttataaggtccttaaaaggtcttgtaagattaataactattttcagtatttcttcctttgtttattacttggaggattgcatggatactgaaattttttgttccctattcacaatgggttgtttcatcttctgtgtgagtcctttaatgaactatgcccaggtggtttgtggttactgttgtttacataattcagcaaccaaagaagtttaagtatagacaaattagaactggaaaatggaaaactagagacaattagcaaataatcatttatataaaagaataagtaaaggaaattttgcatgcgttatctcgttaattcttaggacgatcctgtatagatagtctcatttcatagcttgagaaacagagacagaaacatctatatctgtgacttaatgaggagctaagacaatagtttgtatggaattctcatttatgtaacggctggaccgttaccatcatctctacctgccattgttcactaagagcctgccagacactgtaagatactgaaagctaaacataacctaagccaattttcagaagaggaaacagaaagtcagagaggttaaggaatctgcccaagctttttactagctatgtattaacctagtcgtacttcagattttggtgtggggatagtgatacaaagggagaaatgagcaaagttatcaagtgcataggtggagctgaaatatagcaagagcagcaccgttctttcttcctcacatcaaatacaattattctttcattcctttaccttcactccctactggatacactctggccagttttgccaaaggaaaaataaacctcaaaccatcttaacaaaacaaataacaaatacccatgaagatttaaagatttgtagaaggaaaggggcttggatagttatatgttgggagagtgaccatacatagcttttccagactcccaaagtgaaagttttgcctatagggtagcctatgctttttccattctaagggattctgatggcatagagaatgaagctatagcctttttgtggattgtcccaaattccagatctcaggatgccttatcctgagattagacatggttgcaaatgaagagctgtaaaaacccataatactttgttcgttcttttctgtttttaattatttttatttctcatagtcattctgtttgtttattctttccttaagacacttaatgattttataccttctgttttcattatctgtgcctctttaaatttttgtattccagcaggataggcaccgactcaataattgcttgctgaatgcgcgagtgaatactaaataaggattttggccgttttctgactcagcatttcaaacagtagataatttacctttctaccttgaattatattctaatctaaggaatcattgttttgcttgtgtttatgaaaagccattgtgcatgaattcagcaaacttaaaattctgctacatataagttattgggtaatagggatgtgaagtatgatgcctgtttaaggaagtcacaggctagcagaattctagacaagaataaaagtgttaaaacatataaaaaggactttctccttgaacttttcaaatttctgaagaaaattacaaaagacaatacaatttacattattaatactaggacagactctcttgatggcattaaaagtcaaaattcgatttgaataactcactattttggctttatgtttatttgctagttatataacccatcttaaacatacttctaaattttgagcaaataccatcacagtcattatggaactcatatgtgtatatgcctgttatatttacatatgagcatatagcatgtgtgatgtgtctatatatctgtatttaattattgaatgtgaattacagtaggtgtttgaagaactgcaatgatgaagataaaaatatgttttatattttgaacaaaattatagctttccctagggcattgtgtgttttttttgttgttttaataagaaaccatagaatttgaatgggtgaaagtataataatatctgcatttgaccactgaactgtggtgctgtctaaaaggtgttttacagacactcagcggaattggctctgacagcagcccactcagccaagaaatttgactgtcatcttcatccacttgctttccctcacatggatgacctgtaaataattgtgtcttttccttagtgaatgatgacaggtccctatctatcaaattgcactacataaatgagatagaagccattgaatttagaaacagatgaaattaatctaatgattcattgtttttcattttcttgggcttctctcttgaatgtagaacagtttcttttgcagaattgcacagttagatttgaatagttcaaaatatgacctttcttaaagcacatgatcaagtgatgtccagatactttgagaactgcatgaacaattcaattttgatcatgcttatgggtcactagatagtacgacataaagaccgaggtctgggcagggtacattgctcgtatatccatgttttatggctttggcagcagtaagtagaggagagtatctgtgtatgtatgcatatgtgtgtgtacatgtgtgtgagtcctcatccccatgcaatcattctgttacctttctgcttccaatgagttgtctaagtatcctttctcttctgtcttcaactaggacttctttcaaacataaataatgagtagtctctgtctcacagatgatgactgagtatttcccaccaatcaccctggaaaacacttagtttcttagtgaaagctacttggaaagagctatgatgaaaaacagaaataagacatatatagtagaggttttgatgagtggatacagcccatttttcttggtcataatcatgaaggagaagttgttgctatataccttgtctcagagtctcagagtttcttaaacgtcttctatcctttggtcacccaagtacgcatgtttccaaattgacaacgtccaacatctcctcagcttttctcaagtaataaaaaacagtgagagatgaataggagccatttctaatgtcttcaattaggtacatctaatgatcaccaaaaattaattgacatgttgatatagctattttaatggagaaatgttaaaatccttcattcccccaacctaccacctcctcccagctagctatttcagcaggaactactttagtagtcaactcttaaaagatcactatgagttggtctagtcagagaaaacttcatgataaaggtatgcaaaatttcatctggacctctgaagatgacctatttgaatatgcaaaggggtgaatattttagtggcccacagtatgagcccaaacacactgggcacaagtatgagagacagtatcatatagtggttaaaagagcaagctctgagccagaacactccacattcagatcccagcctcaccactttctagctatactactaggggacaaattacttcacttctctttcctgaaggctcatctatttgggaggacaaagaaccagactcatagggtcattgagaagtaaatgagtgcctggcacatggaaagccctcagtaaatgttagtagttgtgattattaagtgagggagttgcctaatgagaatgaggagtggatgtaaagattgccatattggaaatgtagtgagctagaggactggcacaatgttacgcatagccctaaaaggctaagggtatgggcttgattctgtaggaaattaatagtggactattataggaatgacattacaaaaacagggcttagtaaagcttatgctgttttatcttgcatagcttggctgatgaagtctattgattctttgatatatatcataattttaaaagagatatcatctagaaatttagtttttgtgttgtgtgttgaaatttctttattcagaggtgaggattgttttatttgaaattgatgttcaatatataggtttgctcaggtgtcttatttcttagttaatttggtggcagcagcttgaagtcctcataaaccaccataagcattctttaccaatggtacatcattgtccatactagcaggaattaatgacaatttcactattaagctttctttctgattaaaaatgttccaggaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcttgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatagtatctcattgtggttttgatttgcatttctctgatggccagtgatgatgagcattttttcatgtgctttttggctgcataaatgtcttcttttgagaagtgtctgttcatgtcctttgcccattttttgatggggttgtttgtttttgtcttgtaaatttgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatgatattgcctaggttttcttctagggtttttatggttttaggtctaacatgtaagtctttaatccatcttgaattgatttttgtataaggtgtaaggaagggatccattttcagctttctacatatggctagccagtttccccagcaccatttattaaatagggagtcctttccccattgcttgtttttctcaggtttgtcaaagatcagatagttgtagatatgcggcgttatttctgagggctctgttctgttccattgatctatatctctgttttggtaccagtaccatgctgttttggttgctgtagccttgtagtatagtttgaagtcaggtagtgtgatgcctccagctttgttcttttggcttaggattgacttggcgatgcaggctcttttttggttccatatgaaccaccgcatattctcattcataggtgggaattgaacaatgagatcacatggacacaggaaggggaacatcacactctcaggactgttgtggggtgtggggaggggggagggatagcattgggagatatacctaatgctaaatgacgagttagtgggtgcagcgcaccagcatggcacatgtatacatatgtaactaacctgcacaatctgcatatgtaccctaaaacttaaagtataataataaaagaaaaaaaaataataaataaataaatagtctttgccctggaaaaaaaaaatgttccaggaaaaggtctttgttttagtacagaattgcttcatggttatggggaaagcttgcaggagataatgtaatatgccattgtggtgggtttttagcatgctggaaaatagactatgatgctgtgagctttacatttctctgtacctttttggctcaactgcaagattatgaacattaaggttgattgatcctaaacttaaattgcaatttagagcattactatctttactttgagcagtttttgaagcataatcattatttttttggaaataaagaaatgttgatagtaagattttagggtttgtaattttttttattcatgacataccttttatattatattttcttgaacctcacaccttcccaattctctcaatattaaatatggcttgaaaatacaaacagtcttagaatactgactctttatcatagataggaacacaatcactagaggcttcctatgcctgcctcagatctcagcactaaaacgattttaggtgatacagctaaactcacatgatataatacagagttccttccagtggtctccttgaataaaataattctaaaatatcaactaatttttatctttagaaattctttatgaatttattttaaaagaaacctgcttttgctctttgtcctgtacatttaaaggagcattgacaattcccaatttaactaagatgagttggttaaactcaaactatgctcacataatagagtatattcagtcactataaatggggactatagtcagaattactggtaattcgcccgtgaaacctttaaaagatatacttacctgggaataaccgctggagatttgaccaagatgttgatgggggaggcgagaagggactcatctagattgactctaggcacttgtatttttaccaagttccataggtaataatttaaagtccaggctaaaaatggctgcttaagaaaattgtttaataacatgtaaaaatacccatgatatgcaaactaagctatttacagtgtataacacgattacattgggaggaaaaaagaaagttaacaatagttatccctaatacatacaagcaacaattctagaatgccaaagttcttcagatccaaacttgcaagtcggtgcttttttattcaataggtcaattatctatgctctgtagtattcctctacagaatattttttggctaaaaataattgttcctgccatttccaatggtaatttagagctggttatatatacatgaatatctccaaaattgctggtttctctacttggttatgtgtgttcttcagaatctttctatgtcctaagtctggcagaagaatcaaaatttgacgtgcagacttggatatccacttagaagggaaaaatggagaactaaatgacattctcccccaggtcacgttcttagagaattttgtggccctgattatagtctgatgttagcttaaaaagcccataaatcccaaacaccccatgcaatgaggagaaattttgcttagaactccaggatttagacctagacatctctcttttcaacatgtcatccacacatatggtttcaggtcttttatttcagacgacattatcctttgagaaaccctccaacctctgtgctttcagtgtcatcagatttcctttaattactgtgtgtgagtcacttttttggagtcttagtccttcaaaggtatttcattcccaggacttactcacctataaaatgttcgctgatctcatacatcaggcaatctgaactgttagctcccattgagaccgaagtaccatttccacttaagcaactgtcatcttaatattgagttagaagagtcagtggcacttttaatcttaccggatataatattcctttgcattctcttgaggctgtgttttgcactgtttgtcaccatcccaaggctgtctttgtttattctgcctgtcagaatcgcacactgaaatgcagttgtttccattattatcctctagctctcttccccttggatcctttatttctttggtgtatgatgggtgaaaaagaaaagagacatttctttttaagatgttattctaaagtatttttccatattctgtattgtgttgtgttgacatctcctgcatagtcttatgtgtgtcttgtgcccagcacacctagaattcactaggggtggggtcttattttgcaaagccaggcataatcagcaggaatggagcaaacccctgaaatgaacctgtcagaccaatcttttcccagcctgccgctcctcactactggcagcagcccttcagtgaaattgtccaagtgctgctttattttaaggcatctactgtttgttttagatttacattttgatttgacattccttttgctggaggtagttttcatttcaacttgcaatgaattgtactttgagctataattatataaatatttagatattatactttttctttaggatatgaaaaaagatggttagttgcttgtttttgctgtgtacttctaatatacttagcatttaaattagatctggagtttctggagaaatatgtgagtcagtgagaatctgtttttgtgaaaggaaactctgaagaattttctttttctaccacttaaagacagttgtttctcattttagaagcaaaaattaaacacatacctagttagagttcaaagtagagcaaataaataagtggtacttaaaatgtatgtcaggaaaaaatgtatgtcagaaggagaaaaaatcagaaaatagttagagaatttatactttgattaattaagatttgccccgtttactttacaaaggacagttagaagagtctcttacataagcaagggcccaggcaaactattttctttctttcctaatgaaaagctacagagattatatgttgttgtctttatgatctattcccttaccaacagctgtcttccttgcccttacctgaatcttttgcttattaatatttcatttttaaaaattactaatagctccttctttttccagaaatgtctttgccttgtttaacagcagcatatacattgcattagtataaaaaagatactgttggtgtctcctaaacataccctgacagccctgggctttttccaaaactctgtcttgagccttctctatgattcctattaccctttctggtactttcatccatcctcgcagcttcagggttcaatttttgaatgtttcccaaatatgtaattctctgacctctttctaggacaagagtcacagaattctgactctctgctggatacttccacctgaatttttagcgggtgcttgaaacattgttttgcatccaaccatttaattcttggaataaactgcacttggccatgttggcatattaccaaaattccaagaatgattcagtcataggaaatttatccacccataataagatcttctgaggggaggaagtcatgtaatcatctacataggttctgaaaaagcagaggggtcagataacctctcatgcattggcagagggaatatttttttaaaaacgtgggagggggaggaggatgatacaattagacaacagttatagatgttcataaagtagtataaacagtttaataaaaatgaatataagattaaaaatcgtatcacataccaaaataaaatcaaggtgaataaaagaccagtactcctacctcaggactttttccattttctttctgccccaggaaagatccctggtaggattctggaagggaggaaggaaatcctgcactcaacctggcagtggtctatagatatagaatccttcttctttcttctgtttctcttgctaacaaacttcggcttcatgatgataaggactttctatgaattgtgaacggctgtaactcccaagtgattctttccttccaaagcatcttcttccatcccttgtgcttactatattctttggtaatagaaaaccaagcctcaagttatagcaagtccattttctggccattctctcttcattaatattttaaatgatgacatgaaaacttcaagatttgatttttaggcttcaagttcttactttcattgcagtaaaagaaaggtttgtctcctctgaaagttataagccaagatggcacacagtaggtttggcacatagtgctatgtttttggtcagacacactgtgagtcatggtgctatagtttggtgtagaacatttttttgttttataagtactcatgtctcacatacacattttagcaataagtgatgttttcttaattttatcaaacagaccaaaatagctgaaagatgcatttttgcacacacctgagatttaagatcattttggggctatttagcattttatgtgcaaaggtgactcgtaaacagctacttcatactggacagcattttgatgagaacgcaaaaggatgagccaaacccacactaggaaagggagttcatagataataatatatttttaattttttctcttttaattatgcacttgtttattttaatgtctttcaacaactattattaggagaaaacgagaaatgtcattccataacttctaatatcttttaacaagtataccatgcttattgaggacagtaattttatgtctttcgtatttttgtaaagatacattttccacttttatttttctttcctggtaaattgcttcttcatatacatcccagtgactatcgtactgttgttattctaagatggtcataaatttgtgttatgaatttttgtgttcatattttgaccactcactgtggcttctttttcactacaatgttgagcagtgttttatgatactcagcactgtactgatgtctaaaaggaaatatactgtgaatacatagcctgcagatttcatttaatacccatataatgccctcaccactttaaaagaggtcttccattttaaaaatgtgtgtgtgtgtatgtgggtgtgatattcagccttatttttcctttttactcttaatcaaattatcaagtcatgcttatccttaacaagataatttatacagacagggcatttgatcacaagaacatcaaaacatctttgttatacaggtatttgaactgttcaaagatgtattttatgactttggtgcacagaagtgtaacttgtattcacatacatgtattattttctcgtaacagttgacttcaagcctcgagccagcatggatactgtccatcacatgttactttttggatgcaatatgccttcatccactggaagttactggtaaggataatgggtttacagtatagaagggtgtagaaaatgtgttttacaagtgcaaagtgtatctgtgcaagtattttacaactagttaataaataggcagaacattttaagaaaaagaacattgttcattgtcatcacgtggttatcatggtttatcacagttatttagtctgctatagagcatatctatcagcctttgtcactgacttaataaatatatgtctcatggacataaagatggaaacagtagaaaccaggaccccaaaaggggctgggagagaagggagcaagagttgaaaaactaccagttggatactatgttaactatttgagtgatgggttcaatagatgcccaaactccagcatcacacaatataccatgtaacatgttcccctggaatctaaaataaaacagattcaatatatgtatattgttatacagtatatgtccaggtgcagaaggtttgtaaagaaagtctgaaaatatagattattgatactctgatattaattttttaaggttcattattctacccgaagagcatcatggttctgtttattgagcactctttctccagacactgtgactggtgatgtaggcttgccatttcattttatcctaatgtctctgcaaagcaaatattgttatttccactttacagacaagaagcctgaagctcaaagtgattcagtaagttgtttacggtagtaacaaaactggtgcaagataaagattgaaccctagcttgtctgattccaaacccacagttattttcattttaccacactgccttctatttattcaagtaattattaattcaattagatattattagaaagtatttgaatcactatggtgagtcttaatatcatgccataaacaatcagtaaacctctattaaatgcctgtcatatgccagagctgtagcagatgcttgggaggttctaggaaaaataagatgttttctacccccataagtttacagcataattatggtttgagattgtccctctcattttgttctttggcattcttgaagatcactgaactctgaaaatagccacactttttaagcttcttattttcacgtagacccagaatcactgtcacacatttaatagtccgaaatgactggtgtgctttgctttgcactgaggaatctgttttgaggtcctgtccttacataatcatgtagactgatggacctttctctgtgcatcctaacattcattagcctgatgtgagtcaagcagcaactgctctcttgtcgtttttgtaataaacaatataatgtgtatttggaactgttaaaaacacagggcaattagtggaaatctccatggaccaagtaccgtcaaagcatttgttaataggcttaagttatttgatgaaaggaacatatcacataggaacccaacctatgtgactgggtttatgtaaaaacagagtcagcaaatcacagtaaatacccttcaatatcaacattcccgtttatactcttcagtaaatttttgtaaataaaattctgggattaaaagattattctgtgacagcttttcctgaatcttattcagtaaatcacatcctttggtttttatgctttaaaacaatttcttctgaaattaccaatatttacctttgaattggactcattgaaaatagctagaaggaatgtaagcttttaaagtctgcttttgctgcaccttggtttaagggaatgagtgagaaaataacacaacacttaaatgctattccagttctaattgttaggaaaaattatctaaaatgagccaagctcattgttctcatgttaagggaataaaacaaaaacctcattttggcccctttaaaatatttattagtattcttaaataaactattctgaaattaaatctataagatatattgaccaaaaatcttccacattggggaataagaagtttcaaagaaaaatataaatgaaagtgaaaacagaaattttgagtagagtaattgctaagtatattattttgctaaaattattacttgaaagtcaacatagtagaaggaaagagcagtgaactaacttgctggattccctgggtaggttatttagcccatctgagatggagttcttgtcttcatttttgcaaaagacttatactaggccatttttaaagcctctctatgctctaaaattccataattctatgaatataaattgcatccaaatgctgagtctgattggaaaagcattatttctaggagctggaagtgtgtgtactgcttgactcacctcaagcaagcagctcactgtgttttgccagtcagttgcatcattgagtaattacaattcttaataacactatacccatatcattttaaatggattttaaaatatttgccttgtatcccatagccccacttaatttgtagacttgttatgattgaatttataatcataaaacaaggacaattggtgctgttattcatcatcttttaaccaagcccaacacgtttaagtctaacatttaaaagtaggatcttttcaatatgtgaactagaagacatacattaagtaaaactgttctaatgattctgacttccacaatcaggcctttttatatatatatatatatattcctttatatatatataaagattataatacatatttatatgtatatttgtatataatatatgatatatattatatatcatatatttattttatattcttttttttttgactgagtctcactcagtcacccaggttctagtgcagtggtgcgatctcagctcactgcaacctccacctcctgggttcaagcaattctcctgcctcagcctcctcagtagttgggactacaggcgcgtgccaccatgcccaactaatttttgtatttttagtagagatggggttttgccatgttggccaggctggtctcgagccccctgacctcaagtgattcacccaccttggcctcccaaagtgctgggattataggtatgagccaccacacccagccacaggccttatattcttatttaaatatggtatacattatttatcttccaatatttggcaaaatctatactttaaagaattagagctcacaggatatttcacagccagaactttcagttgcttcacagaaacatctttcactccccacccccagtgcctcacaggctcagccctgaagatagtcagtggatattttccagctgtttaacatcttatcctgtcatctgaattatagtactcacaacaaaaatctatcagtgtcaaacgtcttgcattatttttctaaaattttttgagtcatggaattgatcacactcattttatagttgcaaatctattcttcaattattctaagacatagacagcacttaaatgaagactcctaaactttcacatatattttggggatgatacctataacagttttgatgcttaaaaataaccagaagtcattcacactctagggaaacttataaggaaatacaaagctgttttaaggaaagaagaaaaagctattttaacatcaaaatgtcaaacttggatttcctcttttctgtttgttagctaggatttcctcctgtttacacttcagtgttccattttcattgcgagcaggttggcaaataggtgtctttaatatagaaaacatgtttcccctgaaattatgaagttataattcatcttctatcttcaggaagcatttttaatattaacgcaaatagctattctgatgatgtttcactgttgtgctgccctcctttgctctttgtaattgcctctttctactgttcattaaaatatatttacagttatattaagtttatataaaaatagtagacacagcatgaagcagttttcattatatagtgattttaattttaaagtttttttcctctgcacacattctagccttttgtgactcattccaaattagcagctcacattggcaatgtgtctagttaattatatgcatgtgcatttaaattgcatacgttgatttgaaccttttaatatactgtagggtggtccctttatagttagagtgggcctagtgctcaattccaaattaacatacctctagaggttgcaaataaggaccagctgatggaaaagaagcagctctgctgacccatgtaaagaaagtgacagtacctgtcagatgtaaccccaatgccttcttcccaggcgtttggaggaggaaaacaattaaccctatctagggaccaaaagaaaataatagcaccaagattagagcaagcatatcaatggcatgatttgttgcactctatttgtgctctatagacttaattcaaagcatgacaattctaagttccctagatttattagctgaatatgagcctaaactaagctctaagtgagcagatgctcttttgaagttgttagagtcagtaatgaaatgaaatgaaggtgcttaaatttactatttaagtaaatttttatatttaaattacccagtttaatttaaagtaagtaaatttaaatttacttaaatagtaaattttgaggatatcttggaaatttaaatattgtattcatctattctatgaattacttcattctgtttttactcttaatcaattttttaaatgataagtgattagctacttagagtttcaggctttgaaaatcataatattttgtttatacaaattgtgttggcatttggggtaattctggagtgctctcttttttaaatatgagattgtaggcttgtgcattttttattctgctgagcacaggacatagggtttaaagcaatttaggattgcaaaccccaagattttgtgtttaaaatattggatgattaaaacgagtgggcttcttatgtatccagtgttatactttggtgtgatcttctatacatagctaaaattatttttagttcttcctattaatatttgattttaaagctatttctaatgacacttaggaccaactaatcttaacaaaccaaagatggcttctacaggttgtttgatgttttttgatgaaaaaaaatccaagctggttaaatgaggctatttccagctgttctaactgggaatcattctcaagctaaagcagtagtgctttaccatcttatgaagctttagcttaaatccctttcaactgcttctatttattaaccacctgctgtgtctttttaaatgccactatctccacagggttacagctgctgatgagaagaaaaaggagataaaacattatatatatatatatgcctgtatgagagatactctgcttgggtacttatttaaatgactgttttttaaaggtgatgttgttttccaaataagcccacagctttgttgcctccctcccagtgataatgattctttggttgagaacagtatttgcatatgctgtctttatgctcctgttccacatcctggcccctgtcatccatacactatatacagcaggattcagtgtgtcttctgcaatcctctctttgttttttctgccgtaggaaacttctaaagttaaatatatgtaacatccttgtcagtataaataaaaataacagaatctcccaaatctacactgtctcttgttttaagcactgtaaaatgtgtcattgagtgcagtagcaatgtttagacataaattactgataggctaaaattaatagcatccattccctttttccactttaatattgtaatagattcctatcatatcgcatattgggatagtataacggatcaatttttaaaacacagttggtctctgattctaacttccagtcaccaatttggtgagtatgttccttggctaataatattaaggtacttggattaaaggtgttaataggagttccttagaaattgcccaattctttgtagactagtgtcaactttaataaaatagaatgttacagttggaacccttttgactgtttcaacagaaacaaatgcatttttcctcacaagactagtactttatgttaaatacagtagcaatattataatgcagcgttgtatttagcacagatccagaactgtgaaatcggaacatcttggtttcaaatctcagctctgctacttggtagtggtaataaacattggttaaatgatgtaacctgtattggtctgttttctcatctgtaaaattgggctactaatcttggcagcttgattgggccatcatgaagggtagatgaggtaatataagtaatgtgtttggtgtagtgtctggcatgtagaagggatagctattatttttattcatttattgataaagtatatattaatcattcactatgtgccaagcactttgttgggcatggagaatttggtatgaataaaacagacacacactctgcttttatggacttactgcctgtctaaccttattggagcaaaggaacagtgggtagtttctgtgatgctatttatcaggctgatatttcttaatcaccattctaatttgctttttcattatgtatcattctaattactatattaatgtctgtccattgcattgaagttcacataggattgtctgaatttgggaaaatattctatgggtttatagaacaggtaatagtatttgaatatctgactcatactgaatgcattttgaaaggtaaggaccatcccctcatgctattgattttgtgttgtgtttctttaaaaaactttctaactttagatcagttttcctggttgtggttctgttagatatgtaatgcattaaaattggaatttaaggctatacagacttaacttgagggcatgacaattttttttttttttagccaaaagaagaaacgagttatcagttctgatattccctgagtaaccttggattttaaatagcctttaacagatacaaccagagagtactttaacagtcagtcatgctgtatttggataattcgaaatgacaagctaccattttcagtgcttggcacagtcagaaaatattcatgccatctgaatggtttccccgtggattagacgtgaaaaaggttctataggaaaggtccaagaatccagactagttttattttcaaatgttaattctcatcatttttactatgaatactaagaaaccacaagggagctatgtgaacccttccacaatttaatcgacttagtctggaggagccttataggagaagctgctagaatgataagaaaaagaaacctggttgatgaggcctgaaattacaacagccattgatcaagagttacattgcttcccagccttaaggctctctttactagtaagaatagtaaaaatcccctctacttccataggtccttttttttgggaagccaaaatatactataccatctttctctttttggtcattttacatggagaaaatatgatgccattttcatttaaaatgggaaatggaaatatttaccactctgatatgttatcagttatagaactcagttctctcgcccttttgtttttcctcttagtcctcccattgagttttaggattagttccaatgccccagtgtcctccagtgagtcattctttactcagtcttgagtttaatatattttttattgtaaaacagggttttaaaaattaaaccaatgtttgcttggaagctcttatttaccagacctgataagagaataaaatataaaatcattgtctctttgtgaatatgtcacaaacaacttgttttatctcaaatttgattttagaattgcatgcacaaattgcaacttagttcaaggatgacagtaataatcaaagcttatctccacataatatcattctctgcccataaatcagtgtcaagaattgagatagaagggactgtgacagccagagctttaagtcatggtttagctgtttgacctttggaagttacttaaactctctgagcttattcaactttaaattacaacttgctggcagtgttcttatatgagctgatttgttcaaaaaactaggcaaacaataattcaaatttattggtgtttatattttaaatttttaatctaatttttttcaataaaatattataacatgaagttgagagtgcaatacaatttaagctaattcagctctttaagtctctgtacatggaaagttaaaaactcaccgagaggtaagtttcaccaaacatttgtttcatgccgggacttcagcatgaagatattatcctacatacttgtactcgaagtcctcacagtctgggtggagagagagaagtaagctgacacttaggatgaggagtgctatagttaaggaatggaaggtggatgggggtcggagaacactttcctgaggaggaaggcttgaactgaatcttgaaggagaaagtgaataaaagtttttcaggcagacagctgggatgggatatttcaggcaaagagagcaatggaaataaggaagattggaaactggaagcaacttggcaggattaaaaaagggggtgttgtctggagacaatgtctagatcatgaaaggtcttacgtgttatgctacaaggtttggattttattttgattttatttttgggaagcatttgaacgattttgagccaacaaatgacataatcaaatgtataacttagaaaaagttactaagccagttttctctgttatatttcaatctggttctttctagtcatccattgaaaatcaacttgcatatcagaggaaacagttatcttgtttaacctaagactgtcatcacattggttataggcatttgtaatgtttatgatctttgttgaaagctatgaaaattgccacccaaatctttaaattttagtagctaacagcagtgatatacaaagttcaacacatttgacaatatcatttctttaactattatagctgaggccaggaaggaaaattttgcttttgggcatcatccaacatcctgagccttttagcacacttggcacaaggatgtcacagacatttcttccaacgtacaattctcacatggtaatgatcagtcatcataagtatattgtatttgacagtgaacaggaagaaaccactagttgatgtcttttatattacacattacacaatctctttctacagcctgatttatagaagcaagatcactttgctaagtataaccttatcaagacttcctggttctgggtccctcaccccttaattcagacagataatacagttgtctgcactcattgcctatcctccaacctcatttctggctagaagcagaaaatacggtaagagtccctgcctctgagtctgaagcaacttcttaccagtggttttcatatgtgcaacgtgggtgttttctgtgtttctggcttcagtttctaacctatttaggaatctatcacagtctgcctttgcttcccatccaggtcaggggcagtgtacatttttttctgtgtgagccaacctccgtcccaagaagctgtatttgtccttgtcctttatagtcttcaagcttttcagatctgcctacacacctgactcaccttttttggtcccagttttcaaaacacaaatacacaaatcaacataaaatgtagcctaacaatgtttggattaaatccaattcaataatagaaaaagctgagatatattgtaatgggaaaaaaatggtggcttggagtcagacatactaccatctattaatgtggatctaccaaatatctgagttaccgcactgagtgccttatgcacatcaccacaacagccctatcacagaggtttccatataggaactgggcctttgagggcttataaacacgcccaagatacagagctgctaaggggtggttctaaaattgaactccagatctgtctttctgcctgggtgctcttttcaccctgcaacactctctgtcaacagtgaatcttcagataaagtgaatgttttgttaaataatgcattgccctggaatagtactttgaagtttataaagtctcatttgatttacagaataactctgtgatgtaagtgtacttatccctgttttccgtgagagaaaactaaggcttggtaagattcagtaacttaaaaaaaattaagtaacttgcataatatgatacaacttattaatgcattccagtattcataaattcaaaatgtcatgcatgtataagatcaagaactcttaagagaggctgggcgcagtagctcacacctgtaatcccagcactttgggaggctgaggcaggtggatcatctgagatcaggagttcaagactagcctggccaacatggtgaaatcccttctctactaaaaatacaaaaaattagccgggcatggtggtgggcacctgtaatcccagctactcaggaggctgaggcaggagaatcgcttgaacccaggaggcggaggttgcagtgagtcaagtatcgcgccattgcactccagcctgggcaacaagagtgaaactccgtctcaaaaaaaaaaaaaaaaaacaaaaaaactcttaaaagggacacacttgtattgctcaccccactgatggtaggcactgtaggcactgtttgttgctttggccagatttgttgacaacagtgatcgccaaaggggaaatgtgtatgacactttttttagtccagatttctgctgcattagctttggtttatacagaccgtctatgtaatgcttgcttttctacctgattacatagagtacattccatgtatgaacatatcaaagtaaaaattatatatctccctcacaggattgtttcatatcaggcaaaaaaaaaaaaagtttcctcttttatgtgctttttttcacacagtaatagttctttgctccagtctttattcggatcttaaagctaatatcatgcaatgatgatatattgatgtactttggtttcaaataccttcccccatcacctcccaccatggggagcaatttatgcatttcactatttaaatcttcatttatactactttttattttcttcaggttttgtgatgaaggaacctgtacagataaagccaatattctgtatgcctgggcgagaaatgctccccctacccggctccccaaaggtatgtcagagcctcttgggtggtcttatgttcagctgcttaatttctgtttccaaagtacttttcattatagtcctttctaaccagtgttgacagtgttctgtattgctgcttcacagtgaaagtacttgcattacctcttttgtattgaaaaggtttcatttaggtagttactctttttctgcctctctttggtaagtagtttgcccacacaacagtttagataaaattagaaaataaccaaggatacctcaagccacctttgacctaaggcacattggttcttgacagcagacacatttcatgagccaagagagctaggaattaaataaactgctgtttcagcaaagaattttttacagtcctggaacctaggtatctaatgtgatgccaagacctcagctggctttctgactgcacctctaaattgtacatagctttcaatgtgtgagtgtactaccagactctcatttattacctggatatttcttaaagggtgtgtgtgggtctgttacagaataggtctgtcgtggttcatggatgatctcgtgatacacatgcacctctctttcctcccttactcattgccagcatcattaaatgatgtctgatttcttgcacttcaaatgagcctcagaattctctccatatgaggcagctgcaaccaaacaagtttgaaactaacagggaggtctgtcatagatttgttgacatacattggtagaggagatttgtttaaaaaaaaaaaaaagtatacttctgcctgtaaatattttctctctagattttttaaagctcactagcaagctttattaacagtaagactaataagaatattcagattccaaaaaatcactgagataatggacttcagtaatctagttggtaactggtttcctcaatgacatttttgtagatacctcttttcacagcagaagaaaagtaatgccacttaaatgctcctaagaggtctatttcctatattcaatcacaaaataaaataaatatgaatatatacaaaacaaaatgggagaatgggtttatgtttgtcttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatgtatgtcttttaaataatcaatagagacagaattttgttttgctctgtttctttcaaaatgagtgaattgtcctcttaaagtgtaagtgattactctggttctgaagtgggaactatgagtagaatttcatcatagttttgaggagattataatgacagattatattagaaattatcagtcaatggtatatttctgttttcatataatataattttatatgttatatgttatttccctttggagttcatagaacagcaatttgagattaactccattttagatgctcatttctaatatattaacttttttgtaaatctttaggtgttggattcagagttggaggagagactggaagtaaatactttgtactacaggtacactatggggatattagtgcttttagaggtaagttttgaagtgttggaactaagcaaaacttctagtactatattggttaaaatacatgcacaaactattatctacatcttaaaaagaattgcccacaccctctgcccactaggggataacagcttttgtttcctttaatttggaactgttgaaggaatgacttttattttagaagtcatttctgttatgcacctgtgcatcctactgtgttttcttttatgctgactttatagagctctcttgccttctagtgtattgttttatcagcctgctcttgctcttattaggagtgcggatcattccaagcaacactgttggaaagcataggaaggtactggttgtttatatttatgttgctctgagcaagccaccgagagtctataggttctgcaataccaaaggggttctcaaacactcaggctcatgtcgattccttatctatccatacgtggcacttcatgaactcatccattgtccactgctgtaaggcacagaccccagccaccctttagataatgctgaacactcccctagacacctgttgctctaccagtgatcgctatgcactttatttaaatgcccctttccttactatagatcgttagcatgaggaaggggccctgttcccaaggcaaccaagatcaatgcttgttactcctgctgctgcatttagtcaaactccaactgcattcgggttcacactcttgtgttcacaggtgtaaatattaagatttctccttgtcttgtttgcttttctactatgtcttgctgacttatatatattctcctgaattctctaatttgacagtatatttctaagtaacctgatatgtttccctttccaaatacattagctatctctccagcaactaagtttggaagtagatgtccatctctgcctatgaaataccctttaggacctttgctaagagagccccatggggtagaaaggaccatagattgccagcattcagaacgaggacagtaaatgcagtctccctctggaaaagggtgttgaaagaatgattttatgtcattgaaaatgtactataatcaaatatattatcaattaatatatttattaatacactaataaatatatataaattaatatatatataaatggaccagcctatgaacctaacttagaaataaaatttatttttagattaaaaatatgctttgagttatacacaaataacttttcattttttggaatagaacataatcttaaactgttaactctctatagtgctgagagaaggttttgctgaaaacaaagaaataaataatatttgtgtttggggaacaaagacagagattatctgctctaaaaattgaccatgctggtttcagtagaacagacagattgtgagactgctgacttccaaagtattgacaaagctttaatttcctcaaaaaaggcaagcagacctttccagatcaccacaactaaagtagctcatcatactggcgcaggttcccgcaaaccctaatctctaccctctataaaaccctgtacttcacttttcaatctaattcccctcagcgttgtaaggacccctaacagatactgcattgatactccagagaaaacacatgatatatgcttgtttttaaaaatatgttactgtaataatttcttataaggagttaattttgttttataatttatgtttaatctagggatagtaaaagtactgatattttaatatgtaaacatataattattctttgctgtaagagacagataagaaattttaacttttcaatagtagttttttattttctcttaaaaacaagtttttctaaaagatatatggggtagaaagattactagtgctataattcatataacttattgtaatattattaaaatgtaagcaaaaatttcactcatgtaattcattcagtagatactatcaggtccctaaagctttatttagagtagtaagtaaaaacatgggaaaatatcaaatctcactaaaacaatgagatatcgttttatatttattaattgggaagtggtggatattaaattgtccagcatttggatgaatctgatgtgctttaggaggctttataaatttagtatgatgttttggaaagcatttttaccatttcatgtatgtttaatatatagtattaaagtcttgttctaggcttttgtcctaaagaaagattttttttcttaaaaatgctactctatctacccagttattcatgcacatgaaaaactggaaagttctcaaatggccctcactaggacattggttaaataaatggtataacaacaaaaatagccaacaataagatcaaatacagactatataaaattcatgtatgcttaccaggattgtcaagcccaagaaaaaaaggaaatggttgatgaataagaaaggtaggattgggtgatttttttttcctttaaaatgttataacattgcctttataattacatgtttaaattccacaaatagaagcattttgttaactccttcaataccttccagttagtgtactgcactcccactcacacctcatgccaaaaaaagaatatgaatctctatatgcctgatttactataggaatgtattctgctttcagcagcttctgtattgtgatctcatacttatctccagatgcacctagaagtggaaaataattgtatcattttatcttctaattataaaaaatgcattaaatatttatgttatgtacatattatatatataaacaaacacacaattatacacatacatatataatcacagcactgcttttggtgccattgtcagggaagattttatttcgtggttttaaaactattggtgatattttaaagtatataaattgtaaatctgaagcagagtaacactactaggaaattattatattctactgaaaagtggggaaatgtttggcttaagggtatgagcatttttccacacagggaatgttttagacaattgagaaacttaggatctttctttaataaagcaccagaaatgaaggcaaaacatcttctaaaagttgtgggaatgtggtagagtatctgagagagtataacctgaagccatacctgggcatgttttagatcaagcttgtccaagctgcaggccacaggacagctttgaatgcggcccaacacaaattcataaactttcttaaaacattatgagatgttttttgcgattcttttttttttttcttttagctcatcagctgttattagtgttagtgtattttatgtgtggcccaagacaattcttcttccaatgtggcccaggaaagccaaaagattggaccatccctgttttagactgtgatcttccttagtatgaaaagattggctgtgattttagagtgagttctatgggattacataaaatgtttgctttactttgtttttttgtttgtttgtttggtgttttggaaattacacagaatgtgaagctgtaaaataatccttcaaaaacaatcaattgtattaaatgccatatcaaccatagtgtcaagcctatactagtgctgggtatactagtcttcctgcctgtaggagtttattgtattctagtaggtgagacaagcacaaaaggagtgtgtttataggcaataataataatgcatactggatctgaagtctgcagagagacaggagcgtacaagtatacctgaaagtggagaggtatgaagtctgggaaaggctttccagaagttggacccagagcagggtatggaagggtgatcaggagctcccaggccagagcaggagggaagacaggttccagacaaaggtaaaagtagatgcagagacacgggagtgaaacagcatcttagacacaaagaactttgggtcatctgacgttgctggaatgtgaaatgcatagggaaaagtggcaagaaattagaagagaggtcaaaggtggggagcaagccataaagatccttgctaggacttgattcctaaagcactcagaatgctcttcagtcaagctgtaacctgactggattttcatttcctaatgccgctcagtcttgggcttgagtacatggaaaagctactagccttatgaagaaagtatggggctgtaggtggccagagtgagctaggattgcagcttaggaaggccagaatgactttttaaaaaatgtatagacttttaaattttctaaaacttaatattccataggaaataggatgtactctaattagaaatgaatgtcccacgtaggtgatagtatgtatggtaccaggtttggtgaccaaactctaagtccaggcagactggtaatggcacatcctagttttgttaccctcgctgagtttctaaacctctctttgctctcctcatctgtaaaatggtatcatagtggtatcataaaggtaccatacctttatataaataaaggtacctggttaagtagtcaataaatgttagctattatcattatagtcctcatgaaaggataaatttccctaaatacaatattttgtctagttacacataatatgaaaaggacgtggttacttttcaaagatgttgtagtttctcattatttttagacacagaactgttttgagtgtgtcacgttgccagtagaagtttcctagttaagctgtgtttcgtgttctccacagcagtttttgttattcatagttcagctgtacaaagataaactgcaagaccaacttcctgcccttaaggaaattagaatagtgagaattggggattcctccaggtttccctctccccctttttttgaccagttttttcagcgaaatcttgttccgaagtgaaaattctcctgagattgttgctgaatgctgccacatttcttctcgatgttttggcctaggggaatcttaagaaagctctcctctcatttttagaatttctggcattagcttactagtctccaacaataactcatttctcaaattgaagatcctgtgaactcacctattgaagttggaactgatattcttagaatgaaggtcagggtctcttcccaaatgtattgccctgattgtctttggattgtcaagacttccaaactataatccacttactgtcattaagctcttggcgcatatgggaaaactagcagatattattaacaacaaacaacacactctctctctctctctctctctctctgtctctctcggcttgtttccatgcctttctcacagccctgtatgtacacctgcattttgtacatttagtatgttcctggaagtatagccaaaagttttgctttccttagagtgggtgtttaatatttacattctaaattaagtgaatacagcctggagatcctattttcaactctcctttatgtaagctctaagaagtttcatctccaaactttggggattatattagtaaaatcagatcataaagctctagttagaacactcagaggatgattgttttcaatagccaaattttccagaatgctaaggttttaaccctttaagtactataatgttaaaacatcttggatagaaatcattttagaatatattatgtgtctttcctgggcacagtggctcacgcctgtaatctcaggaggccgaagcaggcagatcacctgaggtcaggagttcaagaccagcctggccaacatggtgaaaccctgtctctactaaaaatacaaaaattagccagctgtcgtggtgtgtgcctgtaatcccagctactagagagactgaggcaggaaaatcgtttgaacccgggaggcagaggttgcactgagccatcacaccactgcactgcagcctgggtgacagagtaagactccatctcaaaataaataaataaataaatgtatatatatatgtatatattatacatacacacatatatgtatgtatgtgtgtgtatgtatagatatatatacatataattgtatatatatatctgcactccagcctgggtgacagagtaagactccatctcaaaataaataaataaatatatatatataaaaaataaaaaatagagtatattacgtgtcttaggaagttaaattagatggtacatgttaaatgcctacagctgtgcctgacacagaacagattggcaatgaatgttagttctccttatccccttctcccttttcttcataactttgagatagcctagtgaatatcaatgattgtgctatgatttctttccagtttttaggagtacgtagagtttttccatgtaactgggctcattgccatctcctatctgttcttctgtattttctgtagcttcctttgttgtcaagctaccattgcaactcattttaattcacacaacgcactacatggaggaaaagatgagtaagaacaaaagtctgccctcatagagttcccgtccagtgagcataagtacacttaaaataataaccgtaataatgcgagccagtacaaagttaagtgccatgagagaggggattggaaagcaggcaagatcacacctagtttagatgtttcaagttatcggattgatatcatataggcacccttcttcctgttctaaatttatgtgttagatacagaatctagatgagtttcatattatcagttagatatggaatctagatgagtttcatattatcagttagcataaatagactttggcttgcagcccttaagggaaactttttaaataaaaacatgatcatctggaaaatggggattaaaaaatacaataaaaacatgggaacactgcagcctggactttgtgaccatcagatttgatttttccttgccctcttgcattattccatgctggctgtgatccactcgggtgtggtttctgcaaagcttagttccagacaggtggatattcctgaacacagggtgtgcatctgtgtattcacacaaatacacatgtatccatacaaagggttcctacctaaccacaactgaaagagtagtagagtgaagagccaggaatggtaatcatggcaggaggaagaaaaaacagaggactccagaggaattctgattccactgtgactccagctgtatctctgcctcttagaagactactgccaggaagctattagaaaaagctttgaaattgtgagctcaggaaaaatcccttgctaatgcattttgaacaagatggagcagagatcagtggcaaggtaactgtgcttaaaattatttcattccactataaagcaggttgttctgacttcagtgtaagcatctgagtgctcctgacttcctgacacctaattgcagagagagtgggaaactggatcagattgctccctgttgctttccctgttgtcttctctcaatctgcacaagtagcttcctcctacctgctttccagtgagatacattaatcctgcttttactcactccgctgcgaagtgcacaatactatgggccaggatatttaagcctatgtattttagagtatttcggaatactttccatatttaagaatctcccttgaaattgcaaacatgggagggaggttattgttactgctcctccaacctcagctgacatagacgtccaaaagcaactgagtctctacagtggaagggagacataaatagcaccatctaagcactcatcctagccttccctgaatagggccctggcgtgtacatcagccatcaatctgaatcccctttccagaatagaccataatgttagttcttaccatgatctttcattccagagcacatattgcgtttccaagttctcagctccagagacagcagccctgctgaaacaagcctcacccctgggagatccagaaatgtgtcagaaatatggttccaggaaggatacacttttacctcagttttccttctttattctcaaggctgtgatactcatgtcatctaccaactctccttttttctctccctgactcccatttccaatttctctggtatgctttgatggggatagggacacaaacctttatgcaaatgcttgggggcagatgtggtctggaattaggagcttttaatatttttgaaaggtattcaactgaataaatcatgtactctatcacctttgtgaatctggggcaccatccctatgtagatacactaatgtttctataacaaatgtttaaatattcacacaaaaaggaataaaacataaatatcatcatattcattcaagtcagattttgctgccaaaacttaatgagaaaactttagccttccaaagctgtttagatttcagaattgcaataaattccagtattagaacaaagaaattatttcttcatatttgagttttcagttaaaatactaaaaaggattggaggactctggatgtatctgcacattttccctttaaaataatcttctcttctgaactttatttttcctcttttggaaaatatagaaaattattaaaaagaaaagttgaaaatcccttgtaatacccctactattgaaaaaaattgataaaaccctcttcaatcatacctccctttctcacctaattcctccccaccccagctattgcttatgtctgccaacttttcattagcttatctcagcatttctatatgtggaagataaactaatgtatcagatatgtgtatatgtacttttttcttttttttttggacaagaattagatcacatttcccacagatctgcatctgttgttgttgttgcttttcacttaacagtgtaccctggacatatttctaaggcagcacatgtaaagctcttccatgatttataaaggctgcctagtattcttttgtgtggatatactctaatgtgtgtatcttattgtctattaaagatgctctgagtttttttgctattataagcaatgttagaaatgttttaggtaaccatgtattgctactgcagggcagatatctagaaatgagattttggggtcatggagtgtctaaatcctaacaggttccaccaaatcgctcgacagtttttccagtttacaatcccatatccttgggcaatgagcaagtcccatatccttgcctgcactagatgttttcacacttaaaaaattttactcagtgtttacttaaacagactccttataatgtttcatttaaaagataagaattaactgaaagatcttaatagaattacctctaaagttatatagtctagatcaggatttctcaaaatctaatcagaggaccgtctgcaccagactgtccttggggtactttttaaaatgaaagttcctagttcaaactaggcctactgaatcagatgcacagaaggtagagcataggcagccagagctggctcagataggctcacaagagccaattggtaatttgcagtgtttttgtaagctgattgttaaatatcgcaatcattaaaaataaaggcaagaaatactcaaaaatctttatttcctaattattttactaattttactattatctgtgcacttgagggtatttgcatctgttgtatctgtgtggtggaaatactacaaagtgttattttactgctaatttcttcctaaagcagtgatgtcatgttggtagcttgaaattggctgtggtgggaaaatttacattgaaatcagctatggtggaaaaatttacaccatggaaattgacaaatagtgcaagtcaaagttctgtctattattttgctggttgtctagacctgagaaaatgatggagaggatgttggcaatgtggattactgtaaatgcccccaaaaatttaggacatattcttccaggatttgcagactgttacccattacaccaaagattttactgacatccttaatgtgcaagttccaacataggtctttgttgtttcactaaacaaaatattatttcactaaacaaatatttttgtttcactaaacaaaaatattaacaagcattcttgtctgaactacttcatggcaattacaaccatcagtgggctataaaaagtagagcaaaagtcaaggaaagaattatgtgagagtcaacagcttatatggagttaataatgaaaagtattgtatattttattattatttgtaaattgctgcacatttttgccagtaaaaactgtaacaaacatataaacacaccagtagtgtgtatttttttcacagagccaatgtattactagaatatcactgggcccaggattctgaaattttaacaacctgcctcattgatttttatgcaaactaaactttgacaactggcgctcaaattttcctagcaaggattaaagtcactcctgcatttttttcctgtagaacaggtgtgtcagggcaatctcctggggcctaggacatgagcagaataatttgcatttaccaaaataagtttaattaaatctcaattctcttaagaaaaggggagctttgaaagaagaaaatgcatttaattactgtctggttattctagcactttatttcatttagaaattcgaagaagaatttattttcttaactttttcacaaaatttggcatttggattttaaaattctttaatagaagccacttacaatgcatatctgacattctcagagatccccctccccatatacaggtgcaaaaatgttccttcttcacacttgatttagatatatctttttgaagaatgggccaaaataatttatattccttcatttttttacattttttattttaaagtggaatatatgtgttgacagacactagaaatggaaaggaagaggtccatgaaaccaaatctgaaagagaaatgattggcaagaaggtaacattcaacctgcacgaaacgccatggcctctcaggccttttcagttaaggggaagaggttgaaatgggctgagaaagcactgtcgaacaggaaagcatgacgtttttttccttcttctgaaaagaaaaggagtaagaccaatggatgttatgtgtcatgtactcatttgtttataaagcactcgtttttaaaatcagagacagagaacagagttcagagtgacagaatgagaacagcctaactaaaagggatcatcaggcctcacccttccgttttacagaaatgaagatcgatgctcagaaaggttgcatgacttgcctaaggtagtccagtgctattaaaaaccaaaacaatttaattcatattggttttctagtttgtgtatgtaacaaagttcatgctctaactatgtaaaacaagtaatagagtcactgtttttaaaagtcttttgagccatagttatgaagtgaaatgaactcatgcacagtagaattaatattaataaagatcagagtggtttacttcatctcatttgtgccttttcattttcatgtctgaagtaatccatttcccttatcatgtagagatatttctaaatcaggttgcttgataatcccactgatttcagaattgtaatcggatattcttcatgttcttctctaaccttcattatacacaagcagcttgatgtgagtcatgcgaatgattttaggactatttagtacctcccaaatgatctgaaagaagcctattatccttcagtatttttttcttgcagcctcttcacataattgtgagctctctgattctctagcttgctgcatttcaactttgttaatcatctttagtatggaagacaaatgatcctcagtcatctcattgattccatgggacacctgtttattttaatacctaaatatggccattatgtatcaggaattacactttcattcatagggttatgagaagatatgtaaagcactacagttatacttcttttttaaagaatatattcagaatgttttttatcccttaaaacgtggatttttaaaaaagtaattcaacattgagcagagcgtaagtgatgtcttttttgggaaaagaaaagctttcctacatgcaatttagtttttcagatttacatttagttcttctagtttttttgagaaatccttatgctttacctttattgatccctttgcaactcatgtttttttaatcgctcataattattaactcatttttaaaagctggtcagagctacatagtcatcatctaattaattccatttgaattaatggcaaatagcattaaatttttaacccaagtaaattaagaggagaaataaagtcacttgctcactggcacagtctaaaattaggagctacaattctgtttcagtgaaatgtagttcagggcactcacaacactaaacgaggtttgtttttcactaaccactcccactcccacaggcttcctgcctttcacgctgttccccactgctctcttcatggccctgacatgtttgtttattatgttctaggaattctgggaaaagaaggaatcattagaagtgctgggatttgcacattccatttcccgtttagtactaatttcttttatgttaattgactgttttacttgtaaaacgaaaaggataccctaaatagatacatgacctaaaaaagcatttgatgaaaaccattcaaatataatgtttaataatatggacagaatattctattagcaaaataaaatcaaaccttccctagacccagaagagaacattctagccttcctatttctcccaatagaaacattattcttttcatccagtttggaaacccttcaccttatctccatttcttttcattacatattaattattcttttttccatctttaaaaactttcaaaactctttcttctcatggggtcatctgtcctcccccacacttttcgagtctcatttctttgcaagtacgtcttatccttgtttcacaatttaactgtgatgtacccctaataataactgaaagtaaagtaaaatctggtcagtagccacagacccttctacactgacgttttgtcttatagtataaagtcttgcaaaattccaagggaatgttgagagagaattcaggtcactgaagggtttcagtatttttttcattaacatagtaatcatacttagcatttatatactacttttcaatttagaagtgccttatgttacttttttaatcctcatactacattactacataaacatattgaatgactgaaaaattaatactaaatcaaatgtatgaggtataatgttcaaagtgtattccctaattaataccagggactacatgcatacatagttatatgtaaattagatactttggatttattttttcaccaaggaaccaaaacacaatacagaatagtattgtaaatagattaagatgattgggttgaaaatgtagatactgattttaggttgaccttaaaaaatatatatattcttattaaattatagcttttggagaatataaactttctgtgttcccaacaaaatggatagttttgctgccaggttaccctccctttgtttatcatgagtctttagaggtttaagtaaaacaaaagagagacaacacattgttgcacaaaatagttgagaattccaatgggaatgaaaggaaaccttttatatatgtatacatacacacacacacacacacacacacacacatacacacacacacatatatatgaaaacaccctcaagactattcaaaaatttataatagagaattttatacgagaaatagttttcagctttatattttaaattgtgtttaaaaggactttttaaaatcaaagctcttcaatcccttttcatttcatgatttattttatctagtactttctttatggtttctagacttttgcagctacattctggactcagggaaaaacagataataattgggacaacgcaaaaggaaattcagattaacatttaaagtgtatatatatatataatgctatatatattttatatctataatgctatgtatataatgctatatatatatatcagctatatatatatatatcagaggtaagaaagtgatatatatcagaggtaagaaagtgatatcagaggtaagcagttagtaggccttttgactagaagaaagaggaaataaaaaaagtaaatatttcttagtaaccaagtataatatttaaaactgcccaaccaaagcccatgaagcaagtgaacaagttagttaaatgtttcttttggttttagccaaaagacaactctttcagaagacaaatgaatgtttaaatatggtatatacataaatataaaggtttaaaacttaatgcctcaggaaggggacgtgagtggaggatttttgggtgctggttacatgggtgttagttttttaagtttcctggatctgtactttctgatttgtgcacttttctgtgtatcagagttcaataaagagttctaaagccaatcaataattttgaaatttagcactgtactttaaaaaaataactttatctaggattggtgggttttatcttttaattttactttcttagaaggatgcctctggagcaggttcataattttgagagataaaatagtataaatcataacttcactgtagactcatatttttttgcattcataaaagatggaaacaggaaagtgctcttacattaggtgtgccataacatcctccacacacacagcaattataaaagcaggttggagagcctgccttcctgccttccatttgatctcttttgcgaacagcacaggccatcatttgtgaaagtcgtcgtcttgcaggatggataaatgcgttttctcttccttgccgcaaggcaaatggaagctagtaatttctagtcccatagcagtgaatacaaaatcaaaagaggctaactcaatgcagtgacagcttcaaaaggaattgtttttgaagattcttttttcccatagtgctggtttatttagcactgaaggtcatctgctaacccagctttcagcagcctccaggaaaacctcagtgtagcttgtgtcatgtattaacagtcccccaatttcacttatattttgctaagcagatacacatttgccatgacagcttaaagtgtcggtgcttttgaatggagactattttatctcgatgtatctgtaactggagagtcctcatgctcaggactggtaactcagattttgttttgaaggaactaatttttaaaaaaatctggtaactcagattttgtttgaaaggaactaatttaaaaaaactttaatatatgaattttctggttaatttggatgaccaccatttttttgagtactgttaactgactttaggacctgcatttctaatccagatggtacaaaaaaaaaaaaaaaaaaaaaaaaaaagagctgtgtcttagcttcattaaaaccagagtttcattcaacgtctctaatagagcccagagtgaacacaagatctggatccgcttttccctcagttgggttcattttttatttgcctctcatacctatgtcccatctctctgcagcagtttcagttgcacagaaatgaccttttttatataacagcacagcccaactgtatagaaatatctttttaaaaaaacaacatggcccaactgacacagctgacagcaatctgttccaatgctaaggaaactggctgtgttggatctgttaggagacctcactctttattctcctacgggattttcaaagtaattataattatatgaaatttccctcaactttagaaattaatccccaaataatctcctactcctgcttgatcaccttgggagccatgatttagccccagcaaaacatcctgtcccagtaatttaatgttattaatttagaacaaagaaccataaggtaaagatcaaaacagcttaatagtcaaatagttattacaacatctatgtatgtgtattattgcaaagtcatttgcatttagtgataatataaaaatgatgtccctgattcatttttgtttgtatgttcaagacagagaaagtagagaaggtggcctttaaattagttcagaacactctgggagggtgggaagatacgatacagtttagaattatttgcttccaaattttctaaattttttttttttttgaaacagagtcttgctctgtcacccaggctgaagtgccgtggtgtgatcatggcttactgcagcctcgacctcccaggcacaagcaatcctcacaagtagctggggctacagtcacacgccagcatgcccggctaatttttttttttttttgtagaaatgcagtttcaccatattgcccaggctggtctcaaactcctggggtcaagtgattcacctgcctcggccttccaaagtgctgggattatgggcatgagccattatgcccagcctaatttttattattgaagatgttacttctttttgtttttcctaagacttggcagtggtttcaggcatactttttagtacctccttaaagaaagaatccattatccaaaagggtggcttggaatagttggaaatgagtgtgctctaacctttaccttcaccttcatagaagagtgtggtgaattgaaaatcactctacaaatgtctttctgaaggactttcccaattagtgggacgtagtttataacaatacattggttccctcaggatcagcggttaatctgtctttttattgaagcaggaaacaaccaggacaagatgagctcataaagtatagagcactatctctagaggaaaaattaggagagaccaacagaaccatctaagatcatctaagaacgtaagatgtagtaggttattatcgtgcattattccacataatttactacttagctaagaatccaagcaggaactacaagctattattagaaaagcaagctaaatagtttgggatgaataacctcatatcccatgcattcacctcccattaagagaattcctacttaagtggatgtccttaattaagtaccactggttacttacccatttttgcttaattcctctatcttagcttcctaggaattttaaccttggaagtctctaagatatagaacccttgttttttatttttgcctttttttctagtaaatagcatttattaaacattaatattagagaattatatttgatactcagatgtgtcaccaattagctgaattactttaagaggcaacacacttaatctctgtgacctctttttccctatccataaagtgtaagatttgaacttacactctctgagtaaatcatgtctggtttccctttcggttctgagattctgtgagtctatatatctgataaaataattcggcatggttatacatctctgcttaagcagaggaaagcagtttctcaaaggcaagcccagacccttgtgaagcagtcattcagtttcatcttccttaaaattagattctgattgaatgctattttcaagtctcatccagtatctggaaatactcatttctttcattatcagactactctttggaagtcttaccacccaacaaccagcactacaatattgtcctatgttgtgatggcctctaaggcattatcagacttggctattttacatttctttttaaaaattattatttcaacttttccactgtaaatgtcctcaacattacaaaagcttcttgtacatgcatatgacattataatggaatagtgacataatgaaatatccctctcagttttacctcatacctatctagtgaatgaagtttcatctccatatcttgaaaacccttacactaaaattatttttattgcaagagaacaaccactatgaaaaatctttttaacagggatgtcttggggttcagttctctgtaaatacaggacattagtagctaaaggccaggtatttgcctgtgtacctttgagagagagttaacctggcgcccaacccaatgaaagaaagaatatttactttggaataataaaactaaaataagaataaatgaaaccacctgaaaagaacagccgttaggacttttgcatgataatgttgtacagaataactgaatgtacattggaagaataatttcatgatcaacacaaaaatgacctcactgtcttttctacaaacctaggatcccgtcgaactgacttcaagcccaaaactcagaaaaaaaataaggttgtcttgggtctggtcaaggagtgcattgttactaaaagtcatggaaggaccctgaaacattatcaacttctttacggtcccatggcctctaatttaagaatttccttttacccagaccatggcatttatcttactaaaatttctttgcttcacttatgattttattctgtatctagctagttcagacccttctgagaacatgttttgcacaataacataccaaatttcaattctaatttcatttttttaactattttactcttttaattttcccatgtttttcctgctttcttctagtcctgtcttattacttggagaaattttatgtgcttcagtttctttcattaaagaaatttcacactcataactgtaaaatacatttcttaaaaataaaatattcatgtactgtattttttggaatataccaatagaataataataactaagcatttagtgattttttcctatgctctaaatagagtgctaagttctttacctaagttatctcagttgtagactacttagagtttcttactggtataaatgttgatcactagtgctaatctattgagtattaagtacctagattttacttctcttagacaaaggaactcagtgagcacttcgttgaaaactgatgatggtcctgtaaggcactatcctatgatcaaataattgtgcaggattgaaaaatacaaatgaatcccaaaccttctatttgacaaatttggcatgtggaaatgtgcaatatttatattgaaatataaattcaatatttatattgaaatgtaaatctatagttcatatagcttatataaactatatataaactaaatatatgtaaaatatatataaatatattttgcttcctttctgcctttccttcaaattcaatcctcttacctgactattttagttttttgattcacgacagttcccatctgttttttaagcagtgggattccatttctgtggtctttggctctgagttaatttgcctatctattcttctccccccctctctcctttttacttttattctagtcacagaataagtctatccagctggcttttccagccaggatatatgattttgatattctgagttcattttctgtacagttcttaactgtctgagtactgatttgttttttcattttatgtagtaaaatattagcagaagcatcaatttttattgcaataaacgttttaactgtcaaatgcttttatgatgatgcatgtcagagacagattttatatatagcctaatgaattgaaatcaattaattcttaggaggtttcatatcttgtggcccaagcactgtattacaacagaaggacaaagtcagagcacactgcaaatcatcagggaaatatgcaaaactagctgaagtttctgagttcacagaagtaagatcagcatagaggttatggaaataataatgcatcactgtggcaaggatcgtgttggaggtcataatcttcacaccaaacactgaggctgaaatatgctgcttatcaaaactgccacctgctataggagcagctgttgatccaggacccctgttggcctccagaccaccttgtttgagggcattcaagttgctcccactgggacttctcactgtgtatatgtgcaagcatatgggctcttcaggtcaaactgtggaaagctgtactggaagaaatttaaagtctctacaataataaaattctattttgaaataatatatgaatgtcagtagacttcagcaatgcctaaagtgtatgaaaacctaaattatgaactacacttcttagaaaataaaaaagtcttttgtttggtgcagcatggagcaaactattttagttcagcaacttttctgggtttttcaacaatacagataatgcatagagagtattaacaactttctagtatctagtatgtctgcaggaaagtcaatatattggtcagtttgatgagtcaagaaataccatagactgcatgaaatgatagttttgtttttgctgttatgatacattggcaattaaaggaattactggatatgaaagtacttagtaaatcataaagaaccatacagatgaaacataacttgtgttttaaaatatttggttataatcatttctatcttactagttggaaatccattttctacattatcatatttaagatatgtgtttctatgtgtgttttcagataataacaaggactgttctggtgtgtccttacacctcacacgtctgccgtaagtacttccatttttcctagaggagcagcaactttaacatctttgcgaacttagagtgggaagtttactgtattaattatctgtgggtaaaaattaacctaaactgggttaaaacaacaaatatgtattgtctcattttcctgtatgtcagtaattgggcacacttagctggatcctcaggcatgtgttctcacacagaggctgtagtcagaatcttggctggggcttcagtcagcttaaggcttgactggggaggagccacttccaacatcactcacatagttgtcggcaggcttcagttctttgctgagtgttggctggaggtcgccctcatatccttgccaagtgggctataaacagggcagctcatgatatggcacctggcctccatcatagaaagtaagcaaaaaaaggaagagagggcatgcatgcaagatggaagccagagtctttcagtaacctaatgttcaaaatggcataccatcacttttgccatattctatttgttaaagataagttaccgagtaactcaggaatggaaaaccaaacattgtatgttctcactcataagtgggaactaagctgtgagaatgcaaaggcataagaatgatacagtggactttgaggacttcccagggtaaaggatgggaaggaggtgagggataaaaggctactaattgagttcagtgtatactgtttgggtgatgggtgcaccaaaatctcagaaatcaccactaaagaacttaggtaaccaaataccacctgttccccaaaaatctatggaaataaaaaaaatgttaaaaatgtttaaaaagatgttactacacttcttttagcccacattaaagggcaggggattagaccagggcatgaatgtcacagctaggaatcatgagagctgattagtcagggttctccaaagaaacctgaaccaatagaatagagagaaagagaaagagttgttgtaagggattggctgacactattgtggggactgattaagtcctaaatccattgagccaattggaaattcaaggaagggttgatgttgcattcttgagtccaaaggcaattcacaggcagaatcctttccttttgaggggaccttagtcttttctcttcagactttcaatggactggatgaagcccacccgcactatggaaaataatctgctttactcaaagtttaatttaaaggttaatcacatttaaaaatcacctacccagcaacacctagactggtgtttgaccaaacaaccaggcacctggccaagtcaacacgtaaagttagctatcacaggaaccatttagagtctgccttcacatgaaaaagtattttttaaggaagaaaaatttttcctctttttctacttcaattttcaaaagcatcacattttataaaccaaagtattgaggtatatgctgtttttccaaaacagtcattttgactttttcaggtattttagaaaaatgttatttttttctgcagacagcctttaattgctggcatgtaccttatgatgtctgttgacactgttatcccagcaggagaaaaaggtgagtaatgattttttaatatttaccattacctcattacctaatctgtagaaatggatttatactgtattttttataaactttaaaaataatcaatatttttatgtcttggaaaaatgaaccaatactttattgtccttggatttaaaatagatttttgtattattccaagccagtggtttattacttttccattctttattgagatgctaggaattgaggcccttgtgtaggtgtgtattatataaattaaagaataaatcttgagtatttaaaaataaatcatccattcttgagatgcagaggacacactgcataatgagcagtgacataaacttctacatagaaagatttaaaaattaaacgactagcaaatccagcaccaacttagtctttaaacttggatatagttggcttacttctctacttgcaaaatggggatgataatagctgattctcccaagcttactagaagcgatgagaataagtatattattatttatcaatatattttacgatcctctgatgaaagtgccatatgaaatattgttcatttgttttcgctgggaatctcttaaagttaatgaccagtatggtctctttgttaccattttttcatctattataaaatgaatatttattgaatagctactgtgttagactataaggaaggaacagtatgaaatggcctcttctcaacaggaactgtcaatgtagtgatgttaggtgtctgcattcaatttttcaaaaattctttcattccaaaaataaaaaccaatttttaagctttctcaactggataaatttcaagctaaaggtaacaaattaagcctatgttttcactaacagagtattttgatttggttctagtcattctgtttatgaataaaataaaaatataaggcaaggggttcttaattcatgtgagtaaagtggctggcacagaataagtgcttaatatctgtgtatttaagtcataagaaaacctcagtccctagcatcttgtgaataccctatgcataattttagataagaataatgtcattttccagttgaatagtgacttttgtctgtgttttcatttcccacagtggtgaattctgacatttcatgccattataaaaattatccaatgcatgtctttgcctatagagttcacactcaccatttaggtaagaactttacatgttaaattataaatatttaccattgtgcttcctggtgccataaattaaaatgcaaattgtgtttgaccttaagtctgtttcaatgaaagtgatttcatataagaccttgaaatattttatgctgttttatcatattgtttttttaagatactcagtctttgcagctctgaaaatactcagatttctactttaaagtaggaaagtaaatatgccttttgtttttctaataccttattatattaaatgattaaaatttgtgtttattacaggtaaggtagtaagtggatacagagtaagaaatggacagtggacactgattggacggcagagccctcagctgccacaggtgggtaaaatctagtttaattttgagagaaaaaaatattaaccagcagaaagtaatttttaaaaattattatgcaactcttgtgaatttctctaaaaatctctaaatctgccttaactgtataactgagctgtataacctcctttttgcaacttccaatttgttgctttctttgtcagttttctcaatatggtcaaaccatgttggtggcctttcacatcccatcatttattcaaagacagtatttcagacagctcttctattatcacatttattctgatttttatgggatgcatttgctaatagtatttttttgtttatttcaaagtttggtgctcttgtcataaagtagaagttattaattaaaggtgaactgtttttatccgatgattaaaggtgaactgtttttatccagtgattatttgtgtatgtgggtgggtgtgtgtgtgtgtgtgtgtgtgtctatttcactgtctgtcttcatcctctctacccagagtgtaccaagcttcacattattaaagcatggggttctgtgatatatcaatagaattaaggtcaaaaatcctctgatcagttgaatggatgctgaaaaagcatttgataaaattcaacatcccttcatgattaaaccctcaaaaaaggggtaaaggaggaacatacctcaacacagtcaaacatgtagttctggattttattggtaatattaatgattcattgtgtttgtctttttggtaggctttctaccctgtggggcatccagttgatgtaagttttggtgacctactggctgcaagatgtgtattcactggtgaaggaaggacagaagccacacacattgggtatgattctatacattccactatttaaagatattttattgggataaggcatgattacaggtgacagctatctttgtgaataaattgtacattttttgtcctgtcatggacaattacaacaaactgtggcattttatcatttcaaagctgattgattcagataaaccccagaacatgtgctcatttttttgtgctactctttttcttacttcctcaaaaccttcggtatcatacctctaaatattacagttatcaaagacttcatattactttctgaggctcatcttaataaagaaaatataatgataatgaaaattttttttctcaagtgcctttttgccctgtgttcacggggtctacatttggtgattcctattaaatactcagaaccatgatgttaaaactctcgtgaatttaataatttccagttgtttagtctactaaataaggataataatatgcaacactttatcaaaaaagaatgttgagccttttaaataattttttaaatactgagcctccttgaaataattatattctataacactacataaaattttcaaagcactatgaactctttcaaaaaaaacttacctaaatgaaaaatgaaaggtagtttcttttcatgctttttgatagaaaagaatcaaggagacttctttttatgttaaacaacttttaaatatttactgatgccatctggaagctagagttttaaaccatttatgtcgtaatcaaagagaagttacagaaagtaagcatctgaaaatatgctttagatgccctaaagatgattcttgcgatagcaacactaactgttggctgtatggagaaagggaaaaggtactaaggcaggtttaaaaaggaaagcaggagcatttgatatagtgtaaaagaatttttatgtcactctaaatggcttttttatataagtaagcataaactttaaggctaaggataaaacaaataaacctttatcaatttctgttacagaaatagtttccaacagctttgcttttggataaatttgctaaatttggcaaagagacttcaggaaagcaatattattattgagttatgggaaacgatgatggtaagaaaaagactgacaaaggaggcataactagatttgaaagaaagagcataacgagtcccttcttaacaatctttacatgaggtaacatgattcagagggtatccatcagttgttcattttatgtcagtgcagagccataggtagtttacttaaatgccccaggttatgttattaacctttgtagtaagtaaatagagcagtaaaaaaatccctttcaacacattacctgcattgacttacaagttttaagtgtgggaaaaaaacagaattttttgcctagagggctctttacagtttgcagcggggaggtttgttactttggccaaattctatccttttgagttctgtctgtgaggtaatatctgccatagaaattaatgacttgttatagtactaggatgggaggccaaagtgatctctggaggcctctatcagttccatgagtctagaataattcttgtcttttttaaaatgtgcattttgctttaaaataataccctaaaatgactacactaatttatcctttcacaaatctcatgtgggctaaaggaaacaccattttgtaataaaaatgaaatagaaaggaattataggaaattaacttattgggtgagtccatattctgaatatttaatttctactacagaggcaatttttttaccagtggaatgacaaacaagtaagacaagttttaatacatttaagtatgaataaaagttttcataataatggataatgttctcatagcagttaatatgctttttatttttagacaaataacaacagcaatgtgtctctgttttataaaataataggcaaaacctccatagatgattacaggatcacagttgagaatgtgaccagtgaaataaactagtaatttatgatgtcggttaaattaaatgatactctgtaaatccatatatctcctctccctcttctcttttcccatctacctccaacccacacatacaaacacacattcccacaggacacagatttgagccccgagcgtgaagcacacataggtataaatcacacttaactaaggataggctggggccagtaggtgcctcctccatgtactgcgagaactctcagcttcaagttttaaacctttctgttctatggttacatagaaactaggttttacagaaaaaccgttgacagtagcctactaggaagatttacagttgagtgattcttctaccaaaatcaagcttaactgtattaagctagaaattttggaactggagaaaactttgcttgggtagaacaatcatgggtaactaatgaacagcacttaaaagtagaggctgattttcccataacagggattcatcttaaaataccacgatgtaaaaacaggagatggatttaaccacctgagtgtccataaatggatgaatgcataaagaaatgtgttttacatacacatgatggaatactatttagcctttacaaggaggggggggaatcctgtcatttgtgacaaggtggatgaatctgaaggatgtattaagtgaaataagccaggcacagatatattaatacaaataccacatgatctcacttatatgtggagtctaaaaaagttgaactcatagaaatagagaatagaatgatggttactgaagggtgggaaaggaggtaataggaattgttgatcagaggacataaagtttcagatagacaggaggaatagattttgagatctattgcacagaagaatgactatagtcaatataatgcactatatatttcaaaataattaagagaggaatgtcaaatatttcatgattaaaaaaatgatagggccgagtacaatggctcatgcctgtaatctcagcactttgggaggccaaggcgggcagattgcctgaggtcaggagttcaagaccagcttggccaacatggtgaaaccccatctctacaaaaatacaaaaattagtcgggcatgatggcggatgcccataatcccagctacttgggaggctgaggctggagaatcgcttgaacctggaaggaagagattgcagtgagccaagatcatgccattgcgcttcagactgggctatagagtaaataacaggagcaatgtttccctgtctccgtctcaaaataaaaaaatattaaaaaaaagataggtaagcaaagtgatggatttgttagtttgatttaatagtaccacactgtatccatatattaaaaaatcacattgtaccttatattacaaaattattttttatttcaatagtttttggggaacaggtggttttttgttacatggataagttctttagggatttctgtgattttagtgcacctgtcacccaagcaatgtacactgtacccaatatgtagttttttttatccttaaccccctcccactcttccctcctgagtccccaaagtccattttatcattcttatgcctttgcctccgtgtggcttagctcatatttataaatgagaacatatgattaagtgcttaccattatttgtcaatcaaaagtaatattaataataaaaactactttaaaagtaggtatatttaatatgagatatattaataaatatacttaatggtaaaatgttttacccatatattatatttatttttaaatagtaaatatgaataatatagcctaaataaagttgcaccaaagtattatatatactgacaacatagtactactaattgttctatgaagaagcaatattttgtgcttgactgcattacatattttatattcaggatgatacttctctaaattcgtttcaaatgtttagtcaagtttaaataaaaacagaatttaattaagtcagccaattaagctcattaagtcagctaatcaggctaaaagtttatatgctaaaatttaatattaattattgggactaggtagacaatatttaccaatttggtcagttttgttggtcatacctttcatttggaatgggtcatttcattaaaatatgaatgttcatggataccaacatagcactttaatctgcatttttaaatatattacatgcaaagataaagttacatgataaataacttcttaatgtatacatttaaaggcaccacgaaactttttaagaaatgattaacagttttgtaaaatgacttctttgaagtttttatatttctttctaaaattactattaccgattttgcctattttcaagcctaacatttgttgaatataaacggggtagaggtgaagaattcttgagctagtggagtgtttgcggtatagacatggaatacaatgatatttggaagtttttaagtcatacatttcagattacttggtgctttattaaatctgtattacatatctttctaatataatatattttaataaaagctctcatggaacctaggtaaatagattagacagatggataaacagatatggatataaataaatattttcagaaatcccacagatcaattgagtacaaaaatttgatctgactcattattcagtagtataatatactagggcaaacatgctatgtcatatgaagttgtaaacatttattaagcaggattattaattcttccttcattcaacacatatttatcaagggcttccaattttcaggctcacacattatgtcagacctaaagctatttatattaagtatgccagtataaaacaggaagttatcacataagcactttattattcaagaagatgaaataaatgcactactgtaattttggaatgtaagtaatgccagcagtcatcattttaaggaatcacactggcattggagaatgtttaaagggccattcagtggacataatctcccttcctactttctcatgttcataaatcactcagattagcagagttgaattgcatatgttgatctcggtggaaattaagggtacatgtgtcaaaatactcccttaggaatacagaaagcaatttgttttaaaatgagattttttgtttttgaatgaaaggtgaatgattgtaaaataaaataagcaaactgtgatgctgatactaaggatgatttgactcctgacatttttagcatatgatagtttctctgtcacataggagctcagagttaccttgactacaagtctaattatagatggaaaggaataaagtatgactctttttgttcagctcttttaatgaaattttccttgtgatagcaaagattcctaaattatttgataaaattcaattttgaatcatagaattggtaccccaaatgaactgtattggtgagctgattaatatgtctcagaaaatcacgtgtgtaaaggcaaacacatttatatgtgtatcaaattaacacataatgtatgtgtaattgaattagtgtattgtgtgtgtatgtatatgtgcatgtgtgtacacacatacatatatgtatactcttacacatatatgcataatttttctcaaaagttaattcagtacatggtaagataattcacttttgaggaaataacctgcgaccttagcttatgtttttatttttattttctcaaatatgctatttaaaataataaagtgtgatcataagttgtagaggacaaagagttacattattcagaaagttactgattttcctttatttgctatacttaagtacatgtgtttttcaaacatgtaaccttgtaccttggtacacactatttctaatatagtaattgctgcctttgtctccaatattagtatataattattctaaacttatgccacctttttatttcatattcttctccataattacgatctataattttcttttgttttttgttacttactgctttttggtgataataatgaatttaatttagtaagagtaaattattgtcctgatttagccgacattgcacaatttaattccttgttctcagattaattacctttcacttgtttgaaatgaaatttttacttttagtacaattttttttcaaatgtatgttaaaaacaaatccttccaaatatacatgtaacaccaaaattatctttgaggaaatatatattaacaagatattttatattagttattttgaagctttgcagtattagttgcttcttaaatctctaatggatttttctgaaagcttgaactatgtgtttatctgaatggatggacagatggacagatagaaggatatagatagaatatacatagatatttacctgtctttatacagataagacatgttatgaaacatttctagctacacatctgtatgcatatctatgtatattcatttgaatagctttatatagctttactacatgcacactactctattgaagaaatccttttgattggtcattcttaaacaatactagcattttgtttctacctacgtaagagcaagtcttacagtacagcttttcttaaattatgccctggaacacacagcaacacaaaggagcccggtcagattcatttagggaatagaacctactgtatccacgccccccaccccaccatacagtcatgagcacattgtgtattaaaggatcaggcagtacaacattgtttaacttgtatagcccaacattttcatttgttcatatggtaagatttttgtttgtttgcttttttttttcttttcttttcttttttttgagacggagtctcagtctgtcacctaggctggagtgcagtggcgtgagatctcagctcactgcaacctctgcccctgtgttcaagcaattctcctgcctcagcctcttgagtagttgggattacaggcagctgccactgcgcccagctaatttttgcatttttagtagagacgaggtttcaccatcttggccaggctggtcttgaactcctgacctcatgatccacccacctcagcctcccaaagtgctgggattacaggcgtgagccatcgtgcccggcaggccatatggtaagtttttctcaactcttctgtaagcatttcaaggaccaaagttttgtggtaataattgtggaaatactactctagtaggaagagtaaaaaaagttctagaattccctctctaagtattttataaaaacatataatagctcacagaataaacaatttccatttatgcaacagagaacacactggcccaagggaccaacaatatttagaccagcagtgatagttacttcattgtgtgtagctttttagtaaggaaaaaaatcaggatactggcttcttacatatgctgttgtgggtgggtataccttctccagtgaaaacatgggtattggcattcccaaaaagagaaaatatggaaggacccatccattgatgagttgcaagtttcatgaattattatatgaatttaaaatgtttttcctttcattaatttgagatgcttaaatgattattttgcctttcctctctgcaagatgattaaaggtttttaaagctagagccacatctaaaattcctttttcctttttgctcagttgatctacatatacctccttttttttaaagcaggaaagagaaggataatatggcgggaggctccagtttattatttttgcaacagccattccttttatagcacatactgaccaactccaaggctgttaaaatgtaattcttaggaatggtgttttgacaccatgaagacatgtgtagtgaacagatgtttgtttggctttgcacttcactatttgcttatatttcacgggagaggcaattacactgacaggtatcagattcagagagtaagaagccaaatgatttctaaagcataaacagagcttcccatggcaggggcttattcctgtggtctctcaagggctctatattttcaaagcttagagaaatcaaatccctgtttgaaaaatatttttatttttttccttcccttgctgatgtcatactgttgctatggagagaaagtgagtgctgcatgacattgctggaaaaatcaacactgatgtatttctgtacagcaaataacctacctcatagcttttttttattagtgtaggcttgctaaaaattgtcaatactaatactaaaatggacatgttcctttgcccaaacaactttgctatgtaaaagtcttgtgaaggtgtacttaaatggttccttcctaataatgctaaagagaatgaaatatataataacccatgtgaagtaaggaagcagaatacatattttgtaaactattagatattttttctatcattgggaacttttttcttggaaatatccactgttttaaaatctatttttaacattgagtcattcaactgtacagcactacttccgtcacatctcaacccttaaaaaagattagtgctgatttcattttgagtcattcctgaggcattcttttcaaccctgctataaaagcctagttgccaagtcagacatcagggatacactttgaatgtcttagtggggacacatgattctagattcatctggctgtaaggaaggaggcagttaaccaaaaacaaggtccaggacttttgatgttaagaggaaaagccatttttaaagacttataataaataatatatgataattatattgaaggtttctgatttttaccattgttaaggaaataataaagattttccacgagaacaataacttttcccagtctatgagttttagcaaataggaggggactaaagaataaaaagattcaagagagaaaagaaagtaccatattccctcatctactaaaatgccattttcatcagtggtatttagtagtgttcatggtgtgcctgcaaactgacactccattgttaagtggaaatatgcctttgacaatgtgcttttgatgttgaaaactgtgatgggttttaatgaaagctataaaataaatgcacaatatttctacctttgaatccattgctggcagatctaagggcttcatttttcttgcattaagcatgtgttttatgtgaatagttgatttgttatatcttttttttgcctgcagtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaaggtaataattgatgtttaatataaagtaatatatgattttgtattttatatttttgtatgtatcttgtttgatgatatttaaaatcatctttattcccttcttctaccagtcacatgtacacacatatttcttattttctcatttttctctttcatatcctatctcccctccctgacatgtacccatcagaacagttaaagaggaaaatctcagccagggatgaaacagattcattttgggaccaatcccataaatgtagaccttttttcacttaattcatgttttctcatttcctcatctaactccttccctaaccagtaatgacttacacagtttatgaatttatgcaccatgttctaaagatcactacagtttgccagggaaaatggttatcatctccagccatactttaaattatccatttaatgggcttcttcaggcaaagaacaattattgatttgtgaagcattgctagtcttgactttttttatctaattctcagaattgttatttaacatatatatagttcctctgcaaaatggtcatattgactgtcactttttaacttaaaattgcaaagtctactccttgttttatcgcatgaagtatgctgagacttgattgagttttgcaagttcagtcttaacacgctagagcagcttcttatttctttctagtggaaattttatgagagaagttagcatagcattctggccatttattaagattctactatatttatagaatatgccttaaagtgttcttaaatgttcttaaaacagtgctaaatttaatttaagaaaacaaatatgagtcattttgtcaatgcattttgaaaattctgtatcatttatatattattgaaagggtagttgacctagttattaagtcagatgtcttgtaattggtaggttgtgctggggggtggggggtggggagcttatgaattagagcatttctgtcttataaattcttaatacggtaataagcacaagaccctgaatagtatttttatgttgatggactatttccaataaactattttaagtatgtaatacatactgcaaatttatgctcagcttctttgatcctttacagaaacagaatataaagataagattcctttactacagcagccaaaacgagaagaagaagaagtgttagaccagggtatgtatgcttatttctataactagtcctataaaagtatcaatttccaagtaggcaaccaaattgtaaagttactgagatattgtatgtctctctgtatctgcctcaaacactatgtattgctatttttatacaatgcataattcatgagaaaatggtcaattattgcactttagctttgaaagtaaaattcattcatataatttagtgctgtttcattttctgtctttgttttacttcatttaatattataatttttatgtatagtacaaataagtgcaagcataatcattaaaaaccatcaggctgcttttgaaatctaataaccttaaccatttaaattattgtatattttgtatggtatgttcattaagtagatttgagattcaagaaaaaaagaaattaagaattaaatccacatcttacctctataagtcattcttctctgccttcatcaaggtaggagcgattattgtcttatacatctatagttttgtgttaagttgccatctgcagagtttaaaaaaagcatcattcttcccctgttctgtttattgaaagtggtaatgtttgatgcttgtatgtcatatactgcatgtgctggtactaaaaaattacttccctgaatcttggctttttgccagttgtttggaaggtagtgctttgggttaggctttggagtttgttatcctaaaaagttgtttttggcctacgatacacgtttttaaacgttagtttcatgttaatgcaaacccacttctactgacagcacaaataggaatagaaaggatttttctattagcaacatgtagaagtttcctgtttcttattgctagctgctattggaattcttcaaaatgtattacattaggtctagttcaaaaatatcactcttgtatgaatagtttttacaaaattaaacaattgagactttagaaaggggaaaatgcattctgaaagaagcataaagtaaactgtgatcctgaggtttttaaattatacagcggatgttttataatatctcattctaacaaagtgaccttcaaaaaaatacagcttagctcaaagcactaaatggctgagtaatttaaaatagctaaatttatcaatcctgtttatatatttgtaagtaagccagtaatagcagcctaaatatagtggtattcagagtgtttactgtaacttcttatgaagtttgttcagactttcaatgaattattttgacatttcaaatgctatttgaaatgtatgtctttaaaataattttgtcttagaatacatttacaaataacaacatatatgaaacaatacggaatgagataccaccatttaatagatgcatcttataaaatggtatgtttctatggaaactgcagttggactatggtttccttttgaagttagtcaagttgatcaagggaaacactgacacttctaaaaggttaaaaacccaggggttttgttagtgaagcggtattaaaggttatatttcatctgttctttccaaatagtaggatgtaggaggtgttatatacgcctacaaaccagattctttaaaatactttcataccttgccattcatttacccttttgtgttttatagcatatatataatattcagaggtgaacattatctatatacccaaatatacaaatatacccaaactcttactggtccccgagaataattctatggacacataagaaattattttcctgcagtttctattttcttctgtttgtgaataaaaatgctgtaactaaaggtatttaacttgagaataaaaaagcattctgatattatcaattttcatattgcagaaaataggctgttactcatatgttgaaattagtgggcccattaaaatgtcatctctaatgacggtaaagacagtagcctaaccaaaagccatttcaatggctagcatagtctgtgtatgatcctaccagtctatggggaccaccagcctagaattaaaagagaaatacagaaatgtaccaaatgcacatttgtacacatagttcatgtgatgcactaatgagattagtctgtctccttacaacacatagggcaaatctcattgctgaaagagtatttcattcttcttagagatatttgtttgcacaaagtgtctatttgtatgcattctttggaaagtcaacttgaccaagtagctaataagggggctttaattattcaaataaattatgccatgtatgttaatttttaaagtaagccctcaaacttcacttatcactttatttggtgttctggccaaaacaatttgtgtagtatttctttacattgtacaattattttaatactttttagccccaataagcaaaagcccacattattgtggttgtgctagccacaagctaacagacaccatctatgttggtcctacagaagatgtgaaacccctgtagaaaacagcacaatgtggggtaggaagaaaagacttgaaccatcgatggatatgtactcatggacaagctctatacctgttagtgggtacagatagttctgtaagtgatgtagatagttccacctggttaatactatatatagtgtatatgtgtgtatatatgcacatacacacatacatatatatattaaataaatgctatttaaattgtactatatatagtattatatatatatatttacttcctatcttaatacattggaaaacaggtagaaagatataagtcaagatatgtaataaatgttatgttagaaagaagaaatgacctttactaagatagaaaaaaaagaaggaggggagagatagaaataatcatattccatagactaaaagaaagaaatgtagccatgccacaaataaacaggaagtgggagttatctctaacatggaggaaaaaaattcaaagaaagttagtgatctttaaagaaagccagtgatcattaaaacacagatttatttagtactctgtttctccaggagaaatatattttctttgaaatttgtatctcaaaaattgctagctattgatgttttgccagaatattaatcttgattagaaattaactagaaattaactagatgtcttgacatctaagttgtgcaaatccagtctgtgctttctcacaaacacactaacctttcaccatatctttgtctacatctgctctctgtagaacaaaatctggtgtaaagcaagtgtacctcagattctgtctcaaaagatgtaattacagagacaccacaaaagcatcattatatgacagttttacttatcatgttgtcctggatcatgcaacaataggaaacattttaatgaggctttaattgagtctgtagggatttctttaaaaataatgcttattttgactgattttttaaaataatattcattataaaagataaggaaattatgtaaagtataaatatacaaatagaaatcatccgtagtccccagaaacatgagtacatatatgtatgtgaaatatatattatgcatatatttacatattcaatatatgcatatgtaaagcacattattttaattataatgtatacacaatttcatagccctttttaaaaaatataccttgaatattttctccagtggtaaaaattattggcaagagtgatttttaatggctgcataatacgtgcatattcctgcctatatcaatttgaaaataacccatttgcatataagggagtttatctgcgaatgagttgattatgtctgcctacagggagaaaaacacaaatggatatttaaaacaaactaaaatgtcaccgtccttcaaagacattgtgagtgaagaattacctatatatgtaataagtacaataaactatacaatagactcaattaggcagtgattctgcatggaggaaatgaatcctaggagactatatagaatgaggaagttcacactgatgtcttccaaagcagacacacacacacacacacacacacacacacacacacacacctcacatatattaaggttggcacttttagaaaactaacacattttgtaagttctctttatttcttatgcattataatttcttatatgcgttcactataccaaagctataaacatcctgaactttctataaccattgtttaagcaaagaatatgggcttgaaactaagaagcttactagatggaagcaaaagtctacacaattacatttaagagttctgaatttgagtgtctcacctctttaatattcaaagtctagatgtagtgttgaaacttacgtctgttgtattgggaagattcagtgtcttaaattccaggcagaattgaaaatcaaaatctataataacagtatgtccttgttattatgtattatgctctagacaacatttatttggctgcagaaacagcctttaacatgttttattcagtttgctccaaaatctcctcattgtagtctttgtgccctcatataatcaatctttctactcaaaggtcagcataagctactgtattcccaaggcagagagaatatgacaaaaatataatttattgagggaaaataccccatgaccccagatagttaaaggtcttcggacaccttctgtgaaacagtaatttcacagtggttttatgctaacaaaaatgaattaccattggcatgttttatcaaataagcagaatcaagggaacaaggttgccagttaaaaacacaatagtctactgtcaaagcctgctaaagttacagttgtaaacagtttatgggaagagttaaataaaggctgggcatggtagctaaaatttatatttcattgatttgttcaaaatagggcattcctttgatcctctaataaaacacaaataattttagtaacatcttcttaactaattccaagcactctctatgccactttgctgttttaaagaagatacagtttttgtttgtatgcctattcactaaaaatttattggtttcttatgatttatgagcacttcacaagtctttatttattgaactcatctatcaaacacaattctaaataccccccaaggctctgggaagctgactgaatgctgttttgaattggtttcctaataacggaataggcagatgtgaatgatcatttatcacacagttaggctttccaatatagatctgtgtgcatggtagttatgaaaaccatcatcttctatcttctccttttttatatttgtctcgttttcttaaaaaggaagaaaagttgatttctgattgcttttcaatcaaatgagccctataaggggaagaaataataaagttcacttcatttgtgatccttgagctggtcaccatggtcatgtgttttatttctctaaggctagagaataaatattgtgggacagtaataagtaaacaatcaataaaccaaattgactttaacccgaagggaaaatcagttaagactaagtcataaaacaaattattaaattctaaaaagagatgcttttatttttccattcctcatatcctctcattaatcagttatgttccatggctctaatcatgttaacttggttacttgacatattttgtcagtggctaaactgctgctgaacatcctatttactctccttatattatagaaattgcagaacaataagcagtaacaagagctgggtttttttaggtaatgaagaactagtaatgtgtgtgggaaatgggaatttatattctggaaagttctgagaggtatttgatcatttttaaaaaataatagcacctgcctcattaagattttacaatttctaaaaaattagatacttttttttttctatccagtaatcttaaagcattttttaaaaaaccttcataggaccatttttcaatgtatatttcatctattttagtttttctcaccatattcctgaaagtacatcagagaaatttccatgctgggagcagggaatagtgagtggtccctgataatagaaaaatgtccattgatccacaaagcagttaatgcaagcacacaacttaggaactttaattggtggtgttattagattcccatgtactatgctgcattccttttctccacacattagctgctactatagttgtgttttccatataccaaactcacacaattgaattccttaaaagatctagagcatttgggtattttataagaatcaaaagttagggaataaaatttaaaaatgggaaattactgcagcctaaaatcatcaaggaaatatttttatctctgctaatgcagatgcaagggctgacatttttaacaaattattattcatcccagaattgcttattgagtatctgctaggatagggaaagtactaatctctggaactatgacaagaaataagaaatgagagggacttttttatataaaactatagttctatcttgtaatttctcccttcccagagataatttaaatatacagaaagtatttttagaacatcttaaagaatttggtcatacatgtaaggtacattttttcaaatcaaagaaaactaggcctttttttttttttttttgagatggagtcttgcactgtcgcccaggctggagtgcagtggcactatctcagctcacagctcactgcaacctccacctcccagattcaagcaattctcctgtctcagcctcctgagtagctgggattacaggtgcccgccaccacccccagctaatttttgtatttttggtagagatggggtttcaccttgttggccaggctggtctcgaactcctgacctcaagtgataggcctgtcttggcttcccaaagtgctgggattacaggcatgagccacagtgcccagccaaaaactagtcattttttaagctagttttgtgcaaatcgctgtggtatgtatgtattgaccagtttgcacgtttcttgtgttacgatatggacaagatagaccaggatatgacaaagagaaacccagttaaagaataaacctagcacttgagctcagaagatggttaatttaaaaagaaaaacaattaagttttttatagtaagattgataagtttgagaagaatgtataggaaaaagtgtaatggccagtacagaaaagacagggaaacctgaatccagtctagtgagcagtttggagggcaactgtcattctgaccgtctccttcaaatcccagttcaatttcctaccagctgtgcaggttagtactgtaccttttgtttcctcatataaaataaggacaataataacaatttaatagagattaaacgtattaaaccgtataaagcattcagcaaagtgaatggatcatgctaagctctcaagaaattttagctgctattattattttctatagtttatattgttctgaatatgttaactctgtcaacaattggtaagcagcaaacgtctccatttttctaggactgtcccagtttatgcctagtataaatattattaacacccttttccttttaaaaagtattctagtttgagaaacaaattatatggtcaccttagcagggagtcccagaatagaaatagaaaataccacccagaatatacccaaggattttaaatcattctactgtaaagacacatgcacacatgcgtttattgcagcactattcccaatagcgaagacttggaaccaacccaaatgcccatcaatgctgcactggataaagaaaatgtggcacatatacaccatggactactatgcagccataaaaaaggatgagttcatgtcctttgcagggatatggatgaagctggaaatatcattctcagcaaactaacacaggaacagaaaaccaaacactgcatgttctcactcataagtgggaggtgaacaatgagaacacttgggaacagggaggggaacatcacacaccagtgcctgtcggggggtagggggctaggggagggatagcattaggaggaatacctaatgtagatgatgggttgatgggtgcagcaaacaaccatggcacgtggatacctatgtaacaaacctgcacattctgcacatgtatcccagaacttaaagtataataaaaaatgccacaaatcaaaatcaaagttagtccagtggaaaaaaaaaaaaagaaaagaaaataccactcagaaatatatagctgaacagagctgtggaaaaggtagctatggggatataacccaggagtgtccaaggtgggtagggtgccatcaatcacacatcagttccgtagaggtagagccacttttaataccatcctagacagattttgtcatccagagcagagatgggggtcctttctgaggaaggagaagagtctttcactatgacaatcaaaagataagattcccaaatgagtactggtggtaaggagggaaaagttgatgttgcaaatcagcctaggttggaccttgtgattcactggttagagagagaagaacacagttttctgagttgatttactcaaaaaagtgtcatcactaagagagacactattaaaaggttaaaatatggcgagaagattaagagctccattttagacattttaagttcaaatgagacagacagacatccaagtgggattttccagaagacagttttgtaacaccagtttggtgttaggagagctccaggcttggtagtcatgtgcctggaggtggtagcttaagttttgtaagtgactgagatcacttagtaggaagaggctttagccaggggaaaaatgtttcagggacagacttcccaaaacaccagcgttttttacatgatggacggtaaaaagaggaagcacagatgataggtggagaagacctgtaaagaacaacattataaggagagaggttctgaagggaactttcaacagggctacagcctcccagtagatcaaaataaagagtctattagcattggcaattaggatcccttacctcttggagaagtcatacaacggtgaaataggaagtggaaagaaatgcatccaatttagggagggaaaaggatgtaaggaagaatgaatcagcaagtagccctgcaccatccaatatggtaaacactaggtgaaaatatttatgttttgaatataaattaattcaaagtaaaaaattaaaaattaagtttctcaggtgcactagccatttacaaagtactcagccccatgtgtctgtctagcagctattaggttggacagtgcagacatagattacatccattattacagaaaattcttttggacagtgttggagcttgtaaaggaagagagaagatggaaaagcctgaaggatatgttatgttagaggagagtctctccccacctccacaacaactcaagccctaagtgagtgtatgtatagcctgtgagtcagatatgaggtaaagaagttgtatttattaataaaaaagaaaagagagaagacaggagaggctttagggaattctggaggaatggcattcagaacagtggagtagagagagttctttttccaaagatacgctaaaagagatggagaaggtacagatacagcctcctttggcaaagccagtaaccaattagctgtagtagccacagtgacttattaagaaaatagagggctaggaacctaaaagggctttttttttaattttattttttttacttatttattttttgagactgagtctcactctgtctcccgggctggagtgcagtggcgtgatctcagctcactgcaaactctgcctctggggttcaagcaattctcgtgcctccgcctcctaagtagctgggattacaggtgcccaccaccacacctggctaatttttgtatttttagtagagatggggtttcaccacgtaggccaggctgttctcaaactcctgacctcaagtaatccgcccgccttggcttcccagtgctgggattacaggcatgagccaccgtgcccagtcctaaaagggctttttgttttctattacaaaaatccaaatgtttgactggaaaaaggagctgatttttaaaatattatataaaccacaggttgaagcagatgcatgttgcaattagtttgttttttcagtcagtaattataatagctataatttagtgacacctactttatgatatgtactggactgggtattttaatattagctgtcttctttaaatctacaaagtaatttctaaaggttattgtcactatctttattaagttaagtagaatttacttaaaggcacaaagtagaattatttcttaggggcacagaaatagggtttgatgtgtatttgaattgaggagttgccatacagggaaagaccagagtgctataggtgcacccagcagagacccctgagttgaattgtcaagaaaggcttttttgatgtgacacctaagatctgaaagttgaggagctagtttattagtggggagggagtggtccaggcagaagaaacaatatcttcttagagttgatattcaaggaaatgaaaagccaatatgagtggaacataaactgaaaagaaaaaggaaacattgagagatgacacaggggtcaggaccaccaacttgctttatttatgttctactccatctgttatattcattagatgtattttctaaataaacatcttaatgtgactaagaaaattggttaacatttcaggattccatattatatctagtacactagaagaggaaaaaactctttctggtttgcacataggaatgtaagagatagccatctagtggtctctctctcatgtaacaagatgtttgtacagattctgctctgaaactttattctggcaaggcctgtgcaactgtgtgcagccaagcctgttgcattattttaacaatttttgctttcctaacccaataacaattttaaatgataaattcacatgaactggagtgctctacctttggtattttatcacagcttttagatttcctcttacaaacctgaatgactatgcatagttctgaacctgtcttcctccatcaagattaccctaaacacagaggttgcagtgagccaagattgtgccactgtactccagcctgagcgaaagagagagaccctgtctcaataacaataatagcttaaacatatggattcaagtttttatttaattttaattttttttgagatgaggtctgtctctgtcactcaggctggagtaccgtggcgtgatcatagctcactgcagccttgaactcctgagctcaagcagtcctcccactttagcctcccaagtggtgaggactataattgaatgccaccacacccagctaatttttttatttcttagagagatagggtctcactctgttgcccaggctggtctcgagctcctgggctcaagcgatcctcctgcctgggcctcccaaagtgctgggattacaaatgtaagcctccactcccagcctcaagtttttaaataatggtttatctctccctgaaatactcttgtattttatttcctaaataagacgtttcattgtacaagcatatgaaactatttatatttaatgtgtggtacacgagaatttagcagtaatgaactgtattaatttttcttctgtgaggcagaatgccactgtgccctaacagatttggttgacttataatttgctttgtttattttactgagattggccctattacttggtaattattttctgattgaagatttcacctgggataagctgatttcactggcaagaattgaaaacctactttgaaacattaaaccaagactatttgtaaacatgacagaatctcttagcatcattttggaaagacttcatctccccttgcaccactttcttaataatatattcttcagtgaaatacatcatggctaaaccagttatcattttcatttcctaatggtcatgaaaagagattttataaatgttttctaattgtgctgtaaatgtaattaaaacgtaagcaacaggactccatagtcgtaagtaatttcatcattagcagcacctagtataggatgaggaaaaggaagaactggtggttgcccttgggtttggtgtaggagagcagatttgtgttttcattgagaatatgtttaccattcacacagttgatataaatggatttgaagtcatcgtggaaatgatgagggttaaaatacttcatgaactttctgtagtcatattttgtatatgtgataatattttacaaataatttgctttcatagaattggagtctcatacccaagtttactccttaatacaggaaggcatagaatgcattttagtgatgaatcaccctaatgatatcagtttattaaaatcttttcctttgtttgaagctgatttaaaagtatcctttgctcaaaaaattatttttctcacttgctcattttttgtttaagaggaacaactagagcttacagtagcactgctaacaaaataataataaaatttaggtttcccagttgtcaaatggatacgtatttacttgtgttttacaggaaatgtatatttcctgctcaagaaatgtatatttcatttcttgtggcttgcacttcaataggttttaaaggacaactgcaaagagtttcttgtgcagatagctgttatctaatgtagctattgatgatattttattttagaaatctgatgagctcttaatttccgtatcaaactatactttgaaaaccatttattgaaatgtgccatgcaattacataagcattattttttctactaatatgtcaatagatgttatacataaagaaatagatgatatatgaaataaagtatttcatcggtctaggaatttttcttttttttcctcctatgcttaaaagtctgagtgcaaacttctctcttatttattatgagaaatgagtagatattttttaaagcaccaaattttgtaaattttgcaatcttatctaccctccacgcccttatctcttctcttttttccacaggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggaggtgcgtgtagggtttcttttaagcagtaaagtgtgaaatgctacaatccacgttagcaaaacctgaagggaataagaattaatgggtgaaaaaattcatcaatgaaaaggacttatcattagaaaaaaattactcagatttgggctatcagataacatctttgaagatttttttttgttttggttttggtctattactgcataaatttagtgtctgttctattggtgagccagaactacaaggaccaaaaaatatttggatcatttggggaaaggaggcatatgaaattcaggataaaaattcttacaattgaatatttttcattttgctcaatggaaatacattgaaaatttaaaacctgatatgtaaagtcccagtttaagaaatgctcatatactgtctccttgtaaggtaattaaattcctctcaaatgaatcttacactttcaacattctcatccagttgacttgtaaaatataaccatttttatgattttgatttcttaagtttcattataaattacaatcttaattggaaagttgagtatttctgaagggacctctactaagtcaataactatcagatttatctttatttctagcccaaataggcttccataagtagaggaaaataccttattcccttcaggtttccgtaccagcaagctatggatgcctcatctttgtctttaattgtgttgtggcctctgtgatattgattgcgtttcatgttacttgctaatgtggaaagccagataatacagcatgtggagataatctccaaaaaagtaacggatatgcgtgcatggcagctgtccatgtgtgggttggaatggcacaggctgccagcttgatgttttcaaattcagctttgtaggaggccataaattattcaacacccagctgatttttatttataattgaaaaaaaattagcatgcagtgccttttgttcacatgagagtttcaaagcatagtccattggtactggcctaatggtttctgtgagatgttaactggaacctggatttttaacttttcatgtttaaacaggatcagccctgctctaactcattctggatttgacaaataaaactatgtttctcatgaggtggtccctggacctccttgcctcagaatcacctaggatgcgtaagaaaaatttagaccctgaatcctatcaaagaacaactgaatcagcatttctgagtatgatgcctagaaatttgcagtttatcatgcccctatccatttcaaaacacacaggaatgtctgcctgaacttatattttaaggacagtgaattgtaacccagacaacatggaaatataaaagggaaaagagcctctttggtgggaatacaattgtgttcatgtgtgaaatgtgagttgcagcatgctttatttattccatgacttgtctttgttattcttagatttgaaatgatatcatggtcatttgtaggcatcaagagtgtcagtgtcccagtcagaatttgacttaagatattgcatttctgaaacttactcagtttttctacgaaataaatccttaaaatacccaagtgcatgtacttggcaaatatcctcatactttccaaagtggtcaaatggtagtgctcaagagaaaaatgcttctctagtatctgtttagggaaatttccttcctgtgaatgtcactgacgtgaataacatgagtcatagaaacatacagcacaactgcaaattaataaaggaacatgtatttcctttctaaaataatttaatgttatttccctactctaattacaaaaacttttaaaaaataaaatgcaaaacagaaaaactcatatttaggtaagctgtttctaaaaggctttttcttaattctctttcaccatttactgtaatgcagtgtaatatctaactttaatcgatgctgtttcattcctttgggtaagccagaggaaaacctatcctcaggaagcttccattttgtaaaaaaaaaaagtaggaagttattagcatataaggccctaataaaacttattagtaatctaattaatgtctagtcctcagggtatagtcaaagagaataaatttgatggataattttccattgtttctttcatacccttctccaggcaaagctgagaatgagcctaatggtcggaggaattaactgtttccctaagtgcctaatttactataaggaattgtatttgctgcatagaagaaagtaactttttatatgagattattataaaaacaaaaatgtcaggctggtctgttgcttaatattatagctcatacttatttcagatatctttgacatctcttgttaattttcaaataaagaagctgaagccagaagttaacctgtttgaatgaggtcacagatctaaatctgaaacttggacttgattatttccaatgtgcatcttctagtttcttacatttcaatacagttgtgctcaatcaaagagatcctaatgagcttgcccaattaagataaacttcccaagaacactggaccctcactgcttagaagatggagatttctattcagaaccctgatctgatgtccccagttgttgacaccagcataatctaatacaatggtgttttctgcagcagtattttagatttcatcagttggtctatatgttggaactgtaatatgatgatgaagcccatccagttgacctgagggttcaaaggtgaaattaatagatcagctcaaaaatgtgggtgtgactatatggtaggcctaggaacacctgagggtttcaaaaaccatactattttctgaacctttagtttggtcaggattccacttgttttccaccctggcatctgcctttaaaactgggttctccacctcgttacgggttggatatcagtggtcaccaagctacatgaagaagacaatagaatgatatcttctgacttagcccagctgagaaagtccttatcgttccccagaacaagacggttaaatactgtgtcttattgtatctctaggagtacaaatatctgcgaatagcattttttttaggttttatcttcatgacttttggtgaagatctgaaaactctgaacaattgtgaaaacagcattagcaacagaaacttcctggacaagttcagatacactagaccagaggttttcaaactgttgtttgaaaggagacccatcaagtaggaggtaatagtcacaggcttcccaacacacacatgcatgtgcgcacacacacacacacacacacacacacacacacacacacacaaaatacagcttccccaaaagcagttctgtatgtggccaaaatcaaatttggaaactacttcatggagtcagtataatgtagaatattgcaagtccaggtacccgactgcctggtggctttgaattccagctatacagttttctatgtggtctctatgcaagtataaaaaaattcactgggctttagttttctcatctataaaatgagattataatagtatactcctcgcagagttcaagtgagggtcaaatgatattatacatgcaaagtgctttgaacagtgtcggcatgcagaaagcatttgaaaatgttatagtacattaacaattgtgactattattgctaccattactgtcatgttatgttagattgagatttttaaaaatgaaataccaaagtataaatattgattatttgatcttaagcagcatttgtgagacagagaattttcttgcagtatgcaggaaagcagcaaaatttggcactctaagttgataagttaagaaaaaagtgacttggcagtgttttatcacagtgggaacttgtggctcttcaaacatctgatcacatacattgatctaccttgatatttgcatgtgatatatgacatacagtgtgaaaatgctaacctcaataaactaagaagcagatgtacttctttttaaacttagtatagtttagtttctatcattaatagtttagatagagatagcattaatagagtagaaacaaaatcttaggtatctttattctagttgccctctggaaactagactcattgaacatttaaaaagtagaactaactattctagtggcagatttgattggactaccacatacttgcatgtggaagcctgattcagtctgtattacaaacctctggatgtgagaaaatacacctgtatttgtgtgacaattctgatcagataagaggattcagaaggtgttcaattattcttatgatacatttagttttttcttcatttctatgaacaacttatacttaatttcagagtccattcttatatttcagccatagtcttacctctaggttcaagtcttgcagaattttcagggtaaaataaaccattcagttggctgaattttgatctctgaggggaggagaatggttaaaaaaaaaaaaacacctatacatagcacttactttgagccaagcttagtgttttagatgcattgattcattagaaaggaagaaagtgatgaaaggttaagtcacgtatccgaaattccacagctcaagaaaccaagatgcaaagccaggcagacttgctcccaagtcttgcttcttaatcactctgttattctgcatcacacacacacacacacacacacacacgcacacacacatacacacaaacaccctagatatacaaataggaagatgattttttctagtcatctgattatctcaggctacaattgtaataactataggtattataggtgtattggtcatggtttcctgattagtattcagccagtttgaccaatatgaaaatctcatttgcaattaaagaaattttaaaaaggaaaagaatactgctaatgcttttgagcccctatttatatggtaaatctcttcctcacttcactcccattaaatgaagcattataattaattcttgttttctttcttactttggtataaatatttctacaatagttttagttaattatagttattgctggcatttctgatgaataacaatccctgaccaaaataagacatccttttctcaaaagatgaaaatttacaagtacagaaaaagcaagcaccatattttgtttttgttgaagtcttctagtgatttttttcagttctatttcttaaaattaaatgtgaagagccttgttacactgaaattaattcatagttctgggtttgaattttttcctcaactttaggtctgttagtctttaggtaacacagataaatgaatgccctttcaaatacttattaataatttcatgtgaatgcaacagtgatcactaatattaatctctttctggaaaagtataatttattaatctttttcatgattaattgatgcaattttaatagcagtatttaatttttttctaaaagtagtaatttctttttctgaatatatggcaggatatgcggctgtacattaacctttatttataataaatgtaaggacgtaaggattctttatagaataatataatttatttatcataaaaagtgttatatgtcattggaaaaatattttaagatttcaggggttctttcaactttttaatcatcttttagaaacaaaaacaaatttgtatcaaagctactaggatcaataggtaatgtatatttaccttatttttctaaaagtattgtttccagtaatatgttctcaacatgttctcaactccagattttaaaaacaagcaatcaagcttgaaataattctatcatttgctatctgaatttagagcaactgacaaagttgggaatgacttgcccaaggtcatgggtaagaaatttgtatttaatttttaggctaacactggaaatctgtagcattaactagtcatgtattgaatcatttcttaaataataaccaagagaaatctgaactagaatttttaacttctctatcatcaaaagtgtttaaggtagaactcaaatatattttatcatataatttctttaataaggattttaaattgttcttaattggggattagaaaataattatccctgaaattgaggcctaaagtctggctcaaggctgaagttcctttcctgtcaaatgaagacagttatgtggaataattccgatacagttctagcattctctgattctcatgtcgtgatgagcaggaattggaacaataatcaatattaattccacttacatacacactagtcctaaatcaatgcctttattcttgatcatttcatcgtatagggaatagcctttaactacctgataattaaaaatatggtgacactggaagcaaaagtattaattaacttagctaatattcacagaaaaaaaccatgaagtttttctttaactatcctagaatttctggttaataaagagactcagatcctgaaagttttgaacacttggctaagtaatgtaagtgtgcaaagacaatttaaaataaaataacaataatgtaatataatttttccaaacattcagtactaagagaaccaggttgctcatggtgttagacttcatacatttttttacacatcatctttactgttttgaaaattcactaaaggtgtatattttcataaatatgttctagatatttacattaattttccttcttgaaaatttccagcctacaggggttctaatatgtgacaaatgagtgtttttgtaattggtgaagataggctcaaaacaacctatgcgtccatatttttttgcagacttccaagcacttaccagtttaagggcatatgatagttgagatcattcatagccagattaaagttctttaaacagtatttccaatattttatgaaattcatatttggccccaaaataatgcaattttttagacgttgcatattttctgtaagaatagtaactctgcatcttcatgggcacttagctcccagtacctagttggcaggccactgaatagaaaggttccagaagccattatatgtgtttattgtctttattgatagtaatcagccaattagcattttcattgagtattctcatagtatcttcagcattctgctatgggtgaaaaggtagtacagatgaattataaggttgtaggggagtttgaatgctaattgataccataaacaagtagagactaaaacatagactttaatgcatttatgaggccatacagtaagtaggccaggccctgtgtgacagttggtgacaaaaccatgaataagggatgatccttgcccttgaagaattctgtctagttgtagcagttctgagctctgagaacgtgatgaaagcaattaaatatctgcattgtcgtgagctttgagttccccttggagcccatctagaagtttcaggagtggtgaatgagtaccgaattttgacaactacatgagagaagaatgaatgaagtgcaatctgagattcaagcaactttgaaatcattttaaacatttggtgggggaatgacttatccatctgttgatttatctagtcatttctaaatctaatgcctatactctgtttccagagttcactttcaaaaatacagcattaatcatgtcaccccatgttttaaatttcccatggacatacaccatcagagagcctgaagacagttcctccccacccagcactgcccctgccagtgcctgcccacatcattgaggcctgggtaccaacccagcctgccggagtccagacacattgtccagggatctgaggattcacccgccctgtctaccaccactggtgtctgtgcactcctcccaggggtctaaggatgggtctgtcaagcctgccatcaccactgctgccagcacccacctgcatgagccacaggggggcctgaggactggtccttccagcccactaccaccactgctggtgtccatgtgtatgacttggggatccgaggataggttcagtgctgatactgcctttactaatgccatgcatgccacccctgggcccaaggacctaactgcccatccagcccaccactgccactgccagaacctgagtaagctgcctggacctgctaccactgatacctgcctacaccacctaggggcctaaagcctgtcatgctcagctcactgttgccaccagtggggcccaaggatcaacccaccttgtgtccttgtcctcagcaaagcctccttagcttctgctaaaaactgcagcctaagctgctgaggaactcagagacaccactgatgctgattatagccaaagaaatcatacagagactactgtgtccacttagaagtaaaaccaaaccaccctattcaaccaacactatagttcatctataaagaaaaacatttttccttatgaaacccaatctataaaactggaagaagcaactgttataccacatatagaggtatcaatgtaaggacacaagaaacatgaaaaggaaacatacctctaatggaacacaataattcttcagcaacagactcaacaaaaaagaaatctatgaaattcctgaaaaagaattcaacataatgatattaaagaagctcagtaaaatagaagagaacacagataaacaatacaaataattcagaaaaacagtttatgatctgaatgagaaatttgacaaagagatattataaaaaagagtgaaacagaaatcctggaactgaagaatttaatcaaatgaaataaaaaatacagttgagagcttcaacaatagactagatcaagcagaaggaagaatttctgaatatgaagacatcttttaaaataacccggtaaggccaggcatggtggcttatgcctgtaatcccacagtttgggaggctgaggcgggtagattgcttgaggccaggagtttgagaccagctggccaacatggcaaaactccatgtctactaaaaataataaaaataaaactagccagacggggtggcgtgtgcgtataattacagctactcgggaggctgaggcataagaatcacttgaacccaggaggtggagattgcagtgagccaagatagcaccactgcactccatcctggatgacagagtgagactgtccaaaaaaaaaaaaaaatcctgagattttaaaaagaaaaaaaatatttaaaaatgaagaaagcctatgtaatatgatatataggacactgtaaactgaccaaatatcctaatttttattgttctatattgttctagaaagtgtagagatgggcaaaggcatagaaaacctatttaatgaaataacagctgaaaacttcccgttttgaaagagatacagatatccagatagaggaatcccagtgatccccaaatagcttcaacgtaaagggtcttctccgagacacattatagtggaattttcaaaagttaaaaacagagactaaattctaaaaacatcaagagtaaagcatcaagtcacatataaggaaacccccttcggactaacagcaactttctcagcttaaaccttacagatcgggagacagtgtaaattgatatattcaaagtgttaaaagcaaaaaacaattcatccaagaatactattcccagcaaagttttcccagacaagcaaaacttgagggaattcattcgcattagaacatccctacaacaaatgcataaagaagtccagattttacctctataagcaaaacaacaatatctaccatcacaaaaacacaagaataaaattcagtggcagagcagacacacaaatgagaaagagaaaggactcaagtgttgcctctgcaaaaaaatcaaaccacaatgataaacaataggaaagaaaggaaaaaaaggctatacaaaacaaccagaaaacaattaacaaaatgacaaaaataaatcctcacctaccgataataaccttgaatataaatggattaagtttctcacttatatagactgccttaatggagagaaaaatataacccaactatttgctgctcgtaaaaactcacttcacctgtaaagacgcataaagactgaaagtgaaggaatagtaaaatatatttcatgcaaatgaaaaacaaaaacaagcacgagtagctatagttgtatcaggtaaaatagactttaagaatggtaaaaacaacaaacaacaacgaagatgatcattatataatgacaaagagatgaattcagcaagaggatataccagttctaaatatatatgcatatgcgtcactggtgcacagagatatataaaggaaatattatttgacctaaagggtgagatagactccaacacaataatggttggggacctcaaccattgtcagcatcggacagatcatgtagacagaaaataaacattggattgaaactgcgctttagaccaaattggcctaacagacatttacagaacattttatctaacagctggagaatgcacattctttttatcagcacatgtaacattctccaggatagaccatgtgttaggccataaaacaagtctcaacaaaattttaaaaatagaaattatatcaagtatcttcttagaccacaaaggaaaaaactagaattcaataacaagaacaactttggaagctgtacaaatacatggaaagtaaacaaaatgctcatgaccaactattgggtcagtgaagaaattatgaaggaaataaaaaaaaaaatttgaaacaaatgaaaatggaaacacaatgtaccaagacctatggaatatagcaaaagcagtgctaagaggggagtttgtagcagtaaatacctacatcaaagagtagaaggatgtcaaataagcaacttaacaatgcacttcaaagaactaggaagcagaacaaaccaaacccaaaattagtaataggaaagaaaaagagcagaactaaatgaaatagagactaaaaaaatacaaaggtcaatgaaaaaaaagttggctttttgaaagataagcaaaatgagtaaactgctagctagactaaccaagaaaaagagggaagattcaaataaataaaatcagaaatgaaaaaggtggcatagcaacaaataccacagaaatataaagaatcattagagatatactgatttctgtatgaaaactgtattagcatacagttttcaacaattgtatgctaataaattagaaaacctagaggaaatgagtaaattcctggatgcatataacctaccaagcttgaactagaaagaaatagaaaacccgaacacaccaataacaggtaatgagattgaatcagtaatgaaaaaaatctcccatcaaagaaaagcccaggaccagatggtactgctgaattctaccaaaattataaagaactaataacaattttttcaaactattccaaaatatggaagaaaagggaattcttcttaatttattctatgaaaccagcattatcttgacttcaaaaccagataaggatacagtgaaaaaagaaaagagcaagccagtatctctgatgaacataaatgcaaaatcctcaacacagtactatcaaaccaacttcataaacacatcaaagagataatgcatcatgagcaagtgaaatttattgctgggatatgaggatggttcaacatcaaaaaatgtggtacagcacatcaacagaatgaaggacaaaaaccatatgatcatatcaatagatgcagaaaaagcatttgctaaaattctatttttcttcatgacaaaaactctcaataaattaggcctagaaggaatatacttctacataataaagtccccgtagagcaaacccatggctgacatactgaatggagaaaagaggaaagcctttcctttaagaagtggaataagacaaaggatggccactttgaccattcctattccgcatagtactagaagttctaaccaaagcagtcaggcaagaacaagaaataaaaggcacccaaatcagaaaagaggaagtcagattagtccctctttgtagatgacgtgatcttatatagagaaaaaccttaagacttctccaagaaaagtcttagaacttataaagtaattcagtaaagtttcaagacacaaaatctcaacatgtgaaaatcagtagcatttttatacaccaataatgaactagctgaaaaagaaatcaagaaagcagtcctatttacaatagcttaaaaaaatactgatgaataaatttaaccaaggagatgaaagatctcttcaggaactacaaaacactgatgaaagaaattgaaaatgacaccaaaaaaatggaaaaatatttcctgctcatggacagaaaaaaatcatattgttaaaatgacaatactacctgatatggtttggctgtgtacccacccaaatctcatcttgaattgtagctcccacaattcccatgtgtcatgggagggacccagtgggacgtaattgaatcatggggtcagtttcccccatactgttctcgtggtagtgaataagtctcacgagatctgatggttttataaggggaaaccccttttgcttggcttgcattctctcttgtctgccagcatataagacatgcctttcaccttccaccatgattgtgaggcctccccagccatgtggaactgtaagtccattaaacctctttttctttataaattacccagtctcaggtatgtctttatcagcagtgtgaaaacagattaatacaatctacagatttagtgcaatcattataccaatgacatttttcacaaaggaaaggaagtcaatcaaagggataactgtacccccatgtttactgcaatactatttacagtagccaagatatggaatcaacctaagaatatatcagcagatgaatggatagagagaaggtggtgtatgtacacaatggaatactattcagccataaaagaatggaatcctgtcatttgcagcaacatgtgtgaaactggaggtcattatattaagtgaaataagccaaaaatagataaataccatattcatactcatatgtggaagcttaaaaagttgatctcatggaggtagagaatagaatgatagttaccagagcctgggaaagattcaggggaatggagacaagttggttaatgggtaccaacatgtagagagatgaaataacttttagtgtttgatagcacagcagggtaaatatagttaacaacaatatattgtctatttccaaatagctagaagagaagatatgaaatgtttccagtgcaaagaaatgataagtgttcaaggtgatgtatattctaaataccctgatttgatcatgcttgtatcaaaatatcacatgtaccctataaatatgtacaattatttcgtaccaataaaacatgtttctaaaccttcagtggctcccaattgccggtagcagccatttgcaattgttctcccttttgtgacaagcaagggtgatagatgatagatactgttcatctgagcagctccattcacatccacttctatacctaggattatttgcaaattcaggcataccagctgtcattctgcccaccttctctccaaaaggcatatcacaatacacatgagtgacaatgacattttcatatgctctaaaatatttctaaagcaaattattccctctgtgctttactgctgctaataaagtacttgtaatgtacctcaaaattttcagtagaagtcaagacaccacagctacacactatatgatcattgttaaatccagcctcctttatgtggtatcagcacattttccagtctaaatcagaaatcagggtcagctaatccagtccccagccccccattccacctgacatacacacgtatcctttcctgattattttacaaaatcttacaacacattctgcaattataaacatcctcacttttattctttttgaccaaaatattctctgcccacttctacacttaatgaattccaccttacctttaagtgcatacaccaacgtttgctcccgtgggaaaccttttaagtagaccttaatcctaccctatcccagccctatccttgggaaggattctgggccctctcctatattcctgtactactttgtgtcataagtattgggttcctgggttttaaaaacattttattctgtcatattcctatcctattatagccctattatatccttttatttactaaggccaaaaaccacgttttattcctttgcgttcccagattctaccatagtaccttacatagaaaatacgcttagggaatagttgttgaagatgcttcagaaaaaaaagaaggaaaggaaagggaaagggaggaaaggaaaggaaagggaaaaaaaagaaggaaaggaaagggaaggggaggaaaggaaaggaaagggaaaagaaagaaggaaagaaagagaaagagaaagaaagaaaagaaaaaagggaaggaagggaaggaaggaaagatgatgcttcagcaaaggttgaactaatctgggcatcctattgtgctatgttttgttaatttttattaaaaaaatgtacaaagtttaaaatattttgggtgaaaaggtacttttctgtagttgacagaattattttgaagtgcttgttctcacacaagcatcctttcaagttttcatagctgatcatataagctttgagcttctctttctccccccagtctttaatgtccgtctttgaggatttcactgcatgttgccacatccttcagagtggcaaggaggaatgagactcaaattgctgcttttctcctcagaatctttgttgaagaatttgggagggacagaaatatcaacgctgatacaatagctttcatagtcatcttcataactgtatatcctcaattagtatagatatatacattgtacccctttatccgtgagcgtgtttataaaagggattaacacaagtgaggctggctgtggtagctcacacctataatccccacactttgggaggctgaggcaggaggatcacttgagcccaggaattggagaccatcctgggcaacacagtgagatgccatctctcgaataaattttttttcaattaactgggcatagtagtgcacacctattgtcccagctactcaggagaccgaggtgggaggattgcttgagctcagcaggttgaggcttcagtgagctgtgactgtaccactgcattccagcctgggtgacagagtgagaccctgtctcaaaacacccacacatgcaaacccagatattctctgaagatatattctgatcagaaataagaataatttggaaatcattcagtcacagagtttctgtcatttttttcttctctcattttaggaaaccaaatatgaacagtgaaagagagagtcctattcttatagggtcactgaaattaggagaatgagactgatatcttagttctgtgtaacaaggaataatcaatgagtggtttattatgggggctattttatactgaatatccagaatttactcaggagatgatagattagatagatagatagatagatagatagatagatagatagatagatagatgagggaaaaggacagaggaacacagagtgccaggcttattgcccattcttcctatttatttaaaacatttaaaagcgttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagcacggcttgattgtctttttttatttctttgcatctagtgatgttattgcatgagcttcttgtaactattatgaatcctcatgaggcaattcgacctttcccttttacactaaatgtgtggatatatcttttagatttccacatggaagaggcactggattggcctggagtatacttgttaccaggccaggtttctggggtggctctagaccctaagaataacctggtgattttccacagaggtgaccatgtctgggatggaaagtaagtaatattttttcttcaataagcaaatgaaaataaaaatagtgtacataattttttcactaaactaagaataatggtgagagaactataaaggttttttagaatttgacttttatgagcaaaatgtatttgtccttttaatgtctgactgtagtaagtagcagagaggaagtcttgtgtgctttaaaacaaagtagtttcatgaaatagtttatggaaagaagacagtaacaatctgtgattctacccacttaccattttgctccctcctgttatctatctataacattaaagatagttaagccagtaccttagtgaaaatgttcaagacttcaaggagagtgcttatgaaaagtgatcaactaagaaaggttgctgatggactataacaacgcacttttgttattttcacatcctgggtgcagaactatgccaagaccattgtcctggacagtgtggttggggcagtttggccactacatgtgaagaaatagtaacttggccttaaggttttaatatagactacttttattactcaaatttgctcttttcatgagcatcaaaggcttaagaataactctaggactatctattactcctgctttatcctctggattttccttttctacctccttagagggatttttagtaaaaacatagaacggttattgagtgtttcctctgagttaccatcattattcaggttttacagatgtagaaaccaagagaagttaagtattgtgcccaaattagcaagtggcaaagccaggcttcagttgcttcccatctaactccagagttggcccacttagccactttatgatactgcttttaatggaattgtaagcatgttcatgattgtatttttaaaagcttgccccacaatttagctaaacaatttttaaaagctaaaccccacaatttagcagcttattttaattcttttaagtaatgaatagccattattcatttatttcaatacaaatttacatagggagataaattttaagattttttatcaattacatctaatatatcttctcttttcatacatataactatgggtctcatttggaaaatcgaggatctacatgtataattcaattggttttctccagtttcagagatgttgattaaatttatgttaaacctggttctgtcacgtatgcatatgtctaatgtctaatattctttgtgcagtcgaagatgaaattcaatcaacatttcagaatacattggtagcattgttactgtttaattgtcctttccagttgtcatacttgaaaatggaatctgaaaaagatcacttcagagttcaaagtaaataatcaaactcaacattctcattcatacgcctctgttgcatcgtcttagtcattattgaacatctaatagtattttaacaagtgcttttaaaagcaaactattactattcatagtagcatattcttcattttaatgaatattgctacattttctgcatggatttctagccacattttaccagaggagaaaattacagcatcattttctcccattgatactgtttcagctgactaaagctaaattggacaaaggccaatttttcattttaatgtgatattcatttccaagtaaacagcagagactggaatagtttaatagaaaaagggatctgtgaagtccagtttagggtggaagatgaagtaagactatgaaacaggaaccacctaagagcattttctgtggcttatctggctgtgctagcatctaggtaaccaggatcctgtggaaatagattctggtttcattggcaaagccccagagtatttgccctgataaatgacatctacaaaggggtgcagttgaacatgcaagatgtcttcagaggaaactgctgattttactcactaaatctctgtttccttgctcttcttcatctttgtctttcagatgtaaaactatttttttttctctctttccttctcccttcctggtattgcctgttgcccttagcagactttgcaatccatggttgtaaagaaattcttttctggcactcagctctctgagtagaattagaagtagattactctgttagttattttttaggaaaataaatttggattagttcaaagaacaaattagattcaggctccattctttgaatggtaatgcatggccatcattcctaagtcacattctataaattggatgaagtatatcgggttttttttgtccttcattaaaaatccaaggattatacaaagaaaaagtaccttcctgtggaatttatgatgtacaggtgagggacaatacaaattataaattagttggaaactccattcttcttgttactactgttggatggtgacaaatcctgtattaattttccttgaaatctttcccattctgatatttctgaggttcacagaattgtaggttctataagaccagggcatattctaaatcaaattgaagcacattatatcccatagttcgtaagatgtgatcattctttaaatatcagacagtacttggatttaataataattcctaattaatactcagtacccaaaggttctttaatatcattgcatcagctgtctttataagtaccattattcttcattcccacctggtaaccctgatcagcccttattctttgacttaaacacactaaatatacatagcaaccaaaattataatgatgataaacctctgacctgaaagatgatagtcactccctttctcaatatgatttccatttttctcccttacttcaatatcgcttctcttctagctgaaataagaaatgcctattgccagcagggtgtaatgaaactttaaagagtctcttgtctgccctggtgttagggcagcatggcagctagagctctttaaagtttaaatgcttcccagcaggaactgggtagcttttgcctcagtaataactgttcctgagtttctgtcttaaaatcgccaccccactcaaagtgtttcttggcctttctttcatgtacctgagctatggttggggtgtactatgcagaactcacatcgtatacccacttaacttaactatgggtcttgcccctaacttatagatgttagaagttgtatttcttatttcatttatcatttcttctcttggagttggaagggatcttggaattagtataacttcagattctttctgttacaaataagagagaaaactcaatacaaactaacttaggaaaagataaaattagtttgtataagtgaaaacttcaaggaatatagtagcccaattacatcatcaggatctgttttacagctcatttttctgtggggtggctccatttccagtctttgattcattctgttgctcctctccatttgcaggttcaattcacattgtcatcctaatgtcacagaagagatagtctatatgcctgataagtcaacataaactcactaaaattagtctttatagcattccttcgtctgacctagatcatgtctcattgcacgttaaaccagttattttgggcagaggaataaaattgagtctgtggcttagcctgtgtcttttgttctgctcatgaaatgtgggagtagagtcaacattatctgaagcaatgggctgacagtggagctcaaaatgttgggtcaactagaaaaaggtaaggtttcattatcacaaaatgcaacaataaacatgtactcccaaaacagcaagtgtccatcaaagagcttatctccagcctcccacctaatgtatacatctcttctacagcaacttcaaccatcatccagtgtttgaattttttcaatgctaagaaactccctagatatgagacatgctttccaattatgggacccatctagatgttataaagttcttcattattttacctaaatctgagtcctgttacttcaccttttagtaatacaggattaatttattcccatttatccatgtcaattatttgcatatttgaagaaagccttatcttttgcaaactgaatattctccaagctctcaagcaatcttatgctgacatgatttatttcaactgaaggaattttggtctctctcccctttaagtgtttcgcctagaagtggtcatagtacctcacatattatttgatcagtgttacaattagttcccttgatgtgtatgctacacatctgttagtataagagaattgtattccctttttttagcagttacatcactgtgttgccttatgtagaatttgtaatctatgaaaatctccaaatatgtgtcaaaaattgtgctgatatttttactggaagtttatgcttatgcagtgttttaaaaatattgaattcagggctttattccaattatgttccactttattacatttagcattgtttcaatttacagacattattttaatcttaattagccagagactttgtgttagttctcccagctttgtattaggtctctttgataagcatgccttttatatcttcatagatgatgtttataaaatttgaatagctgaatggttggttttgcaagtttcgtttgtagagaactcatagtcttctaggaatcttcttccctcctccccccagatagctcacaaaccatctctttatcaatactttatggacttttgccaagatctattgttttagaaatctgtctgcttcctaacttgtagaaaaatcagttcaagatttgcttcgctagttttctggagcctcagttaagatatctgcctgggttatgcttcaacttctgcgatttctttcctaccttagggtttaactggccctggagaacagaactcaaaagtgtctgttacctttgtaccatcatgtctgagggaaaactataaggggttctacaaaaaagaatgtttcagtgttctatctttctcatatcgcaatttcacactttaccggagcctttttcttccagttttatgctattttctctagttcttcttggttatatgactgttcttccatctcttctacagtacacattgaatttgataactggtgggagatttaccaattcagtcaggtcaatcctagtaagagaaaatcacgtttttttgaagataggaggcctggatttgaatcttggttaccatttcctgtttttgagacttgcatcaagacgtttgaactccctgattctcagttgcttgcctaaaaagtgagggctttaataattatctcatactgttaagtaacaaaatgcaccttgttaagtcacttgtccccagtggccttattgactgaatagaatccagagcctggatgtatgatacctagttcttttttctcttcctatctatttgtggtatttatagttctaggcctaaaatggcactaaatagtcatactgaattttttttgtctgcccatctcttttcctgcctcacagggactttttacaatgtgtctattttcagaagtaagtgtttttaacataatattaagttatattccatcgagagtctctggcctttgtatatctttgcttttctaacattgaggttacattttcacttatattcttgcatgaaaacctacagttatttctctagcttcttaatttatataattatattatatttcatatcttccttcagttgctgttatttaatttgaattcccttaattttgattcatggcatagaattttattttctccttactctagctcttttgtgtgtgtgaatatagcaaagcatttcttcccagccttatctaaactgtttgattagctgctaatgtgaaaaatcattaatggagaattcaaactgctaaaataaagaactgatgaattccagcccataggccacagttcagtcttttcaactgagtgcttttccagagaaacaaagaaaaatcaaaagtgctccaggcactgtgtgaaatgttcagggtattattatagcctgtaaaaagttaaatgtagttgaaataaagacctctctgcagcaaataatgtggagtagctgctttagaaaactaaataagcagtttgctatagcaacggtgtatccagctctataatctgacagccatttgtgaactgttcaagggttacctttctttgaattacaagagtttataaactacttacttagcaagtttaacatgtgtgtttggagggggactgtgattttctcatttgagaaaagatgtcaatttattttattatttgccccatgtaaccgtcagggaccagctgttagttccgtgaagctccagccatcccaagtgaaaggattaggactggtcaaccaatcatctgagtaaatgaatgtcccttgatgctgccagtttaaacatatagacgtctgttaaaaaacatcacaatgattttaaatgaactggtcaggcctattatgtagtgattaattcctttaaagctacattcttcctaagaattctgggtttttcttatttgttatttacattatggaagtaaattactacatttaaatgagctgtatatataagtagagtgttttatctttggattttgttatgttttgttagctttgtgtcattttttactttgtttttgaggggtggtagttaaatgaacagattctctaatcagtaaattctagaatttgtgttatcactgatattcttaacagtgaaagtatagtaataatatgaataataatcataaagctatggaaaagtagctagtcttaagcaaacataaaatgccctttatacatatagatgacatgagtgtaatttgtgatagcaaacgaaacctaaaaagacccagataattagttgttacattgtaacaagatactgggaaagatatcttgatatgttgcaagacaattttttttaaggatccaacttttaattgtaaatatctgaactttgggaggtggagttgggagaattgcttgagcccagaagttcaagatcagcctggtcaatatagggagacccccatctcaacaaaaaataaattatctaggcatggtggtgtgcacctgtggtcccagctacactcatgaggctgagatgggaggatcacatgagtctggtaggttgaggctcccatgagccgtgatcatgccactgcactccaacctgagcaacagagaccctgtctcaaaaaaaaaaattactctgatttacttactctgtcttattttgtttgttccttatttttcttcccattccttcatttgctatttttcttctcattccttcatttgctatgtcaaaattttctattacaacaccaaaaagtggataatgaaatagaattagatgatcctcaaattagttaattttactatttgctgccaccactggaaacttgaaagttctatattatgaatataaatgtccatacagaaacagtgtttgtggcagcacaatatcaattacttgacacatttttttctacatttgtgtgcagtgcagaacaatgccattgatagaggatgtttttcacttacctacttatcaactgcaacatttccatttgacctgactggcacaaggactgtgggtctgttatttatatttactccttaatgcagcttgttttcttggaagccaagcccagcatttcaggtctgtgactctgagactctaatcttacatggctgtcagtgagtaatttaacctatagtttacactttgaaatatttgagcatctagagaaataatctggacctataagaaatgctttaagttacagaagttcagtgtatgctcctggagagggagggaaacctttttactttctcctcatcaataaattgtaggagtgctatttcctaaaataatatgaccagagatttaggaatgatggtgaatatttacatgaatgacaagacagatcaaaggggcagttatcttacagaaatactgcatcccattcttggagaaaccatgggggcaagtaaatatatcaggtttccctaatgttttgtcattctgcagagaggggaagatgtggaattatgtgtgctgaggtctaatacgaggatatataataggcatttggactgccactattattagctgtcagtggtgagtcagaactcacaatctacatataaagtagatagcacttggcaagaattatgaattggaattatgaatcagtaacttttcatattccacaggtcgggatggggtagaaaagtaatgtactagtatattccaaggaaataaactaagaataaatgaaaatattatatatagttttattatatgtagtgatgttatatatagttttgcaaaatggagaaactgggtaaagtgcacacagaattgtttttatttcttacaactgaatatgcatctacaattatcttaactaaaatttccattaaaaaaagagggggaaaggttttaactcttaatagcagaagcataattttcacattatttagattgccattgtgcctttacaaagcactgaaatgtttctgaataatgaggaatgtgagacttaaaccttgcattagttccttctcatgctgctaataaagacatacttgagactgggtaatttataaaggaaagaggtttaattgactcagttcagcatggctggtgaagcctcaggaaacttacaatcaggtagaaggggaagcaaaaacgtccttcacatgatggcaggaagaagtgctgagcagaagtgggaaaagccctttataaaaccaccagatcgcatgagaacctgctgactatcagaaaacagcagcatggggtaaccacccccatgattcaattactttctaccaggtccctcccaaatgggagaattcagccaaaatgaagaggctacaggccccatccaagtccagaatccagcggggcagtcaaatcttagagctccaaaatgatatcctttgactgcatgtctcacatccaggtcacagtgatgcaagaggtgggctcccacagccttgggcagctccatccctgtggctgagcagtgtacagacctcctctcagctgctttcacagttggcattgagtgtctgttgcctttccaggcacatggtgcaagccgtgggtggatctaacattccaaggtctggagaatggtggccctcttctcacagctccactaggcagtgcaccagtggagactcttcgtgggggctctcaccccacatttcactttcatactgccctagcagaggttcttagtgagggttcctcccctgcagaaaacttcttcctggacctccaggcatttccacacatcttctgaaatctaggcagaggttcccaaacctcagttcttgacttctgtgcacccacaggctcaacaccaaatggaagctgccaaggcttggggcttgcaccctctgaagccaaggcccaagctataccttggcctcttttagccaagtcctaggacacaaggcaccaagtcctgaggctgcacagagcagcaaggccctaggcctagccaaaccattttttcctcctgggccactgggtctgtgatggaaggggctgctgtgaagacctctcatatgccctggagacattttccctattgttttgacaagtaacttttggctcctcgttacttatgcaaatttctgcagctggcttgaatatctcctcagaaaatgggtttttcttttctatcacatcatcaggctgcaaattttccaaacctttatgctctgcttcccttttaaacatacgttccaattcaaaccatatctttgtgaattaataaaactgaatgctcttatgagcactcaagttacaccttgaatgctttgctgcttagacatttcttccaccagatcatcttccacctaaatcatctctcttcagttcaaagttccacagatctctagggcaggggcaaaatgccaacagtctgtttgctaaaacatagcaagacctttattccagttcctagcaagcttatcatctccatctgagaccatgccagcctggacttcattgttcatatcactatcagcatttttgtcaaagccattcaacaaggctctagaaagttacaaactttctgacatcttcctgtcttcttctgagccctccaaattgttctaacttctgcctattacccagttccaaagtcacttccacatttttgtgtatctttatggcagcaccctatttctggtaccaatttcctgtattagttccttctcacactgctaataaagacatacccaagattgggtaatttataaaggaaagaagtttaattgacttacagttcagcatggctggaggagcctcaggaaacttacaatcaggcagattgcttcagaaggggaagcaaacacgtccttcttcacatgatggcaagaaggagaagtgccaagcaaaagggggaaaagctccttataaaactatcagatctcatgagaactcactatcatgagaacagcagaaagggggtaaccaccccatgattcaattactttccaccaagtccctcccatgacatgtggggattatggaaactacaattcaaaataagacttgaatttatggaacttatgtaaagtctcagtactctacataaataggagaacaaaaaaaaattattaaattatattctttggccattaaaaaatacaccacacaatttgggtggggacacagccaaaccatatcaaaccttaaaaagagatagtgaatgaagaaactttaacctattacatatgaatgtgaaggttacaatatactgagtctcagatgtgctgaacttgttagtcattattatagtcaccttggaaaaataaaagattattaatggttgaatccagtacctatgtttttcagaggaatagttatgatgtttttagtaaataaattcatattgaaaataaactttcagatataggataaattatttggtgtttcatactagcaagagtgacttcatattttccctttaccattttcccataatttaataatactatgagtattcttacattggttcctatctaataaaatttcacatttcagttgataatgaccccataaatatcttatgaaatctgttttgttaatgatgatacttccatttcataaatttatttttttctagataccactgtgtggtttttaactgcatataatagcatatataaagagtattactgaagttttagattgacaaagctgaatcaatattttgtgttcaattgaatgcatcattaataagaactacttcagggacttattgttgtctttcaggaaaactatacccaaaagactgtaacagtcaagtagctcagataattgtgtggtgtattttttaatggccaaagaatataatttaagaatttttttttgttctcctatttatgtagagtactgagactctacataagttccataaatatggcagccaactgatgaatggattcatgacagatccaagcagtctgttaccttcccaaattgcaaatatataatagcaaatatttaatgttattcagattcttcttttgcttaaccagttgcactacaaaatattaatacttttttcacaatcttgcctgatgctataaaggcaattctgttttacagaaatattcataagtcatttattgacttgatatgtatatttataaacacacacacatacacacccacacacacacatacacacacacccccctcaactatgtactgatccaatccttttttgagaagataacttggtttcttgttgtttcatacatttacttctatattacagaagcttagattagaagagcttatctttgtcattcatccctgttgacatataacttcccaaacagaaaatgaaataagtaccatgtctgtgataattgtgaatttaagaaattatattactaacaatttaaatggaaatataattttgaaagtatatatatatgaatatatgtccataatattttataataatctaaaaggtactgagtttaaaagcagaaattgtcatatttaagttttttaattaattattgcatagttgttcattttgtagttatagaatagctgttatttggtaagttttatgcctctaagcatatttttgtctcgaggatagattcggttttgtaacttttaaatactttgaacatcctcttttatatctctataatatgtatatgcatgttgtacctaaagtataataacgaacattttgatcactgctcttccagctattattataattaatgacaaagttaaaataagtcatattttcttttgcaatatgaaagaaaatgtctattgaatgactgcatactcttttgaagagcttttgaaatttttcaggtacattaagagttcttgatcaatgtttctcaaaccccagtgagcataggaaccacccaagggtcttgtgaaaatgcagattcaggtccagtaggtctgaaactgcatttcccagcaatgccaatgcttccgttccactgaccaccctgagtagcatggttctacaggttaatggggtatattataatccaaatgactgaaatgtggcagacaaagagtgaagtcaaatacatttgagctcttttgattttgtatttatgtgaatggtctgcatttctcaatttcattggaatttatgattgtttcatgtcctatttaatgctttttgtttagctcgtttgacagcaagtttgtttaccagcaaataggactcggaccaattgaagaagacactattcttgtcatagatccaaataatgctgcagtactccagtccagtggaaaaaatctgtgagttaaatgacttatgttgttaagacttgtactacatatattgagtataaagtgtatcatagagtcttgaaattcgagtgttttgtataactgcacttgagaaagcagaaaactaactgggccatcccatctttcattttctacataggtgtttctaaatcttgactgaatattagaatcatctgggaagcttcaaaatatttagattcacttatctgtttgccatttgtatgttttcttctgagaactgtctgttcaggtccttgcctatttcataattgctaaatgagtatatttggaatgttctcacctcaaaaatgttaggtatttgaggtgatggatatgttcattagcttgatttaatctctccacattgtatacatatgtcataacatcacattgtaccccataaatgtatacaattaaaatttgtcaatttgtcctttaaaaaattagatttagattctgtatagagtggggctaataatcttaagttcccaggtgattttaatatgtagtcaagcttgttacatattacatatgtaatatatatcttacatacttgattaagtgagttgctgctcagccagatctaatgatccaaaaaaattcttcagcagaaaaattcttcaggacaaccaaactcatcaagtaatcaccattaagtaaaagagcttctctttttccgtctcaaagtgaatactaaacaaatgtcatttttagcattccttatcatgcgtatgtaatttggctttgaaaactgctcattatttagtcttatttcgagatggcacttggcagccaaaaaaaaaaaaaagttgactgatatttatggtcattgaaagaagtgagggaggcacttgcttacagatctcctgaaccattgtaacttgacagcttcaggaattatacccttctccatctgcttaagcacagggaaagctagcttcttcgcaaggtggatagccaccgttttgagtgcagctgcttgggagatgataataatgatgcttagaattttttaacagcattctcaagattgtgtgtcaggggtgaaatgtttgaacctgtttcattggtgctctatttattcaccagaagcaccctcattccagaaaggaattaaggggaaggcagaaaaactactgctaaatcaacttggccatcggtggagtatctgtttgaaagcaaatcataatcctcacattcagttgtcaaaacagggatctagttcagctaattagtcaaaatcagagtgttacagttatggcttatgaaaaaaaatctgtattgtcaacactacactaagattagaagctaacagagctattggattgtcggatatcattggaccaaaccacctcaatgtattgtccatgtgtctgttagctcagtccaggttccttacctagatcattaagattgatttgccagattaaccttctctaatgtttatctagctcactatttcactttgcttagatattcacagcccatgttggctggaggttatgtgctgtgggttttactgtctttaataggcactctttaaagcctttgagttatatgtctaatagtttatattaacacattacatttccttgcaacatgttttaaccgcaaactatatcaatccatttatgtttcttaagtcagttttatacatatttgtaagatgttaacacttatgacctcagaacctgtttttaaactgatactgttttctctaatataccatactttataataaacatttgtaatttatatgtaggcttaatttataaattttaatactattaaatactacctaaggtttgtcacaaggagatctcattataacagtttttattaactattcattttgttcttttctataataatgcaagtatacatttatcaatttataactttgcattgtctttacagattaattagaaaaatttctgtcacatatgccttgagagtaaatgtgtaattaacacaaatatttttattttgcaggttttacttgccacatggcttgagtatagataaagatgggaattattgggtcacagacgtggctctccatcaggtagtcttccttttggtaatattcaaattagaagctaacagagttatgcttttgaagagctctggagttgtatgggttttttgtttgtttgttttttcttctgtcacccagtaagttataacaagaaaatagagcagccatgtcttagttcagcatgttataacaaagtactatagtctgggtggcttatacacaacagaaatttgtttctcacaggtctggagtctggaattcaagaacagggtgccagcatggttgagttctagtgagggccctcttctgggttataggctgctaatttctcatagtatccttgcatggccagagagataagagtgacagtaatctctgttatctcttcttatggcactaatcccattcatgagaactctacccttttgtcctgattacctcccaaaggccctgcttcatattaccatcatattgggggttaggatttcaacatgtgaatttggatttgaggcacaaacattcagtccataacaatccacatctgaaatatttctcttagaactcaatgctagggaaagctagtatgtaaatgatgaagtcacatttgtcccttggaccagatatgaagcttcactcaaataactacatgggccctcccaaccattttcttaactgtctgtatttgcctttatttcctctgttcctaacttgttgttgttgttgttgttgttgttgctgttgttgttgttgtttgagacagggtctcactctgtccctcaggctggaatgcagtggcacgatcttggctcactacagcctccacctcccaggctgaggtgatcctcccaccttagcctcccaagtagctgggaccacagtcacacaccagcatacttggctaatttttttaaattttttgtagagatgggattttgccaggttgcccaggctggtcttgaattcctggactcatgcaatccacctacctcagccttgcaaagtgctgtaattaacaggtgtggccatcgtgtctgggcctaagtcttatttctatttttttacttatttttttatgtttttttcttaaactaccttaatcttctataaattgaggctaggcctctagtaaatgtatatttatatataaaaagtgaaatttgtgttatttttaaaagaagttatatcaagcgtaatatgcttttcatgaataggtggcaaataacttggaaaacatcatctcagtaaacatttattgctcatgtattatctggagtgcattgtagtattatctaaggaaagacaaaaaggaaacatcagggtggacagaactgggtatccatgtactagtctccattcactactaattaaccgcgtgaccttgagcaaatcatttaatcttcataggctttattatcaaatgaaggaaccagaccagatgatttctaggatcccgttcagttctaacaagtattaataccttcttttaaataagtctctgggagcttctactccaattgcttgtgaaagtggtcttagtcatgtgggtgtaagtcactaataaccatgaaaagtaggtaaggcttttgttcctttttaaaaaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaaggtacccaataagactcttaatctccagttgtaattcttagccagtatcactgggaactaaatattggccaacactcacattctttaagctgtaattgtcccctacagggtcattgtaacctgggtcattgtatgcatccagttagcttgtctctcacacacacacacacacacatatacatacacacacacacacacacacacacacacacgtcttgtaaggaaaataatgtatccaccaaacaactatccaaatagggagaaaatctgtaatgtatttgtggataaaagacattataaaataatcttataaactgctttaccttatctttcccctggctccaggcatttaatggtttactatcatgaatttagaaacatactagagagtcaaactttgggtgatttttaacattgtgtatctaaggcttttttttgttctgcagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggtatttcatcttaatatgtttgttgtcttctgtcctactgtactctatccttaaaaattgtgttatcttaatgtgctctttttataaattttctttgctatatatttcacatcttaaaagtatcttacaactgttagtgtgttctaactcagttttgattaaggtaccactattcattgtacagaaacaatgaagaactcaaaggatttaacacctgtttgtaaggggttaaaaatgttcccaaacattgattttcattttatcttaattatgatcatctgctccagtattaaataattaatatttgtcttcacacatcgacaaatggtatatgtctgataaaatcagtattcaaaatactcatttcacatttttaaaaacagtagtgaccaatttttttaaagataaaatatgtaaaaataagtgtggcttatgcctaaataccaggataaataatcaataaaatcttgaacttttttctcattttcaaaatagattttcttgactctaagaaaatctgaaaaataattcagactaataaaatacatataacttatattacaaaacaacttaccatattttctttaaataatgaaaatatatttaatttctgaaatttacatacaattacaatttttttaaattgtaattgacatagtaattgtatatatttgtagagtacaatgtgatattttgatgtatgtttacaatgtggaatgactaagtaaggctaattagcaaacccatcacctcacatacttatgttttatggtgaaaacatttaaaatatgctcttttcacaatgaagtgaaatgagatcaataacgaggaatttttgaaaaattcacaattaaagggcacaacatattttaataaaaacatctatacctgtattaaagcagcattgactatttataggtattactgtaatatttatgtttcttataagttgcatatggctactatctggaccaagcagccccccaaattatttaggacataaaatcaagggactcaggtgattgatagagagcaaatttggcttcctcaaggaataaagaaaaagtaataagaggttctcacaactatcattctttaggttggtttgccgcacatttaaagaaaaatttgtcaggaccctttacttaattaagagggtgatcaagttcataataaacaaaaataaattaaatataagaagaaaattatcagttgagaaggaatatggttaagaacagaatctaagcaaaagataattttctctataattttgcacaatagtaattgatgtttatagtgttttttatagtacatcctagaaaactataatccttcaagaatgatgaaaatatcttcaatggtggcttagcattgtgtataatttattatgttttaattctttgaaaatgtagtggttcaatcatctgaattgtttatttaacgtaaacatcaccattttcattgttctgaataaacagtattgtgttaagaaatataattttactacaaaaagtattcatggtgtgaaaattaaaaagatggtcttttttaattaaggaaaatatgtctttgataatctgaaatatacatctcacattttcaaattctagttgtttaaaatcagattgttctatatagactgtaacttcacttattttctttgattttctcttggattctccatgtagctatggcaaatattacttattttttaaaagatctgagactccaaaattattggcctaaataacctgactttccccaattcctatttaggatgcctgtaatagctatatatgtgtattatatctatatatcaatatctatgtatttctgatttctactggttttccaagtggaccacacatttcagttcccgattttcctgtcacaaggaggttagtcctctaaccagtttgccactgatctggttactcaggaggagacactaagtattttatattctacttttgttgccaattgtagggaccaggttgaccctaaatttattctttgcataatatacatggatatattagaagtccattcttacccatattttaaagaaaggttaactggatttgctgttgcaggcttgctctttgcagtgaatgggaagcctcattttggggaccaagaacctgtacaaggatttgtgatgaacttttccaatggggaaattatagacatcttcaagccagtgcgcaaggtatttacacacattgtctaggtttcaattttcatgagaagaagactaaaatataaatcttggcattcaatctgtacttgaatagctttagaaaaacttttaagaagatgtgataactttcttagcaaggttgatgggagtgttctattttattttttattttatattttatttagaataaatgtctttgtctattcctagatcaatttcttcagatgcaaattagcacgtgtgcagttctaaggttcttagtagaactgcacctgcatatgatggcaggtttttaaattcactatagttagaatacaaaaaataaatcagtcgctttctggtttcatccaagtagagaaaacatcacaacatgttaagtgtactcttaaagttctcttagacccaacagacatcttgtttgctttctttattgctatgactgtgctaagcaacaagacttgaaaatagcacttcctggaatttattcaagttctaaagatttggttaagaaactaaaagctacttttggcttcaaaagtgttttcccactgtttattctaacgtgctttttataaacacagcaactgtgttcagtgtgcccatggcccttctgtcttctcagtgtacttactctgcagtatgattgccagagtgatcagaatgttctctacactgtatgaatgtgcttggagtatatgaaatttagaaaattcagcctgctaaaatgctacaaataagtgttattcttcaaaacatgtaaagattcattggttttaattggatcaaaatacaactatcatcagctactgaaccaagtttatatcttgacacttataatgttatgttatttttaagataccagatttgctaatttaaaaaactttaaaatgcctcaatattatatttttaattaaattttaatttttaatttttgtggttacacagtacatgtttatatttatggggtacatgagatattttagcacaggtatgcaatgtgctaaaataataataatcacatcatagaaaattgggtatccatcccctcaagcatttatcctttgtgttacaacaatccaatttactctttcagttatattaaaatgtacaattaaattattattcagtatagtcacactgttgtgctatcaaatactaggtcttattcattctgatttttttaaatctctattttcttgttataacttactgggtgacagaagaaaaaacaaacaaacaaaaaacccttacaactccagagctcttcaaaagcataactctgttagcttctaatttgaatattaccaaaaggaagactacctgatggagagccacgtctgtgacccaataattcccatctttatctatactcaagccatgtggcaagtaaaacctgcaaaataaaaatatttgttgtttattttgatttttttaaatcagaatgaataaccatcatcctgattaaccaccgccacctaaccccccgccacacacacatacacacacacacaaacacacactcacacacacacacacacacacactctctctctctgtcccatacccttcccaggctctggtaaccatccttctgtaccatacatctatgagttcaattgttttgatttttagatcccacaaataattgagaacatgtcatgtttgtctttctgtgcctggcttatttcatctataatgatctccagttccatccatgttattgcaaatgacagagtcttattctttttgtggctgaataatactccattgtgtatatgtaccacattttctttatccatttatctgttgatggactcttaggttgcttccaaatcttggctattgtgaacagtgctgcaacaaacgtgggagtttatttagctctttgatatactaatttcctttctttttggcatataaccagcaatgggatttctggcttgtatgatagctctacttttagttttttaaggaacctccaaactgttctatatagttttactaatttacattcccaccaacagtatacaagggttcccttttctccacatcctcatcagcatttgttatcacctgacttttggatgaaagtcattttaactggtgttagatgatatcttattgtagtttcgatttgcatttctctgatgatcaatgatgttgagcacttttccatatgtctgtttgccatttgtatgtcttcttttgaaaaatgtctattcaaatcttttgcccattttttaaattggattattagattttttactatagagttgtttgagctccttatatattgtggttgttaatcccttgttagatgggtagtttgcaattttttttcctcattctgtgggttgtctcttcacgtggttgattgtttcctttgctgtgcagacactttttaacttgatgcgatcccatttgttgatttttgcattggttgcctgtgcttgtggggtattactcaaaacaattttgcccagacagatgtcctgaagtgtttccccaatgttttcttgtggtaacttcacagtttgaggtcttagatttaagcctttaatccattttgacttgatttttgtgtaaagtgagagatagggatcaagtatcattcgtctgcatgtggatatccagttttcccaccaccatttattgaaaagactgttctttccccagtgtatgttcttggaaactttgtgaaaaatgagttcactgggccaggcgcggtggctcacgcctgtaatcccagcactttggcaggctgagacgggcagatcatgaggtcaggagatcgagaccatcctggctaacacggtgaaaccctgtctctattaaaaatacaaaaaaaattagccaggcatagtggtgggcgcctgtagtcccagctactctggaggctgaggcaggagaatggcgtgaacccgggaggcagagcttgcagtgagcgaagatcgtgccactgcactccagcctgggggacagagcaagactctgcctcaaaaaaaaaaaaaaaaatgagttcactgtaggtgtgtggatttttgtctgggttctctatgcgattccattggtctatgtgtctgtttttatggcagtaccatgctgttttggttacatagctctgtagtataatttgaagtcaggtaatatgactcctccagttttgttctttttgctcaggttagttttgactattctgggtcttttgtgatttcatataaattttagaatttttttcattactgtgaagaatattgatatttggatagtgattgcattgaatctgcagattgctttgggtatatggatattttaacaatactgattcttccaatccatgaacatggagtatcttcccttcttgtgtgtgtcctcttcagtttttttcatcagcattttatagttttcattgtagagatctttcacttctttggttaattcctaggtacttaaaaatatttttggctattgtaaataggattacattttctatttctttttcagattgttcacattggcatataaaaatgctactgatattttatgttgattttgtatcctgcaactttactgaatttatcacttctaatagtttttttggtagagtctttaggattttccaaatatcagattatataatctgcaaacaaggataatttgatttcttcctttccaatttgatgtcctttatttctttttcttgtctgattgctctagctaagacttccagtactatgttgagtaacggtggtaaaagtaaaatgcttcaatgttttattaatagaaattagtctaatactgacagctagtctggtgtttatcaaattttattccagagatatgcattaaatacttactctgtatcaggcattatgctaggtactaagggtataaaggtgaataagggtaaaagggtgaaagagacacagccttttgttcactggagctttaagccatagtaacaggatctgaatataaccaaaatgaatctaaactaaagattccagtatacattcctttctttaggtttctatttatataaacaaataagatttttctagaaatatttcaccagaaaagcaataggcaatgaaatctcaaagcatagcaaccctgcagaaagaaattcattacactgataataaatattttattccatagtgtttcagatccttattgattatccagtcttcattgttgtgcccctttgaactaacttcctcatatctgttggtaaaggaagtgagatgcttaactttcagttctttgctttgtattagtggagtgtttgccttgctcattcttttaatgataatgtactgtgtcaaccaggatattaacttttaatttaaatatgcatctagaaataaaaactaagtgctaagcaagaggctaaatgagccttaacgtcataaaaatctgaagagttctcaattaaaatttccaaagcattgtgctttcatcagatgttaggcaaagaatgagtcacaatatgtgggtcaattcagcaaacttgaaaagagtctcactccaagatgaagtttgcttttcctttcagtaaacaagacttgatattacaccaaaacatataaatatattctgtgttgacacagtaaactgaaatcagtttataaatctctcagaattttcattaaatagattattatcacaaagattaattttgggtgaaggaaataatatggtctgttgactcctgtgtaaaaagagattcctcttcacgatgaaggtcaagttttacataagggggttgtgcttctgtttgtgcatacccactccttatctcctcttacatttcagttctccatcttctactattacattctttagagatgtttccatctgaatgtagggactctgtttttatgtctgtgcagggaagcttagacagtaggacaataaagaaaatggttctatcaaatgctatcaaaaagctgtgagagaaaaatacacattgtcattccccaagtcattccccctgtaatcaaaggacagacttgtggtccctcattatctgcttttatacacacccttcggacaggcatattttttgtcgtcttctgtgtggcagctcatatggaaaagaaagagaatgatccccatccttccataccaaaagaaaaaaaagtgagcccagatttatgtcatttttccaaccttcacagtgatgattaaaatgacaatacttgagctgaaaagttcacttaagttaaattacttgttcaagctacatggagtagcatatgtggatctcaaacctaggtctttctgactttgaaatgtgctgcttaaccttttcattcctgaagtacacattggtatgccaagggctatattaagccacaacataaacattgtgcaacttagaagaactgttttacttaatattaagtacatttaaacttactatgttgaagcaaacattgttatgctatggagtagaacacgaatttccttacgagtttttaaaataaaatacaagattttgaaggcagtttgctccaggctttgtcaccagatgcctggtgaagatattatcatgcttctgtcatgttgattttattttgctgggggtacctcaaaagaagagtctgcaaaggctagattagaagatctttatgtctgtgtagctctaaaaatactaaagcttggtcctaaaatttaaccacataattttgtttcaaatgacacaaagcactagaacagttcattgaaaagattacaactgagttcttctgactgcaagaagacataatgagtcttcataatgagcaagaagacagagtcccatctaccacgcctccccctgagttcctatagtggccccaaagtactgtatttctagcagaacccttggcttcatggatcagtgggaccaaggttctgctataaatacagattagtggctctctcacttgagagccactaataaaggtttattattgttgttgccttgaatttatgacatattgtgatttatttaaagcaaagttcttagccagtgaatagtttacacattccctcctcacctttattcccccatcattatatttttcctatcagaaaatatgaagtattctacaaccatatgttttacaaagaaatttctaagaacatattacggtatagaacaggagtggcctatcatttggtagtcttttgccatccattaactgaacctcccaaaaaagatgaacatttaatgacaagcccgcaggatttcagcaaggcagcattttgatttctggctctgtgttttcctctacatatttgtcacagcttatttgaaagtatgaaaaaaaatgagcctccttggcatggctatctcatttttcttttcagtgtgataaacttgatgatttctaaagtacgatagtatctccagagcatgtattcttctgccccgcctaaactgagctaggaacagtagtttgtctcattagtaccctttgaaatcagcacatcagggttaggcagatgctggctgataagcccatggtctggatactcactagtcatatttttgataactgtgtatccaggcaggccttctggccttaaaggtgaaagatgttatctatatcctgccaactgccagacccagggcacctttggaggcttccagagacaatggaaatgtcagcagcacaataatttaaggcttctcttccaagaactagtttggtgatccccaaaagaaagtcacaaaaggatctcccctgtctcttgtgtcctcataatggagatgacaatgatttgaaatagagaaagatatattaaaatacagagcatctgaagtagggacaaaagcccaggaagtacttggaggtaacactcaatttctttcctttgctgactgaaaacatcacaaacataagacttcaagagtataaaaccccacattgctacgtatctcttagtgtacatttcaaaaaattaaatgtcccaaatctctgaaatgatttttcttatcaataatatacaaatagtttttaaggtagcacatgatagcttgatgggaataataaaaattaatacctagacttttttacttgtacaaatttaaaaaagcaaatttgatagttattaaaaggtagaagaaacatgtaggcaaaaaccaatataaataactagacagataatgcaacaccaagtaaacagtattgtaaaaaataatatacctgtaaattttcacacttaaaagaattgaaagtcagtagtgggggttccttagcatttcccaatgtttagaattatgcctggaagagtcagtacccaatgaatgaatgaatgaatgactcccttcagcctagggttgcttcaataggaaatattttgctttggtttgagtaatatgttttgttgttttgttgtgggctttgctttgtttttctgtcttttcatgaaggattcaagtaaaggctcaccactctaatgtgtagcttcttattttggcagcactttgatatgcctcatgatattgttgcatctgaagatgggactgtgtacattggagatgctcataccaacaccgtgtggaagttcaccttgactgagagtatggttttcacagtattattgttcacattttccctcagtttgattgcttaaaagcatatgaaacaaaaacatttgcatttccttatctttttactgatgagagtaggaatcaaagtataaagcagttgttaaaagacctatttggtgtccattaagtggaaagaaacgatttttttgctggcacttatccccttgtttccacaggaaattcttgatgcctgaagtactgtctgttacattaaaagtcaacattaattccagcttagttccagaaggagagagggggctttggcaaagcagaggggctgacttctttccataaagcctcattccccatatggccctttagctctcagtagctgctgagcatctagagataccagcatccgtttgagacatattatcccaaatatgaatatttggaaatattcaaagaagaagcactttgaattttctgcttggacttcagctttcccaaataactgaattgctatattttcatgtaactcaaaatgttgtctaagtatagatttgctccatcaggatcctgccaactagttttggagttttctaattggaatttggacatcattttcatctctaaaaagcagactaacttttaacccctaatatgctaaaacaaataaattttttaaattgaagtgtaccaaatgcttgataggacacaaacaacttcaatgtccagaaatacttttaaaacatggcagggcccaaatagcagaaggtgagagtaaggaaaataattggggatgataaatttgaggtatcaggagcttcaacaggtagttttagataaaggacaaaaaaacaatatgtaaacttgatgaagaaaaatattaattataaaaggaaaaacataaattataaaaaggcaagaaaacaaattacagcaatggaaagtaaaatcaggagtccaaacacataatcagatacgatatagggcttggatctcaattaatttggtaacttttgtagtcagaactatcctttggataacgtttgcagttgtgtaaaaagaaccaagttagggttgagtgagcagagatgcccatggactatgccactccagcagtagcttcacatttcccttgcaaatgtggctctctcaccacccgaattgtcaaagaggatccagaaggcagggtcagacaataaggcaaagatagatggataacccccaactgcatgactaaactgtggattttcagaacaaaaacaaatgcaaaaatactttgaaagatggagaagacttcagaagaaaatctaaccaatatcttaattttatggataggaacatgattcctgaactcattaatatttcaatctgaggccctgtataccgtgatccccagcctttttggcattaagggaccagtttcatggaagacaatttttccacagaccatgggcagagggaatggtttcaggataaaactattccacaaggagcacgcaacctagatcccttgcatgcgcagttcacaaaagggttcaggctcctatgagaatctaatgacaccactgatctgacaggaggcagagctcaggtggttacactcacctgccactcacctcctgctgtgcgttccagttcctaacaggccatggcccgggatttggggacccctgctttataccaccctagtggtttgaaactcagaagatgcatgtcagatttacctacggggggggactgttacaatacacatggccagtccccactcaagatctacagaaagaagaggaataatattatgtgtattttagaaagtcctcccaagtgactttggtacatctcctgatggaaaagcacagcgatatggcattcagcttcaaaatagagaagccctctgcatagcgcagagtgcagtaaatctggaaaacagtatatctggaacagtaagactgccactgaacactaaatcggtgtctcatttatttgcatccttgtagttaactggtcaaatccattaacatcaactagaagactgctaacccaacatgtcagaactagtaatcagtctaagatattgtccacatgaaggcagatctgcttggtctttcagaaataatacaatattatgaactctacaagaaataactcattgtaaatatgaagtccttagaaatattttagctttccctaggagattttatccaggattcatggaccacctaattagtggtttgtattgaactctttcctaatataataatgcatttgatgaattaaggaaatattttctactgagtaaaattaatatcaaagttaaattttcaaatgttctttttggagattctgacttttctctctccttgttgtgttgttacagaattggaacatcgatcagttaaaaaggctggcattgaggtccaggaaatcaaaggttggtcagattcctcttattactataaaaccaaagtctggctgtgttgaattcttttatggcccttgattgcaacttaaaaaattaccaggctaaaaatataatctggtaaattatcagtgacttctgctatgtactgagcctttaaacctgtatgttgccacttccctttttttttgataaatggagcagtcataatgagctcaaattactgatttcaagtgatagaaagtgattgaggatacaaaaactttgtaactagtgagccagagatattccgagaagaaaaaaagtcagccactttggggagtacattaaccccaggcaagtaaaaaaatatgatttggcatattggaaaaaccttttcttaataggccctaatataaaggagtgaaaaatatctttggtgggtcagtgctataatggtatggaaagattagctgtttctttagcttctatcgtagtaccattcagcttccacgatttactgagggccttttgtgtgtaaagcactatagcaggtctaagggaaatgagactgcacctgaccttatagccttataaggagagagggggaaatttacatacataaacacatatacaaataagtatatcactggtatataatatcaggactaaggaaatgggatttagctattggtaagcaaccactgggttcatatggagtccctgtcaacttattttgtctctttcctaggatcagtttatgtttgtacattctagcatctgcagggttttgacatgtcatttccagttaaggactcgctatgagttgctcatgttacctaatatttaagtagcaaggggattccattattagttgctttacaaatgattcacctagacattcagacacaaacctaggcttacttgttttcttttctcatcaaagcagctggaaaagaaatgaaaagcagcaacagcaagggggagtttaaggattttatgcagacagataagaaaatatagccagctcaaggggtaataaaatattataaaataaatagcaattgtttggcatttgtagagatccaagtgacactactaagtggcattcatatcacactcatatactaaagaaggttcctgtccccctagttttatgtctttgctatatatataattattggtaagttctgtttgccctggaataaagacgttgggaaagatcatgttgttaatagtagctatcacttacagagcagaaacaatgggctatacagaaattattacatttaatccttatgccaaccatgtaataactgctattatccccattttacatatgaggaaattgaggatcagaattcctactaagatagtacattttagagtcaagctttaaaccaaaatctatttggtaccaaagcctgcactcttaaccactattgctatactgctgaggagagactgataccaccaattcattcactataaattctcccaagaactgcaggttgggaatggttatagtttactctgaaacctctagaattttaaaatagtctcaactcatttctgtttaaatagatctcaccaaaaaattctaggtggtactggttggcctggtgaaaacagcttagccatactgacctcatcttagccggtcaatgatggatgaataatgctgtcatataggccatttcctctctcctgtgtgcacaccactgagtccaattggtcagaaaccttccgactttgtggaagtggtttgtggtcaaacccagcagttcaaacagtaaattttattgaaatgtcttgccttgacagtccagttttaatagttaacccaaactcaaatgaagttgtctcttcttccttgaacccatatggctctcattaaacctttaagattatgttcttattacaaagggaatgtaaatcatgctggatctctagatcttatgttttatcaatatcttgaaacttaattcaaaccaccctttataaaagagaagggaaaacacaatttcagacttaatagccttgtagttacatgttaatttttaatccccaaatttgagttgcctttgataacacttatccctactatgaatggtcatataactaattattattaaaaaggtttcagaaccagtgttctaaggaagttgtaaggataagataatttcagatgataaaaaaaaactgatgaaaaggattaaactttctaataaagttactagagataaaacaggtatagcaatatctcaccaaagcatagctctcacccccaagcccacccccccaaataaaagatgataatggccaatcactttcaataaaacttttaaaaaataaaaaaacctctttagtgcagttagctttttaggccttatggtaagcaacacattgtaaggaaacacattaaaaaaaaaaagaatgatctcattggtgatatatgcacttttcatgtcccgtaaccagttacttcctagtatgccatttgccttcagccttcagttctgtctgtgatgaactgggatacaattgctgtattaagaatgtccttcccttcctgtccaagttattccaattccaagtggtctctagacttctcttctgttagggggagacagatttgtacatacatgtatatgtgcactcacacaggaatgtagctaacctccatttctaaacgcattgctttaaagaagaagaaaaactgtcatacatcagcttttagaaaatttgtttatttccaaatatctatagagatgctacaagggcttgcactcttataagattttaaggcatgttcattctacccagaatacacctggcattttatatgacaaaagaatggtcattctaggtgcctcctgttttccagaaacctagtgttctggctaatcttagagcttcttcactcttcattcatcatagatgctccaaattactgggatttttaataaaagaatttaggataaagagtgaaagtggcagaatttggattattcttcaggctttcagtggaattcttagactcttaagttataactattgttttaggcattttaccccacatacaaatgctcttgtgaagagtagcaatattgtttattttctttagaatggaacattttaaatttttagcctcctttttaaaaatgtagagcatcttttaaatcttaaatatatttcagccagttccaaaagttggactgtttaagtatttttagtagataacactcaaaatatcagaagtgatgtgaaaatcaagaatttctaaagtgctgtgtatgtattatatcttagtaagttcattgcctcattctcattactttctgtgaatgctaaactgattcttttagtctttcacctgtatcatccacagttccttccatttaatgttgcccaattctggttctgccttatccatgaaactagatatgacctagtatacccattgtatattaggtgcatataaacttactaaatgacaggcagtaactactctggtaatacccaccttcaaacaagaacaaatccttcttccaaaagaaacaagttcttaaatgccaacctacatctttggcctgtgttttttactcccatgatctatttattgcaattttcttatttaaatatagaataagcttaaatatagagcaattttgtatatctttcctatagcaaccaaaaaaaaaaaaaagacaaatgagtggtcagaaagaatagaaatcacatctgtattcccctcagaaactagacatagaaaagttatatttgaaccatttctaggtctatgaaccactcctttccttccctccctttcaagtttcaagagtcacttgagtggacaaaagaaaacaaaggatggtctccctttagccatagtacagggaaggaaaggaggactatgaggtcatctacaaaatggtgatgataataatagtgcctactcatgagcttggtgtgatgattaaaggaaacgatgcctgacaatggtgtaagtactcaatagatatcactgagactgtcaaagaggctggctcagaacgttgaagcaaagagttggaacctaccatctgtttgtattataaattatgttgacagcatcttaaatgatttgggaaacatttatttggaggagtatccagtaaactactaagctgaatctatacctactaaacattaaccaaagattttcctgattgtgttatccctaccattttgtcaaaatcttcttgaggctttacaatgcattctgtatcgtagggcagaagggcattccaagaagtcgaaatttcagaaatgtatgacctgtgagtcttcctgcaaatgtggttgtaacttttagtctgggcaaattcttactagtctttgtacactagagtttctatacaaatacacatatgtgcttcttgtagggcaaggatgtctcaaggctcaacctcattttcatatcattagttattaagatcactgcagcagcttatatagtttcattgcatcaatttcccaaacagtactttaggcttgatacctacccagtacctgccaatgttacagaatagttttagttattataatagttgttcttttcatcagtaacaaaaggatatacagttcatctgtctgtactcacattttgctgaaaacaatataaaagagcctgaaaagcacatagttccttttttcttttgtaatcctagcattaatgtgtgcagctgtccatgtgaaataccaaaaattaattgaacatgaaaaatatttttaaactaaagatacaaggaaacaaacacttattatatacattttttatgacagacatttacacccaacagttttatgaaggaggtcctattattacagttttatagatgaagttactgtggcccagataatttaagtaacttgcccaaagttatacggctagtatataggagaattgggatttgtacccaggtttgtttgattccagtatgcacaccagttctttcccctacacagtactgtcttattaattttacctttggaaaaatacaaaaggatatatattctgtggaattatagctaaagagcatattaaaagtagaacaaaagaaaactaatttgaaggtgaaaaaccattcagtggaaataactaatcacaatgcctgctgccagtttggtagattcaggtattaaaacatgaaacccctgtacactggagtcaacaagttctttgtgaacagttattgatttgactgggtaggggtgggtaagggggttttgaaatctttgagtcagttgaatattgtgaactcttctttccctgaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggaggcaagtaaaatgagccccgtgaacttggaacctgcctttgaaagagtgtttggcctaattatcctcaggagtttgattgggatttttttcactgtatttgtttttttgtttttaatgctctctaccatttttgacattattgtctatgttccaaatattgcccctagttaatatcacagtacaaaatagtatctggagactctgaaatttggatagttagattaaaatataacctttaatactatcttttagcaattggcttaagtccaattaatgagtccatacgaaattgtaggtagtagagtcagtataaattagctgaaggatcagaggaggagatacctgctgttaggaagaggcccagtcctcaaagtacctgggtcagtttttcaggttgtgtttttctcccattaggctcctagctacatgaccatgggcaagttacttaatctctccagaccagttttctcataaaaaagtggggataaaatagttaccttacaaggttgtacaaagatgaaataatgtacataagcatttatcaggatacctggaacctaggaagtactcaataccaccaatggttatgatgaataatcattggtaataaagtaacaaaaggcataagaagttataaaaaacacttgtcttaaaccttagttttcaagaaaaattaattctataacaaaccatttgatagtttttgaatagtcataatttagctcatcagccttccataactgaacaaggcagagtccaataccagagttagtattttatgaaatcattatcacaatataggatccaagagctgagtttattttaggacatctaaataaataaacaacccaattcatgtttcttaccgctcagtagcagtcccttggctgggtccccaggtcctagagcaagtctatagctgtgtgtgggaagaaatccatggatcagggagagggggagcatttgatcaagaaacagcatctgatcctatttcaggtcaaggcagccatggcagggattcagtgcccttggcaaagccctgacacagaaaaaggcatggaaacagaaaacagaaaattcagtttaatatgttgtaaaagggaatttttattagactttattttgcttttcatgtgccatcaataaatctctataaaaatatagttaactcttcccaaaaaggatttctattaagtccatgttacagatctggaactgtcataagtaggggcaaagagaaataaacatagtcattgtcttcatggtgttatatagatgcttcaaaagagcaagaatccatatcttgagtactgatatgtccccagcacaaataatagtttctgatactagtggtttaataaattgttgttgaaagaatgaatgaataaatcaaccgagctcacagaatagataacatatgaaagagacatgaaacaaaaaagttatagtagagggtggtaagtgcagtgataaatacacagagtagtaggaacagtggggcctaggggaaggtggcaggaattgtggtaaccaacccaatctggcagaagcagtggctagggaataaggaagatttggtctctcctgtttgttgttaagcacatgtgacacagcactgttacatgatgctgactttacaggaatgtgttaggaaggtagagacccaggtagaaccctagaaaattgccattatttgaccgtgttttacttagaaaaattgcagtttcatatgtagtagtagtagatcagcttctcactttttttctgaatttgttcttgatagatcttatccagtctaaggttattaaaaaccctaatggaccttccatttattcatcattccttattatgtattgactccatatcagacactgtgctaggcacatggggatacaaaactaaggaatgtccttgcagaacttacaatctaatttgttggctttctaacagtcttaccagattcttcttcccttcttgcctatttctttccacatcactgtcttctccctttcctctcatctgcgctatctttttccatgatgctgacttcagtcctggttaaagacctaacaggacaaccccaggcctgactttcctgaccatagcccttgagggagtgatgaagcctgggaaatagtacagggagagacacagcaagggaaaaaatgaaacccattgggagttctgtctccccataaggaaagagagtctgtcctttatggagataggcagtcctgttgggaacatttaggtcacctactatgcttggaaaatactcagggtgtcatgtgctttcccttcacttatgtcttacataaagaagaaacgatatacatggatccaaagctttctcaagcaagatatgtactgtcagtagaaagagtaaagctgaaggcaaatatccctaaattgtcataaccaaagatggaaaaattttataaattattaataacatttcctgattaaaaaaatagctatgatttattgagcatttactgtatatctataggtagtgttctaaatgtgtcacatgcagtgtctgatctcagccttacagacagggattctccttgacctttcttttatcagaggagaaaactgaagctcagagaagtaatttatcaagactgcacagccagtaagagacacgggcaggagtcaaacccagcttgggccctttatgtatgtctcagaaatataccgcctttcttaaaaattagaattgcatacagacaagagccaggccttgctttatcatttaccagttcctattttaagttggaagttgagtgcatgggttgagaaagatgactgggacttattttgaaatgtgccatctttttttagcagattctgaacacaaactcgagacgagttcaggaagagtactgggaagatttagaggtatgcctatgaccttttagaacccttcatgtttggttcaaagtcaacaagcacatgtcttttaaaaagcaaggagatatttcatattttgtctctgaagataaagcaccttgtatgcagcttagcatctcccagagtaaatacagaatgcacaccataaactaaactgaagtgcatgggtctggcagcagatttcccagttttatttttcccattctgcattatctaattctcttcccctgccttttacctggcttcatttgtcttcagcaaattttctgtcactcctgttggcatgtcaatgtttgtcatagtaaagatgaccttttcttaaagtcattgaaatgaggagctgctccagggaggctagttctggatagagagctagagaaaagcaggaggtgaaagtgaatatgaaatattcctgcagaaatacataatacttgggagcttttgtttttcttctttaatagtagcatctatatggctctgtaggatacgtctctgtctgtttttctattttatttttaaataaaataatctcccctttcccatccccaccttctgactttatcatttaagaatttacaaggtaacagaatcattgctgcaaactttacccaattctgttattgtttgctttttttcaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcaataaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcattagctgtcagagtgtattttccagtttttgcgtatttgcagattttacatacaacttttataataattacacaaacccacaaatattagtgaaacttactcgatgtcttcaactaaaagaaatgtgtgtattgtacaaaatttagaagatactttagccaatataaattaaaaaccagcctgagtttacataaatttgtaaagtcaggctcttctaaaatccaaagagggtttttgcctatatatcaatcagaggataaatactttaataaaaggtaatcacagctaagtggaaacctgtgtctcaaattacatatgcaaatgatccatcagtagggatcactaataatagttttccttttaaaaaataatttcaggccaggtacagtggctcaagcctatacttccaggactttgggaggccaagcagaaggattgtgggaggccaagcagaaggattgtttgagcccagaaattcaaggctgcagtgagctatgatcaatccactgtactccaacctaggctacagagtgagatcctttctctaaaataaaatacaatttccatgtatccataggaatatattcatcttttacagtgattgcagattagttttaaaacgtctttttcgtaattcatcaatgcaagttagtaagaaccagataattttccattttaaaatgataggaatctaaaactctttttcaaaaatgccaacctgtttttccggcatcatagtagttggaataatacagatataattgactaatcataaagtacatgagagtacagaagggaaatttggaaacggtaagtctgctagggcattacaatcctgtcctagcactccacctttattctgccaacctgggttaattaaagatggtagcctggaaagtaatgaatgacattgacttcaggcaatctttccactgattattcttggctgaacttcatttatcgagtcagagaatgcactgcctgagaaatgtcccagaggagtgaatcctaggcctggccacagtagaatcgcctggagaatttaagaaaaaaattgttgggcactcattctttccagtgatctttatttagttggcttacaatggaatacaggtatggttcatgtttttaaatttgtccaggtgtttctattgtgcagtcacagttgaaaaccattgtcttcgagaatagctattctatcttgccagttacaataagtggatagctatattttcacataaattatagtttacagatgtttggagggggaagacaggatctgaggtgttttgatatgactgttagcaccaaaatctgaatgccttaattgttgaatgtgttaaattggataattaaaatgggcataactgacttattaaaaaagcaaagggaaacagctgtgctttcattttttcttctattaaagtaccttgaaaatttgatttgggagagttaaaagaatagcttgtcattcactgaattggccctgaattatcatttgcataaaatcttttgttctaagctttcctctttagtttattaaatcagcatattatttttcaaaattaccgtgcatcttttaactctcatccagatgttatataaaatcaaatatttaggaaactgaatgacaattaaatccatagaatctgtattagtgcttgtttcccagactgtcacctacatgtagctcaaagttgatgtagcctgtagcaatacgtctcaaactttaatgtgggtaagaatcaactgtgagtacttattttagaagtactaatttggtccctttcccatagtttctgattcactgcactgggtgggtcctagaaatctacatttttaagaagcattcctggtgatttgaattcaggtgttccatggttcatctccaagaaacatagtgctacagagagtagctgaactttaaaacattcttaggcacaggaagttaatattctcaaagatgtggtctctgtagagtgatggt

SEQ ID NO: 16424 - DNA, 112465 bp, Human
tgtgaacatggggctatatagagatttgagtaaatcacattccctttgtaaatgctctatgttcccatgaaacacagccacgatattatctcccttcttggccccctccatctcccttccccttgagacattcttctactttctatttgttggcacctggccaaaccctagccaaaagattcaatttctgtgtaggaaacagaagctattggtacccaggttctgtttcaccagaaaggctcagtctccacacccgctgatttcatgcccacgttgatcagttttcatctcgttatgccaggcatgtccaaacctaacagaggcttcagttagctgggatacccctgagattgctatgcaaagattgttctcctgagagcaaatgccagatcctgccagagtcttactagctaggttaacacaaactttttatgaaataatagtcaccctgaacagctactttcccctaaattaaaaaggctacaaaatttttgtcttaccccaaatttaatgtataaaaattacctgaactctagagatgaaaaatgtaaacatagcaccctctatactaggaatcttaaccatttattgatgtcacacacatattctctcccatatttgtagatttgttaaagagaattcacaggcctccttatatttgaatacaactgtctcaagaactcttaaaaatgtacttcttgaagtattcttggacctggcatgaaacaataaagctgtgaatgaacacataattcatttacctacagctacttcttagtctattttgggaagtcctactctgccactgaagtggtgctttctcccactcaggaagaggaactgtcagcactctcattcagaacttgccttctacttagcacggatggcggaaagtacaaaaacgctgggcatgagatgctgttaaaaatccttctgtgctcacaggggaggcattccaaagccagccctcatggatagaagtaaaactccatcctcaagtcaagctggacttctgaatgtcgagttaaaatgaaattatcatggtaacacattacctgggcttccaatcagggagcgattgaaggctccttggtggctaaggtatggctcagagccaagtgtggtgttccagggtaccaagtcctctgctcaatagctttcattctgagtggcaccaacacatttataatggagagtctctcctaacttttatcatcaccaggaagtgtgttcatcaaggtgttatctattctactagccttgatgctcactgttctagttaaaaggctatccaaaaatactatgtcttggggtactactgagatttgttgaaacattggataattgttccccttccccctcacccaacccatcatgttgacagtaaagtcccttatccttgaggcagctgacatttcagaggggctcaagggtgcttagcttgaaaacaagaacaaaatatgtctgatcacgcccgtgtcaactgtggttaagtgtgggaaccaggataaggacaactgaaggcatggattgagttgtaaggggccgcctccttttccctaggcccagatattgtcaacatgagggtttgttctagagctactgtcttatctgccacattcctttttcataagaaggcaatttggtagcatcagaatttatcattgtttttgtccaaaaatgtgtgtcccaggccaggcgctgtggctcatgcctgtaatcctagcactttgggaggccgaggtgggtggatcacctgaggtcaggagtttgagaccagcctcaccaatatgatgaaaccccgtctctactaaaaatacaaaaaattagccaggtgtggtggcgtgcacctgtagtcccagctacttgggaggctgaggcgggagaattgcttgaacctgggatgcagaggttgcagtgagctgagatagcgccactgcactccagcctaggtgacagagtgagactctgtctcaaaaaataaaaaataaaaaataaatgtgtgtccctccagtgccgcttgccccttgttctcccaagcaccagggggacccctggtcttagattcaagttgcatcactagactaaccagctctgggaaccagagggacactggaggaactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaaggtatgcattaacttaataatgtatttctaaaaccattttgtttatttatcttctcatatgtaatgagctagattatttatattaaactgatctaaattagatttggaattatatgtcagtgacatatagtacagttaattttcttttctttcttcttcctccctctcccttcctctctccctccctcctttccttcctcccttccttccttttgttgcctgggcattttaacctaaatctctaaaaatgtaaatagtttgcttcaaatgatttttgtcacctttcttaagaaaaggaaatgaaggccagcttgctgtgttacacagtttttattttagagaagctcaccaacactgcctcaaccaggcacaacattagcatgaataattaactaataaattcaattctacaagatggctatgcaatattttgtgaagcatctctccccgcaccatttgtattcatggcccttcaaatttaaaataattgaaattaatttattgacttgaagaaagattgaagcctggtactattttaataagtcctatttgaaatataaatttcagtttgaaaagtaaaatcttacatggttaccctaagcccgttcacatggtcttgcaaaaattcacaaaataagcataattaaaccttgggcttgatttattcagcatccctcaggcaggcacttttctccctcaaggtgagttggaggaaatatttatattcgttctttggggtatttcccagagcaaggccagctgtagccaggtgttcgcacacacagaatctggcagcatgataactagaaacactgatgtacacgcactgttttttagtgagatggcctggcagtgcctggaagttggcctcctggcttctgtcagcaggaatcagagatgaagaccctgagtccaagtggtcttcactgtgcttcatgaccctgtagcttctcaccctccaagggaaaaacggttctgtgattcataacatgattttattccttacagaatgatgaaattgagcccacagcattttcttatgaaaagttctatgaactgacacaaaagatttgtcctcggacagatatagaagatcttttcaaaaaaatgtaagttccacttatgaggaagtgccatataaatattatcactgtccttttcgattttttaaaacgtttttgtcctattttaatagagtatgttggtagcatctaggaatatctagtcagggttacatttttaaccccatactttatcagtgtaaaagttcactctgagtttttgagaaacttttacgtatattaattgcagcacctggaacttttttttgcattggctttactaactacctacaattttaacctgctcctttaggtattaacccattatgtgaactaactagattcaatttggaatgttaatatgtttttgaaaagttgattcattccaattatttcaaatggatgacttacatgttgtttttgaaataatatcttttgaaaacggtaaaaaaaaaaaaaaattgcagactttttctgtgacctagtgggagtgttttccttctgttgttgttgttgttgttgttttatttttctccctttatgaacagtctctggccattttaagaattcaccactacttcagggttagaaaataagtttagaattatcatcaacaaatgtcaacatgtaaatcgtacatactgtagcatcatatacaaaaacttactttttctaataaatttcttttcagcaatggagacaaaactgattatttaacggtagaccaattagtgagctttctaaatgaagtaagctttttcatacattaactccataaagtctgtgtgcagtggcttgccttctctggtgtcctcattgcatgcctgcatcatatgcccttattcgctttgcttctgacctgctgatctttccattatggctttaccaggtgcaaaaatcagctgccgccctgtgtgttcatgtgctttcttcacattggctttgcacaccactttttgttggtttctggctgttacatgtagctctggttctgtgtgtatgtgtgaattgtataatatattcatttaagtaaatgtgtctgtgtttttgcaagatgatatttaaggtactttttttctattgatctcattaaatagaaagagaatggattgagtttactacactgtagttggattctccattgctaactttatctcatacctttgcatggactggaaagctttatttttgtcttttaatggattgcatgtaagaaaaatatgttggctcaaatagaatattttgacaacaagcaaaacacttgagttcctgggtgaaaatacattgagttttaggctaataggattgcaggttaaatttgtactttttctttttataacaagctcagagctaattttagaatgtgattaacttaacaaccaaaactgatagatagaattgcttaagcacaagagaaaaatattttcgaacaaaaaaagtttgcaacttttattacaactaaaatgaactacttttttcttcacacatacaaaaaaagttttcccttcagtgaaacccatcaagactcttgttaatccaaaatggaaaattcacttttttttctaacacattaataagagtttgagtgaaggatggacagtatgcttttgtttcaaaataatttaagttaatcattataccatataaagagaaaatgcaagaaaagatggtatcatgccagataaaacgtattatcttaagaaaagataaaaaggcagaccttaatttgccacttcatagagacaaattacatcttcttttcttccgttgtgaaggttcagtggcttcaaatttataaaggtcgcactttagaaactatgttaactaaagtgtaaatgcactgatgcaagaaagagaaaatcctaccccacatatcagacagatgcctctaaaataatccttcgtgtacaatacaatgtttattttactcgaaaacatttcaaatttttccactccactggtttttagtcatataaatacaatgttcataatctttacccagatactatccacgttcttatgccacagctgctcagaagttaaattgctttgttttgtttctttaaccccttccccttcttctgccttttgttttttggtttcttgttttgttttgttttatatcccttggcttcttcatgcactttggttcagtgatcatcttaggtttggtgaggtgaagagggaagacggtttagtgtaaaggagaaaatctaccacatcttcagtttgccacttccaagacaaggcctcttgtgttctttgggatgaagccctctcttaaacattacagagaccttaatactgcatttcactgttaaagaatgaagcaactcttaggtcttgaggataagtgcagtatttataggctcttatctaatgcatttccttttatgggttgtttttgttggtgctcccaacagtcactcctgtaattcttagacataacatttaattttttaaaaatatcatcatccatactttcttgttctgccattcagattctttctttaagtatttattatttgtcaaccttttatccctcacaattacagtagacaatagtattcttttttttaatagtgtttccttctatttgatgtcttcttaacattaaggaagtaccttaaattttggggtgtgactgatggaatcggtgtgattctagatttctttaggtcataggaactgtaagactactcaggaaagtctatagcctttatttttaatccaagtgtctgccctgaatttattccttttctatcctagtgaactcaactggaagaactagacaaaaacatgaatgtcggcttgaagaagccttgtcaaacatagagaacattctgcctgttccttgcactccctcttttgagtcctaccctggcccctcttatctctccaaaatcaaaaacaccccttgggcagaacaacttcaatactcataacaaaaggagacagacagagctcactcaagaaagaatgggcattggaatgtaagggtcaattactccaagagtttaaacctaaacattttcaaaatgccttagccacatagtctcaacaagccagtattcaacactgcattggaagcccctgtgaaggttccttgtgaaggttcaatggcttcaaatttataaagcttgcactttagaaactctgttaactgaagtgtaaatgcactgatgcaagaaagagcaagtactaccccacatatcagacagatgcctctacttttaaataatcctttgagtatgatacgatgtttattttacttgaaaatatttcaagtttttccactccactggttcatataatgagacaaaaaaataaacaagtcccatgaacactggaaaggacaaggtcctagtctcatttgcagatgttgattgtctactctgatataaacaattccacggaaaaactgtttgaagtaattagagagttcagcaaggtaaccagagaaacaatgagcaaagcaaaaacctggagacacacatacactgccattaaccaggtagaatagatagtaggaaaacataaatcccatttatattagcaaaagacatgctggttcctaccaccttccagctggttaatcctttcactctttctatgaaagtttttattcatatactaatgtgtatcttcagggggctgcaaggagaggagagactatatatatagtccatttactgctttggtcaccctgtagggtgacctcctccctatccatgcaatcaacactgactagattttcagtagtagctttagacctgactcctcattggcttctcagtatttccttgttcgttgctccccaaagtgtgatccatggaccagcagcatcggcaccccttgggagcttattagaaatgctcagtcttgggtcccacccagacctgctgagtcagagtctgaatttaacaagatctccaggtgatttatctgcacattcaagtttgtaaagcaccatcctagtggattactggattcctccttggaatgtttagtgtgagtgggaagaatatgagagcgacatataccttctgttattctccattaagaatttagccataggaatccaccactcagagctaaaattttgccacatctatgtctcttagtctcatccaatggactgagggaaatcttctttgcctataatatgaaaatagcaaactagagtccaggagggatagcagaggcacttaatgtgagctgccacgtggtgagacactactactggctcaattgcttgtatgtggcaagactagataaaacctcttggctttggttagttttacctccctttccctattcctaatgagaagcaaaattgatttttagttttaccttcattctttgtttgacttcttacaaagatgataactagggtcctgcagaattgggagatgggtggagggcaggagagagggataaaaacaaggaagagagggaaaaggccttaggtggccacaggaatcaaggagtagctttactttcttgttgctggtaatcttcccccttcctcacacatatcataggatcacatcagggctcaacctgacttttttctttttgcagatgaaagaatattttaaaaggacccatgatctctttccttttacaagatctttatgctttaaatgcacaggcaaagagagagaaggagggtatttagtcttatgagtaagcttatccttgccaattattccttctatatttttaaaatattatttatgtcaacattcatctctcccagtgctacttggattgaagccagacgatgcctcttctcagcaccagtaaggacgtaatactggagttctcttcatctcctccttacttacttggacacagttctgtgacctatttttggaagtcatttagaatctcattttacaaagcactggataccatggggtgaataacctgagtaacttgtttccccaaatcctggctgaaaactgatggttcctcagagatgtgaaacattcacctcactgtgcttgtgtctctgtggaactctactgcagccttattactgtgagatcagctggaagtgatccttctcctcttgtttttccatatgaaaatgatagttttctgactctaatgcaaatcttatatttgtttccttgcctttggattacccagattgatttgtgttacctttttgaagcatgaagattttagggagagctgaagattgttatctagtgggagcagaagcaaaaacaaatgcaatttcgcattgtctgcacttcatgcttatttgctgcgaatgtaattttcagaataggggattatgatacatccattttagggcttggttttcctggctttgttttgccataggcaggatggtctaatgaatgtcataccctctgactaaattttaatagtgtttaattgggaggacatctgaaacactgaacatgcttctatccttgtgagacttaggtacttttctttttactgatgtgcaaatatgttaaaatgcatacctttatatgttaggtaaagtgattcttatacttgagcacatcagaattactcagaagtcttatgaaaaacacagattaataggttccaccccagagatcagcagattcagtagatctagggagggacctgagaagctgcatttctagcaagttgacaggtgttggtgaggctgatgctgccatccacagatcacacttcaggtagtaccttgtcagaataaacacatgtatgtatattttaaaatgcacaaaaatgtctgagttctgtctcctttcctaattttatctcttctctctcctgtagctgaatcccttttttctctcattttttaattcatatggatttgccccatcatctccatgagttcaaaatatttaccaacaaacatatttttaaatttaaaaaacttaattttaataaggaagataaataaagtggccacctatgaacataacagtgctggggtctaaaaaggacctttttcatcctttatccatcttctaccatgatattatttatggagatgtgagaagggatgtgcctagaaagatgggtttgttgttgttgtcagtttgtttgtttttaaaacaatgcattctcaccagaaagacggagctccttgtttccttgagtagtgggctccattgcacgatggcatcaatttcctaaacaaggtgtagcatgccttcacttgcctggcattccatggtccacctcacaatcctcttccctgcatatcccataacttttgttcttggtggcctcgaggcctgctgttaacataacagtttctgttgtagcatatgcatgaatgttagctgttgtgagccataatttcttagattacaacagaagcatgcttcattgggataaattgatgaaatttgatattgattccttatgagttaatgctcttaactcggtgggggaggaggggacccagaaaaggctgggccccatatgcatgaggaaatgacatccaagtgctctgttggccaaaagcattcattctgtgtatagctcacttttccaatgcccattccaaagcaaatagggaagggaaatccatatgaacttttaacagttgctttttaaatacctttccaacaatgtttttcagtccgtgcatatatttgggtaaagagttgtcaccaaggtcctatttattgaccaggttttgctcacacctgcttatctgtcattattccaaacttccattgaggtttgctttatttattcacttattcattatttttgtaagggctgaccagggacacagtgctgtcctctaatcctcagtgaacagaaaggaagtttagtggacccactgccaacacacatacacacacaaacacacactattggagctgagtaagttagtaaactgggtttttcatcattgccatgaagttaggatgataccattgcagggacagcattgctcctggtgcctcatgtcatagcaggagctccttaggtgtcaatttgaaaacaataatgtcaccaacctcttaagtcccgtaatcattcatggactctctgcccagagaattctatattgtttatagcttgtaaatatgcttgtactgattaattttcatcattacaattggttcgttttgaaaaaaatagttactcaagaaaatgaaatttgttgagtgcccaagaaatcatggattgatgtagaaaggtgttatgaaaaagagatgatgtttgcctgtgtaacattaggctttttgttgttattgcttttggggtttttgaggggtgcacttaaattagtatattacctatttgaactattttggggggttggtgtttgctttttaaaaatattttgacctcacgttttatagatattcatgccaaatgtcttccctgttgtgtgggaactggaagacagtacaattgacatgcacactttattatgtatccttcaacttttgaaggggaaaaaatgtattctctctctctctctagttcagggagagtaacccaaaagtattcccaaatgtggactttttgaagtatactttaaggagaaaggcaggaaggcagtgaggtcctatctttgtaattataaacatgacagtctagatatattttgttttataaattataaacttagtaatgtctaatgcctcaaggccaagaaatatcaacctaaatggagttattttcttatcatagcatcaacgagatcctcgattgaatgaaattttatttccattttatgatgccaaaagggcaatgcagatcattgagatgtatgaacctgatgaagatttgaagaaaaaaggtaataaacatgaaaaaaggacttaaaaaaaaaaacaagaaaagatgcaacttttaaagccttggtttatttaaaggtatctgtaaatgctttgcaactccctgagccatggattgatgactatttttttttcctgctcttaagttcgtataaattttacctttcatcagaattagtcaatcctgactgaagtatactgttacatttattgtattattaaatacattatagtgatgtttccccatgtactttcttgtattagattttagtattgcatattgcttgaaatattaaaacaaccaatacagtctctacttgcaatccttgaaaataatttttgtcatataaaaacttataccttttctttttctcccttttgttttgccaagccaaataaatttaatacgtgatttgatgtgcagtaaccctcatttgacctctggtatgaaagataaatacaattgatatgaaattaaatagtcaggaatcgccttagctaattgctggacctttgtccctttcaaagaagctttggaaacaaagggttgttcgcacaaatatttgtcaaaggaaaggcatggggagaaattttaaaatcagtcccacagcagtgagaaatgcctgcggaacatgggagggagagctgggggtacctgagctagagcctttggcgttatgtctcagtggagaatgtaaagagatgaaagttcaagttccataggtcccgtatgtccgtgaatctcaaggtctcagtttcctcctttttaaaatctatttttttctttgtatctaatgccagtgagtgtggttgaatggtctgtatgttatctggaccctctttttaggtatacctggccctctacactccatgatttcacccctgatatttttccaagcccaatagttttccctttagttgtagttgtacagtttacactttctgctatggctgaagatacctattttaagcaagaatgcttcattccttccctctctgtcaatattctgaatatcataatttatttcacattgcttatgattacagcaaagggaggtacagcttggtagaaaatctaacacttcgcattggcaggaggtgatatgattcttgtcacttccctgtgaccttgagctaggaactggcctcctgggcctcagtttccctgcttgtaaggtggtggggctcatgcagtaatttggctagtatttcccttccctaccttcattctttgaagtttgtagagggctgaccgggtgccaagcactgtgccagatgctaggaattcaaaacaataagaaatgtccccagccttgaaggcagttgcgatctgttcaaggagaaagacaagtgattcaacaattccttggcagtgtgataaatgtcatgattgaggtgtgtccttgtttatttccaaattccttctaagttttaaaggtctatgaagtgaccattgacacatctaaaaagggtagcttgaccatttcacaagtgatggaaattttaacgtctgtcattttcaagcgtgggtgagaatggagtacaaagccattcttataaacttctggtaagaccctacattggtacaaccatcttggggaatattttggcaatagtttataaagtgaaaaatatgcctcttatacagcccagcattttcacttctaggtatgtaccctagagaatctctcatctatttcccaaactctggataccagagcggcacagttctcagatctctgctccacctatattcactctgtacctgagctcatccaagccaatggctttacatttcttctattaaactctccagtcctaacctccagcttacactacagacttgtagtagaactctccatctggatgttgaatgggcatttccaatgtatatatacaacatatttcgatccttcctacccctagatatgttcctttcaaagcctataaaatagtaccgttatttacccagtcaaaaccactgggctcatgttggacttgtttcattctttcacatcatgtctggttcatttgcaaaacctgtaagatccagcctcaaaagaaatcctaaataaatcacttctcaccatctccaacattactgactatccaaaccttcatcatccctctccaggcaatgccttctccttcctactcagtgccctacaatttatggtccacacagcagccagagtaaaccttttaaaaccaaatctaatcatgttattccaccctttgaaaccctccaaaggcttcccaacacatttagaataaaatctaaaatacttagtgaggactaaagcccaagtgatgtagcctttggctccatctccaatctcacttcaagctacctttttccttggtcacttgctctgtcttgctgtcattgaatgatgttggcacgcatacatctgcatcaaggtctttgcacttgatgatccttctgcctggactggtgtttcctgggtgtgcacgtggcttgctcctcacacatgtacgtgacctcagaagggctttcactggcccatatttaacacagcatcctgccatgcttcatcaccttcctccctgctttctctgtccttctagtacctctttgacattatatttatttgtttacttatttgtttctgtcactcataatatgagagtttcatgaaggcagggcttacctgtttcttctatcactgcatctatcctggtgcctctaaaagtacttgctctttagaatgaatgaaggtgcccaaggaaagaggtatacaaatttctactttcatttataattagaaatgacctaactatccatcaaccaaataatggataataaattatgatatattcatatatggacttctgtaccttcagtgaaaaataaatgaacaagatctacctacatagctggtatataaagataaaaatagcaagttgcaaatgcacacagtgggatagtttttacataaaattaaaaacagcccaaactacccgttgtttggataaatgcatatgtagtaaggttgcagaaccattttggaggtaaacaccaaaactaggatactagttatctatctggtatggaatggaattgaggtggggtatacaggatgctgcagtggcatcagaaattatgtattcttttacatgtaagtcaaataatcaaaaatgtaaatcaaataaggcaaaatgttgagatctgaccacactggtgtaggcccgtggctattcattatgctatcatctgaacacttctgtattagcttgaaatcagttcataacttgcaagttcttaaataaaacaaaaacttgaagctgtcgatgcatcaaccatttataagttgcataaatactgattgttgctcctgtagttaccacgtgggctctaccccatgtcagaaaggtgtgatcgaaatgaagggtggcttttggggccacgtttcaatgaccactgtatactcttctcaccagtcccataacctgacttttagataaaattgaaaactgaattgtttaaactcagaagcaccatcatctccaagaaaaatcccttttccaattcagtgagaacaatgtcttataattaatacattttccatttttaaagagcacctctcgtatctattctcatttcccattatgaagatcttggaagtcagataggtccagtctttttccccaattgacagaagaagaagctgagatctaggagccaaaggagtgagtagcaagagcagaacttgatacaggccccctggacccctggtcaccataactctcagtgctgtgtttctgaacttgggggaccatgtacatctgccatcatggatgtaaaagcagaataccacctgtttgtggaattcattatgttacttataatgtgcaactctcttatttcattcaagttctgacagatgaaagttcttgggaaagagactgtgaagacgtttttactcttataatttaagctgcctcagcttccatgaataaaacatgagatatgcatcttcagagctacaagtgctactaagatgttctttttcccctaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgcctccaaaaccacaaaaaagaaaacatgcatattgtaagaaggcgtgttgagttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggagtggtgatgactcttaactagcatgctgccttctagcatctgtttaacaaagcacatcttgtaccgcccttaatccatttaaccctgagttgacacagcacatgtttcagagagcacggggttgggggtaagattatagattaacagcatcccaaggcagaagaatttttcttagtacagaacaaaatggtgtctcctatgtcaacttcttactacacagacacagtaacaatctgatctctctttcttttccccacatttcccccttttcttttcgacaaaaccgccatcgtcatcatggcccgttctcgatggtcactgtctctttggagctgttgggtacacttcccagatggggcggcctggcagaggtgctcctcacctcccagatgatgggcggccaggcagaggtgctccccacctcccagacggggcggccgggcagaggcgctcctcacctcccagatggggtggcggctgggcagaggcgctcctcacttcccagtcgtggcggctgggcaaaggcgcttctcacatcccagacggggtggcggccgggcaaaggctctcctcacttctcagacggggcggctggcagaggcgctcctcacatcccagatggggtggcggccgggcagaggcgctcctcacctcccagatggggtggtggccgggcagaggcgctcctcacctcccagacggggcagccgggcagaggcgctcctcgcttcccagacggggcggccgggcagaggtgctcctcgcttcccagacggggcagccgggcagaggggctccccacatcccagacgatgggcagccaggcagagatgctccccacttcctagacggggtggcggccgggcagaggctgtaatcttagcactttgggaggccaaggcaggcggctggaaggtggaggttgtggcgagccgagatcacgccactacactccagcctgggcaacactgagcattgagtgagcgagactccgtctgcaatcccagcaccccgggaggccgaggctggcagaccactcgaggtcaggagccggagaccagccccgtcaacagggcgataccccatctcctccaaaaatagaaaaaccagtcaggcgtggtggcgcacacccgcaatcccaggcacttggcaggccgaggcaggagaaccacggaagtccggggcagagaggctgcagcgagccgagaccacggcagtatagtccagcctcggcaacggagggagaccgaagaaaggagggagggggagggggagagggagagggagagggtaaattagctttatttgatgtaaaagttcaaaaatttagttctctgagagtagaaattattaaaatcgtttttgttttatagaaactggcaaatatttgagatttaaaatatggcaaaaatgatgaaagtgaaaaataagaaatgtagttacattatgtttttttcttggttataaattaaacaatactttatttttttaattcatttttttttggatatggaaatatgttaaaagaaattaactgtcttactacttccatttgcaaacttcctctgaatacctgagtatgaatcactaaacattttctgaaatggccaaagtaacattatccagcctatcaaaattaaaagtaatttttttaatttattttattttattattattatactttaagttttagggtacatatgcacaacgtgcaggtttgttatatatgtatacatgcgccatgttggtgtcctgcacccattaactcgtcatttagcattagatatatctcctaatgctatccctcccccctccccccaccccacaacagtcccatgtcatctaaaacccagcccacattcatatttccccagttgtccccaaccaaattgtccttttttttttttttaattgggacagagtcttactttgttgcccaggctggagtgcagtggcatgatgtcagctcactggaacctcccctcctgggttcaagcaattctcatgccttagcctcccaggtagctgggattacagcctcccaagtagccatcacacctggctaatttttgtatttttagtagagatggggtttcaccatgttggccaggctggtctccaactcctgacctcaagtgatccgccttcctaggacacaccacgcccggcccccaaattgtcctttattgcgttttgtcacaagtaggatttcatccagaaccatgatgcttgttatatttcttaagtctcttaatctcactcagacaatccccttttgataataccaaccagatgaggaatataatgtggttttaacctgtatatgccatgaaataatcaggttacttaatttattcaattttctgttctggaagaaaacaacttattttgatgtctttcttttaatttgtatgaacactatttcattgtaaagtttcaatattgtaacttcactatatccctagatgtgttgaacttgactgctgggatggaaaaggtgaagaccaagaaccaataataactcatggaaaagcaatgtgtacagatatcctttttaaggtaactttaaaaataattacacagacttttccaaactctgtgaaaatgcaggaaatagggagatggagaagagaaaacaaatgattcattttctcaagcattatgccttcatattcccttcttccagtcttgaggaaaaagtcaagacaaagatcttttccactgaacgtccccttcatgatactgttcttgctttcaaatggtgactgtgttacataacaaggtttctctggcagagtttacctagttttacttaccttagaaacagtgtctccttttgttatctacttatttgcttatttactttacattattcctaaaggacttcaaggtggcataaaaagataaatagaatacaggaataaaatagattgtaaatagggcctacaagaataagaaaggccgggcgtggtggctcacgcctgtaatcccagcactttgggaagccgaggcagggagatcacctgagatcaggagttggagaccagcctgaccaacatggggaaaccctgtctctaccaaaaatgcaaaattagctgggcatggtggcacatgcctgtaatctcagctactcaggaggctgaggcaggagaatggcttgaacccgagaggtggaggttgcagtgagccgagattacactgttgcattctagcctggacaacaagagtgaaactccatctcaataaataaataagtaaataataagataatgaggttagacaaatcaaaagaatgaaattctgtggtttgcaaatgtcagctgcagctgtctgtcggtttggtataactcaggatagatattacaacaccaggagcagcggttctcaactccacctacatgtgaaacatcaccatgggtattttcaaaaacataggtgctgctgggcgtggtggctcatgcctataatcccaacactttgggaggtggaggcaggtggatcacttgacgtcaggagttcaagatcagcctggccaacatggtgaaaccctgtctgtactaaaaatacaaaaattagctggtgtggtggcatgcacctgtaatcccagctgaggcagagtcaggagaattgcttgaacacaggaggcagaggttgcagtgaaaccagatcatgccattgctctccagcctcagcaacagagcgagactctgtctcaaaaaaaacacacatacacacacacgcagatgtctagatgctatgcatagtatttctcttagccaagatattggagagttttgaccagcaatgaattcaagataatacttcttgatatgtaccaagagtatattcaagtgggaagccatgaatttgcatagccaggaagaataactaaatgactacctcagccacaaggaatgcctcaataaaatatttcaagattatctaaccttgggctttatcatgtcaaatggatttgcctagataactattgtgaaatatttttctgattaactgaatgatgagatttgccctgtgattagctacaaaccagtaagaatttggggatttttaccaaatatgatgctccggttgtagaagtgctggtttgaagcctttctttctaaagctaagcagagacggggccaaccatctcttaaagcctctcctatttcatggagaatagtgaaagggaagattatgtttagctccttcaaatgttgttttctgtaattaagttctgtgttacagatggggggtcaagaacacttctatgtttcacttacatgttgcttgaccaacgagaaccccttcccccggccttgtaaccaggctaataggaaacaagggatactgcaaatgtcactttagtacacagaggtctacatcaagttaatgaagtatagcccaagactgatttccaaacacagaggaaagtcagtgaaagcctccagcagtcctgaggttactacccacacttttctgcatgaggtggggaggagtcatacagtggtcgggagtgaaaacctctgtgccagagatcacctgctcctcaagaagaaaggtggactctgaactcctggcctggcagattaacaagccacagactggcatgccatttaggtgaaatctcttgtaagttaatagcaccataattctggagaagtaaaagatagcttaaaaaattgtcattaaccattaactgcaccctggctataaccacagggaactcaacctttagaggtgtcaaggtagatgggggctccaggtctgaattgctggaattgactttctgaaagactcaattaatagtctctgaatagttttgggtgccttaatttttttgctcttttctctcattaacgtttttttttgtttttaaaggatgtaattcaagccatcaaggaaactgcatttgtcacatcagaatatcctgtaattctctcctttgaaaatcactgcaggtataatgatccattctgccacaagtctctatgtggtattgtttcctaacccctaatgcccactcctgctctacaactttttaaatagctgaatagtttgttttgtgaagtactaagttcaaataattctccagcaagggcacctactcttatgcaaagcaaaaaacaacaaaaaaaggaaaaaacgacaaaaaaccacccttgtccccccaaaccaaatcattttaatgtgtttcagaaatacttgttccaaataaaagttcagagattgggacaccttacttaaagttccattgagctggaagatttgacagtatatttgaaatcagatttgatgaacttgaaagacattttttattcttctttccagctcttagttttggaacagaatctccttctccttcttttaaaattataccagttaaagtttttgatacatctcacattagcattaagaggacaataatgcattttgccaagtgagaatctttaattgcctagtaatgggtgtttcttattcttggacggttaatgggtgtttgaatttacaaatgccacttttttctctccagcaaatatcaacagtacaagatgtccaaatattgcgaagatctatttggggatctcctgttgaaacaagcacttgaatcacatccagtatgtatttttaacaaaccatatttctagcatgaatggatttgttttgaaaatttctgaagggtcaagtagtactagaggactaatgctaaagatcttcatatttatttaaattctttggtacggaaagcttacatcatgcttcagagggatgtaaagagacacaaaataaacatctggttcaatttcatttggaggatctttgggtcttatggttttcagatctcagtcttaaagtttcataaagcacccaggccaagagtccagattcaggtcagttgttctcaaattcagttacatgttagaatcacctacaaaactgttaaaaacacctgtgccagggccccacttggagactgatttaattgatgcagggtcagccctgagcatggtgttttaaaagccctccaggtgaactgtatatgcacccggtattcagaacccatgggaggctcatgctgtggaaagtgccctggattgatgtcacgacatcctgaagttcatgttcctaactccaaaataaatcactgagtaatgttgcacatacatttttgaacttcatgttaaacctgctaatttcttcataaagcaaagaacattaacctgtgctccatagataggctttatgagatctgtgaattcattctaattgcatgcaatttttttgtatatactcattctagagagttaatcacatttttataaggatccatgacctccaagagattaagatccacaatcacaagatgttatgagctccaaggcagctaatgaaatcaaagtggaaagacctgctattgacagcagcacctgatgggctcaaacctggtagcatgaggtagtggcagaagaacatcacagcaaatgacagcaggaaggtgctttgtgctacatgtaaacactttatgaggttcttttcagaagtgtgtctatgggaactgaaaaaaaatatgagagacaaggatatctgtatcctttgtcccccttccttcttccctcgaacttgcagaagcagttgctgcaggtgacctgcccatatccttgcagtgcctcctgtttccctgaacactggcctgactttccactgccaacatccacagctttttgcctgagagtgagctctggtcactggagcctgctctgccacacatgaaagaccagcagtgccagggaattatcacccctatcccatgcttcatccctcccgaggtgggataaccctgagcacctgctcttctctgccttccagggtttcccagcaggatcgtgctccagctggctgcagtgataacacacccttgatgagctgcctgtcttctttttctcactttcccacacctctgttggagtttccttccaagtagacgacctggtgcaatactacttttctctgaggctgattttaagggaacccaaactaagaaacagctctgatttattttatttgtttttacctaggccctccatttatctttctgattaggttaaggtgattgcttttgtggaaagttcactgtattcttagtgaagtgatgtgcacatacttttaccagctgaagggtgtccaggttcttggcatcttgaacaaagaatcggacaaaatgcacaaacaaagcaagggaagaatgaagcaacaaaagcagagatttattgaaaatgaaagtacactccacagggtgggagcagcctgagcagaggggctcaagagccctgttacagaattttctggggtttaaataccctctagaggtttccattggttacttggtgtccggtctatgtaaatgaataggatgaagtaaagttataaagtcatttacttggtgtacatcctttgtaaatggagaggatatttcctgtcatagctgaagtgtttccatttgatttagttctaggaagtcagcatgaataggccttatattccctgcctcaagaccctattctcctttgaatacaggacaggtgtctggggaagcatgggtaatataaatgggaataagacctgctccaaaagctaaagagctttcaaccttgggagtgggagcaggacacaaatgtgaacacataactagaaaagaagatggcgtatggtgctttatttgttggaggtgtcctggtacaagagagatcactggggaatgggccagttataccacgctgctggaaggaaacagcatttcaacaaagggttttatttgaggcaagacagacatatgagtgcacagtgccttacatataataagtagtataaaagcaagttttgaaaatgaatggatgggtggaggggtgggtgggtgggcatatagagagatgggtggaggaatggggaatggaagactagatacaggacggttctgtagaccagaggtgatagcatacaggggcacctcctttgcagatataaatctaagcaaatgatgctgtagtcaagttcagattccaggaattggaacaactcccttcttgattcccttatcaaacctacaaaaccacaaaaccacaatctcaagtgttgagggttgggtcagcctactcagcagacaggcttactatacagcctgacacttggggggatctggggggcctctcacttgggaaagctaattctgaacccagccatcacaattgtcccttgcactttaccagatacttaaaaggtgcaaggccctctggggagcaggaacccctccccggcacatcccaggccagacccctgctccactggggaggttggagcagctctgcacacctctggaaactatgtggatttcaagtttgcagcactagtctaaggaaaagctcaatgggtgtgctaatttgggttggggagtgaaaacagaaggctgtgccgcctgccatctagtgggtgttgggttgcatcactcccaggcctcccaggctcctcctggactgggaaggagaatggagaagcacagcccttccttaattcagctctttctgtttctctctagcttgaaccaggcagggctttgccatcccccaatgacctcaaaagaaaaatactcataaaaaacaagcggctgaaacctgaagttgaaaaaagtaagtgaaacacacacatttataatggaagcatacataacatgtgtggacatttcagctgttgagaattcaatttattttaaaaccactgatttttgggggaagggtgtaggggtgatgttacaggtacttttcagagcaagattgccacatttccatttaaatttaatttccatatcaattaattcatgcagcaggaaaagcatatctatatattcaaatgccagaatttggagagggcccaaggaaaattgagaggaaagtagaagcattttagaatttctcaagatataaggaaccagcattttataattttatacactctaaagtcctcataagtttcccttttcagtttgccccgtgctctatacctatctagggatactaggtacatatgagtgtgtgactgtgtatatgtgaatagagagatctagagacaaatgattttatataaacatgtttccttttattctcccaggatgatttccttgaaaatattttctttcagagtatatcctagttcagtgaattaatggtatcaaatattggcatgattacacttcattttccccccaagtattctaaatgaaaaattttaaattatgttaatgacagtttattttattacaaaagcaataatgccatagaaaaatcaagacaatgaaaagtgtaagaaagtaacagcactaacatatattatacacgtattcatatactatagacacatgtacgtaatgtacatgtgtagatatatacccacatttttaacatgactgagatcatattaatgatactgagtttaaatttttaaaatttaaccaagtaagtatacttacatcagcaggatatacatctacatactaactttaatcctaatgtatgaaacactatatagaatttaatatatatgacatagaattgtatgcatttattatagcatgatgtaacgagtcccaagttgatggattttcactactataaacatgcttgaatgttattttgtatgtttgtgcaaccctctccttgaaatcaattggtgcaattagagttattcagccaaaacgtatatatattttatattgtgatatagtttgttatgctttcttttaggaaagttctaccaccttagactcttcaccagtcatatatgagagtgcctgtttcccaccaatatccttaatgctggctgttggccatttttaaatgtgtgtccaactcatagaaaaaaattggtaccttaggggtttttttatttgtgtgtcttcaataactccttttttgcatattactatttgtggtttgtccctatgtgttttcccatttttattattttgtttacctttatctttctgacttatagaaaaattatttagtcttattttgtatagtaggatataatccccattaaatcagttgcaaatattttttcctgaagttttgttgccaacctgcctattttctatcagttccccataactgttcataaaccttggtctgtgccagattctccaaattatgggcttttgttatctagccttaaatccttcacgaggactgaacctcctctcaaacttggtgaccagaattttgggcatttcacccatgtccccgcaattcttcatcatgtgtatataaggtggttgttgcaggtttcttacaaggtcgagaccaccaggaaatggcgagagagagaacactgctgaaccttagaaacatggtgccttggtgcctgaacattctatttcttctctcttttcacgtcctcctcagtgtcgatctcaaggcctagggtttgtatgttacctagcatctgtcaccatctctttgcgtgtttttgctaacagaacagctggaagctttgagaagcatgatggaagctggagaatctgcctccccagcaaacatcttagaggacgataatgaagaggagatcgaaagtggtgagctgtttgcttttattttaagttacatgctttgaaaatactttttaaataagaaaaccaggctgggcacagtggctcaagcccataatcccagcacttggggaggccaaggtgggaggattgcttgagcccaggagttcaagaccagcctgggcaacattttcgtagagatgagaccccatgtctacaaaaaataaaatattagccagacgtggtggcctgtgtctgtagtcccagctactggggaggctgaggcagtaggatcccttgagcccagaggttcaaggctgcagtgagctatatgtaatcctaccactgcactccaggctggacaacagactgaggccttgtttcaaaaataaatgagtaagaaaaccaggaatttctttcagaagacccttttatataataatgccgttttaattcctcatagtaatattttggtattcttggtattttgccaaacacttcccattttttctggctactaaattttaatggccttgtcatctcccttcctattggccattcagctattcagcagaaattcttagccagagaatccctgaagcacttgctgtagtaggcagaggaagcaatataaggcacattttgtaatccctttgtatagacaaaaacatgaacttgagtctgttaatgatgagagtagagaggcaaataatttaagagaccctcaggcaaatgattggtttgtctccacaaagtgaactagaaactaaaagccagtattaaaatttcaagttcaaattccttcaaataaccagctcaccagaattatctctgtgtagctagataattttaagaaggcagtcttgcttaaaatatttgagtatgtgctattaccttctcttttactttgatcacatagcaacaatcataatgttcagttgtaaatgggtcatttgagagtttggggatgattttagagaattatttgtttgttatgtttcatgagaattgatgaacgaaatgacaaggacttgtgttggttatacaatgccttggatttatatacaggcataccttggaaatattgcagattcagttctagaccactacaatgaagtaaatattgcaaaaaaattattcacaagaatttttgtttaccaatgcatacagaaattatttacactgtactgtaggctagtaagtgttcaataacagcattatgtccaaaaatgtaacttaattaaaaaatacctattgcttaaaaatgctgacaattatctaaacctgcatcatattgaaatctttttgtggagggtcttgccttgagtgatcagggaggcagttgccaaagattgggttggctgtggtaattttttaaaataagacaacaatgaagtttgctgcatcaattgacccttcttttcacaaaagatttctctgtagcatgcagtgccatttgatgacactttacccagagcagagcttctttcaaaattgaagccaatcctctcaaaccctgctgtgatgccttctcaactaggtttatgtaatattttaaatcctgtgttgtcatttcaacaatgctcacagtatctttacctggagtagattccatctcaagaaaccaccttctttgctcattcacaagaaacaactcctcatcggtttaagttttatcatgaaattgcagcaattcagccccatgttcaggctccttttcaaattctagttctcttactctttctaccacctctgcagtgacttcctccactgaagtcttgaacctctcagcgtcatccatgggagtctcccaaactcctatgaacgttgatatttttacctcttcccataaatcatgaatgttctttcttaatagcatctagaatggtgaacatcagaagcttttcagtttactttgcccagatccatcagaggacattctcttttaggaaagctagacatagagctaaaaatccaaaagttggaagaattaactaaccttattcaagactccttaataaagactcctgactgtggaacagactttataagtgactcagttgcatgtccagtccttgggtttgacattactcccagagaaaagtcataatgactgtactttcatttgttttatgtggcagggagggtctaagaggctaaagatatctgatactactcagttgatactcgttattatggtcatctgttactatgcaataaaccatccccaaatttaggggcttataacaacaccttatcattttctgtcataattctgtgggtcatgtgggcttaggttggtggttctcccttgggtttctcctgcttttgtcagcagatgacatctggggctgactggttcccttgggtgggttatcccggacggcttactcacatgctggcagtggatgctggctgaacgctgggagctcagctgggcctcactgaccatagtatccctgtggcctctctctgtgacttgggcttctcatagcacgatggctaagtcccccagatggaacatctaagagccagtgtctcaagaggcaggaagcagaagctgctaaattagttaagagctaggcctggaactggtgcagtatcacttcctctatgttttattcatcgaagcagtctcagggcccatccaagttcaagagggtgagtgagtgacaaggtcacgttgcataagagcacagaggagggcagatgatacggcagctgtctttggaaaatatagtcagccgtgatgcctactatattttttcacatgtttttgcaaataataaatctaaacaagatttaagaaaaatatatttatagaactgtgtttcaaatggtcaagaaaatactcctaagatacaaaaaagatgactattcagtaaaaccagttcctttaagttaaatttcatagatggtaattaaaatatgtaaggcattactgatacgataatccagtaaaacaaactgcagaaataatggaataaattaacaagaaaacaatgttaataataattactaccatcgttgtaccaacagtggaccaggcagcttacattatggccttatctaacctgtatacagcctgatgaaatgggtattattattattattattatttttgagatggagtcttgctctgtcacccaggctggagtgcagtggcgcgatctcggctcactgcaagctctgcctctgaaatgggtattattaaaccaatttttcagatgagaggactgaagcttagagaggtaacatattttgcacatgatcccacagcgggcaaccgattgcactaagattcaatcccagagctacctgattcaagtcaagacttttgtacgttacagtactgccctttcaattcacaggaatatggtgaaaacatagatatgcaaaaatacttttttaaaaaggagaaagaatagaatgaatgaaagtcaaagatgtgatgtttcctaaacacacacagtcatctgaaattagcatctgtatggcttcatgtattattcttaaaggtgctttcccaccatctacatccatatggtaattattcctccaggcagaaaaatatttgcctctagtgactcccatgttattccaaaatatacttgagatttgggttaagtcttaacagaaataaccacatgatttagtatccacgtaggaaagtacctaaggacagaatcatccacctagatggcacaaggctcctgtttcacctgttatgtgtgtgattcttaggttgcctcagtaatacttggctttggttctggtcaactagtcggctataattaccttagtgccactgtatgaatctactatctatgtgtggctagagtctctaatttaaatacatcaacacagcaggcaaggggaaaccaagcatagttcaataggggaggcctgcctggaggctgtagaaaatagaaaaggctttcagtcagtgaaagcaggtgcccaggcattaggctggatttagattcagaaggacatgtggctcccaggataggagacaagtagtggagaatatcaaaattgtatgtggttataggtgtgtctgtgcatatctgcacactcagaaagtgatcatgtattcatacaattctcttaaggtggttagtaagtctccaccacttgtttggggtatgccccttgccttcaagtggtttacatctgtattggcagtttagacataaattaaattaaatgaaatgaaattaataaattaaatgaaaatttaatagtgacatgagaagttttgaaatcttggttactgactgtaggtcatggaaacctagtcctggaagaactgtgttaagaattcaagagacaggtagatccattatcttgctgtgtgatttcagacaagtcaaatcatatctctgcatctagttcctcgtttataagtaaagacagatgctggattagattattttaagatgtattccatttcctcaaatccttttcttcctgcctaagccttacaattacccacttgttgttgttgttgttgtttggattttgtttttttaatcgtctgcctctagaatatcccttcatcagaattgttagctccagaagaggaaggtggctgtttctttccctcaccctcttcctgtgcctggagagatacttcacaaaataaaacagtctatctagaaattctgaatccagatactaccagttgaaagataccactattttattatgactaagaaagaaaaagtagtttccattcactggaaaaaaccgtcagttgaagaacacactacaatatcagaaatattaaatcaaaaaaagtacatcttagaatcagtgaaatcatttttcatttactcctgttctttcattctcctttgtacttttaaacatgctttaaaaaaatctatctcattcttatgggtctactcatttcctttctgaatttctcagaaattattttagtgggtttttttgttttgtttttacagtaacgttccctcatgccctgtggtgtgaccatgtggatttatattgtcctcatcctgatgtctgtgggtttctcctgatcctggctagattttaggcaaattctttatctgggaattactgcaaatagtgattgtgtgaatccaaatctcacctcagcatgttgcacattttccagcaggtacttcttttttttccccacgaacatcctgggtggattctggcattcttgtcactttcctggaccaatgaacacagtgtgtgtacttcctttcacagactagaccacgctccagggacaccagctttatttggcacccacttccacttctcctcctacctgagcctgacaaatgagccctgagcctttgaaacctatgctaggtttgacaaatagtttgcaggagtagcacaatccttctgaggcctttcttttttctaccactccaagctataagtcattatgcccataaaattcaagtggacagtttagtctctttcaaaattatccgatgtatttgttttcttgcatcttcttatttgctcttgatgtcatgaaagatcaaaacacctttttatgagttatagatattcctgcagtgtttgaggctttcatttttagaattagtatactagaatagaagtagccatccacttaaaaaaaatttattaagcatcaagcatttcaaaccacattttaggagcaggagaaataatacataacaagatgtgctccttgacgttgaataggtaagagtttagtgagagttttacttgaaaaaatactgcatatatcaatgtccccattttcttttagcatcctttttctctaaaagtgcttatgttctacccaagattgtgaacaaggtctgactacttggcagtggtttggtgtcatggattttccatttgtctttcacacagctgaccaagaggaggaagctcaccccgaattcaaatttggaaatgaactttctgctgatgacttgggtcacaaggaagctgttgcaaatagcgtcaagaaggtcagagtcccctttctttcatcactctcaagaggtagcagctgttatttatgaaattttggaaatgtgagaaccacaagagaataaagtaacctataattccccttctaaattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatcccgagtctagccctcatttgagaactagtcctgctaattatataccttccccgtaaagtacagtaagcataaaaatgtttccagatattcagccaaggaaaatagttattcatatacttaccttttatcaggcatagtctaggccataatgacctaaaagtgtaaaacacacttgccttctgcccttaggcagctcatggccccctgtagtttagggaaagggatcggaaacagcaaacaagcaagtattcaaataactatataattacaacttacggtgagtgcaattatgaacataaacacgaatgctgaagaataatgaagtagaaagaataaggaaaccagaacgcaaagggtcaagaggaattggccatgcacagaggttgatgaatcactttccatgcggagggaccacagtaacaacagcaagggctgtgagtagagtggcttgagtgagggtggagtgagacgagatgaggcaggtaggtgggaactgggtgatgtaggattttggaggccattatgagaaattcaaatattcagtgaaatgtgacactactgaaaaagtttagagaagggggcagtgtagcctgattcaagttttaaaagattgctgtggttgccatatggagactagtttaggaggaaacaggagtggaagcaggaaaagcagtgaggacaggctgctgctctaggccagacgagagtccccgatggtcaaaccagacaatgcatcaaagaggactgagtggcttcaagacatattgagaaatgggacagcctactgatggatggaatgtgggaatgagagagaaagaagaagtgagatgaccctctagtgtccttgtttgaggaactgggtaggtgatggtaccatttactggcatggggaagaccgaaagagaaagaattcaggagtttcaaatgggatgactatttgagatgcctgtgaagtattcaaggggaggtgttcatatagcattgccatctgactctttctctgggttcatttcctaactgtctaactttgggtaagttacttaacctctgtgtaccttagtttcctcatctgcaaagtgaagacgataacacctatttcatggggtcactgtgaagagtggatggtttgtgacatgtcaagagcttagcgtggtgcctggtacatggtaactcctgtaaaggtattagttgctggtatattatcatccttttcatctttatcattgtcattatcctcatgatcactggcgtcattatcacgcgtatatagaagacaggttgagctagagatacaagttgggagttcaaaagatcgtatttgaaacaatggaaatactgagatgattcacaaggaaaggtggaaaagaaggcccaagtggagccctagttaaaagtggagccagaaaagaagagcaaggtatggctagagaagtaggagggaaattaggcagtgacaccaagaaaaccaggaaagagaacagtgttaacagaaggactgagtggttgactgtagaatatgttaaaaatcttagacaaattaaatttaacagagtttagttgagcaaaaaaaacaattcccaaattgggcaggacccaaaccagaagaggttcagagaaactccagtgcagccatgtggtggaagattttttggcagaaaaaggaaagtgacctacagaaaacagaagtgaggtacagaagcagctgtattggttacaggcttatttgccttatttgaacagaggttgaatagttggccacctttgattggctgaaactcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacactggatcacacagatatgaatgactagagactatgcttttgagaagttttgatgtgaaggggagcaagaaatggactggtggccaagggcacctgaggagtcaagggagtgttttctttttcggatgaatgaatctggagtgtgtttgaaaacttggaagtggtgcagtagagaggaagagattagttttgcaggaaagagaggggataactgcctggaattccttgaggaggtggaagagggtgggattgctgtggtgcaaaggtgtggcccttcacaggagcaggaacacctgattagtgaagacagtggatgaagatgcaggtaggcagatacatttggtgataggaagaggggagagtatttgtctgatgagcaaagccaaaggaatattgcctttacacactatcttttctgatatagggaattgtgactactctgagaatattgaacgtctattaagactcaagagtattgttttaatacaaaaattagccaggcgccatggtacgcgcctgtaatcccagctactcaggaagctgaggcaggagaactgcttgaacccaaaaggcggaggttgcagtgagccaagattgtgccactgcactccagcctgggcaacagagcaagactgtgtctcaaaaaaaaaaaaaaaaaaaaaagttgctaaagccttcatcaatattgtcttagtgtcttagtcagttggtgctgctatcacaaaaataccattggcttaaacaactgaaaactatttgtcaccattctagagtctaagaagtctaagatcaaggttccacgcaatcagttcctaatgtggggggccttcttcgtgtttatgtcctcatgtggtggacagagaataaggaggcaagctctctcttggcttggccctcatgaccaaattacctcccaaaggccccatcttcaaatgccatcacatgagaattaaggtttcagtatatgaattggggacagtatggggggctgcaccagcaaacagtccataacaaatacccagacatgaatgctgagttactcaagagtgaccattcatgctgcttttcctaagccccatgactaaagcactaattaaataattataataaaacatctaagtaggtaaagactgtccacgaaggagggaaagagcattaagattagcccttctggtgcataaaacagtgaggccatccatggctttttgtcatcagtaatgtcccaccttagcaaataaatagaataacaagtttacctacacttatttaaatatctatgtatgtatggctaataaatttggaattttgccctttagagaagtaaacaaattatttcctttctctaattaggcttcagatgaccttgaacatgaaaacaacaaaaaggtaacaaaataattcccttgcacattttaaatcagatgcatctaatttaaaaaatcttcaaaggaaggaatcagttgtggtgaaaaaatgattaaatcctgataaaaatcacaaaactagggcagatgagtaagatgattttctaaaagtaggtatttaatgcagtaaggcattttcttcactggaattagagatttcattcctgcagtggaactacatgatcatcagcatattgaatttgaaaataaaaatgagtgaataggtcatcaaatccatattatagcataatagaaaggatgatcttagttcccactacattgacattctggaagatcactgattaattttacactgcataacttctaagagtattatttgatgttattagctattggccttattgtaggaaaggtaaagttacattttcactttctttcatcctcttcaaagttcttcaagtgatcacagtggttttatttagtaagtatttatggtttatcctacaacagtgaggctgacagccacaggcagaagtttgcctaataacttcattctcatacttcagaggttcggaaaatactgccttgctgcctgtggggtcctatcctatttgaagttgagatcgtatcttctcaccctctaaatattaaacttgaaagaattatgaataaatatggtcgcaggcctgtcccaaaatatttgtgagtacattactctcttgttctagaatttcataattcataatttgggtcaacagtatacagattgacatttggtcattgtcatttattagctaagttattttaattctcaaggcatcaatcttctcatgtggtcagtgggtaggactctaatcctcactacacatcacagacagtaatgagactgtgtgtgcaagaactcatcctggtgctcagctcatagcactggtggtatttattattattaaacacacatggaaggaacggacatggccgttgtttggtgggggagcaggaggacacattaagaaaatgataaaaacaaaaacaaaaccaaattacattacttgattattgtttcaggcttttattggtgaaatcagtttgataatttagaatgctcagattgttaagtgatcagttaagacaaacaaattgaccatttttttttttttttgagatggagtctcactctgttgcccaggctggagtgcagtggcgtgatctccgctcactgaaagctctgccccccgggttcacttcattcgccattctcctgcctcagcctcccagtagctgggactacaggtgcctgccaccatgcccagttaatttttttgtatttttaatagagatggggtttcacagtgttcaccaggatggtctcgatctcctgacctcatgatccacccgcctcagcctcccaaagtgctgggattacaggcgtgagccactgcgcccagcatctgaccattttttaactcatggattacatcatccaactaaggaatttatccaactagattcactttatgcaggaaatttagctttgcaaagttctcagcaaaaatattgatcacttttgaaggtatttttgttgttggttttattgttgttttttctatcaataaataaactaatttgttttcttttttctgtatgcaaagtaatgcagtttcaatatgtcctatgcagcaagttattaggttacttttaagattaagtgctttttaaatactataaaccacgtatgtatgttgcttacattctagagtgctacagtgaaacatagtccccaaagaggcagcatcattagcacctgggaactagttacagcaatgactggcctcactgcagactcacttcaacagaaactctgagtgtggggcccaggaatctgttctagtttaaaaagtcttccaggtgattctgatgcacgctaatgttcgagagtcactatttttgatgttgtgcctcaatttgtaaaaatatgatgctatatctatttcatagcattgctgtgaggtccaatatagtaatttctttttttttttttttgagatggagtcttgctctgttgcctggtctggagtgcagtggcacaatctcagctcacctcaacctctgcctcctgggttcaagcgattctcctgcctcagcctcccaagtagctggaattacaggctcacgccaccacacccagctaatttttggcatttttagtagagatggggttttgccatgttcgccaagtttgtcttgaactcctggcctcccaaagtgctggattaaaggcatgagccaccgttcccggccagtaatttcttgaataaagtcccttaaaaatctaaaaatgtcctacaaatgtaagataagcttaatattttatgattacctccttttgcattattcagagctacaacagacactaacttcttaaagtatcctttagcataattgaggaagaaaaagcctttacctttcaatttgtgtgtgtgcaattatctttattaaggaaatctgcagcacgtatccgtgggtcctactgaagtcatcaacttatatgttttcttccttgtgcttgtagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaaggtaacaccaaaggttaaatgcagtcgccttttttgcttgattttcttttatggtgctgatgagcttttatctaatttgttgccatttttctttgtgggcatgggggctgttccacctcaccttatttttgtttcacagaccatagaagccaccttggtatgtggtgacattacattgtcattcacgacttcaaccacaaggtggcgatgagagactatggatttgttagtgctgggcatgtagcttcttctgttcccaagtgcattcacaagactccttttaatcaaaagctggttttcaaaaaaacataagaagtatttaaaaacttcatttctgggctagagaagccatcgtaatcatcattatcatcaaaaattcatatttcggtggtggctgaaaagacagatgtctccatccacaggatgtcaatgaaagtaggagctactgacatgataatgtagcattagcctccaaggcctcatgattcagggtgtaattgcatttatttattgctgtttttcggtgagggtttgatggcagagttcctgaatccatctttgcttttcttttacagaacgcaatattcattataacatgtcttcttttaatgaatcagtcggtcttggctacttgaagacacatgcaattgaatttgtcaagtatccttatgtatcaagtggaatgagtggttgactcacgttggtttggcaagagcctctgaaatagataaatggctaatatctcattctggtggtggagttcataaaatgatatgtgggaaagaccatggcagctgtgacaatctgcccaaatgaaaattgtttttataatccacacagtgaactgtgatcttaagcatcatttgtaaatgtgaaatctgctctgtgctgtctacttgtttgtcattgttggcctagacctttgttgttttagctctttgttgtttatttttctctgctgtaggactctttttttctgttttccttaataagttacagttataacaaacggcaaatgagtcgcatttaccccaagggaggccgagtcgattccagtaattacatgcctcagattttctggaacgctggctgccagatggtttcactgaactatcaaaccccaggtaggagctgatgtccagtgaccccaaattccatgagaacactttgacaggatggtgccagcacttcccatcagttggctgtgggcattttttaaaggaagcagacatatggcaaagcaatgtgttattggatttatataatggtgagaaataaaaaaaaaaaaaccaaaatagagcaaacaatggtagaagataatgtgttgtgattggaatttaattcctttcataaatgccatgactattcctgctaaccattatcccatattccaaaatatttctcatttttcttccttttggatcaaagttgttatctttgtttccagaggcagaattaagtgaaaagaatttgagtatctttgtacagtaacagcgactcatttctcctttggcaaacaccctgaccactgtgaacattcagcaaatatgactgatgcaggggcacttcactaaacaaatacagaatattttgaagtaaatgccactaaaatggtatataaggagttacatatttgaagaggtactaatctataacttggtcctccaaagtgtactcaaagtcaggtttccaatatataatgactttttttttctggaaggaaaagagtaaatttttataattgataaacacatttttaaaatttttgaggtttgcttaagagcctaggatcacagtatcaagactagaggtagcaaaatagaaatagaatagatagaaatatgccacaaaccctcttcactgtagatggtcaattctacagcatggttcttacaactggtaaaataaaacaaaaccagaaagctcttttttccttcaactctttgctattaagagaactgcccatgcttcccaatttgaggattttttaaaatctattttgtattttaagaatccctgtcacttcgttccctgctatgtggattgagtggaagatcctttgactttcattcctttggcatgagtgtgagctgactgtgcttctcatgccttgaaggagcctccccagtgaccagaagctcctcctactggagtcaccattctgcatggggtccccacagtgcttgctaggttagactgtgacgtgatagctaccaatacaatcctgagtgtttctagctggggcccagtaacaaggctctgatgacttcacttacttaaaaaagcccaacttgtgttctcagttgtcagtgagtccataatatggattaaatggctaacccagcttatgttttattctataatattaggtttaaacacaacattttgaagaggaaaaaatatccatcagtttacccatttcttttgcggatgggaagaaagaaaaaatgttattcacttgcaagacagaagtcaaaagccatgtgctgccagtgtagaccccactagagtaattccccctgcctcccatcctggaagcatgccaccaagttttatgcgatacttacctagttcattttccagtcttttaaatcaagtttcatattcaccctcccgggtatctccagggttcctctgcccagggatcctgagacccatcctctcccactgtagcaggttggatatctctactctcaatactcatcaaacaatggtgtgactcctatattgaatccagttttaaaagtgacctttagcatgatctttatgaaaacacattttatgtttaatttaaatgaaacatgaggtcaattcaacatggaagagagtatgccttaaatagaccaagcagaaccttgtagtattaaagagggacctgtgggcctaggagcaatctgatacctattgtttcaaatcaccccgtcagggtcttttttgtctaggaagacaagatgctaaattatttttgtctcttgacagatttagcgatgcaattgaatcagggaaaatttgagtataatggatcgtgcgggtgagtaatatgatttaaactgttttcacctagattgagaactccatactacagctctaatgaagccatgtcattttcaattaggggctacagaatttaagctgggtttgagggatggaatagaaagaaatgaaatacctagagaatatttgcacatatacattcttcatctaccccattttactaagcaggttttgggttttttaaatcacaagtgaagcagttcatacatatgctacagtttaatcctctcactttaaaatcaatagtggaggattttatgtctgggacaggtaataatccctgcacacttggacattaactggagatgtaggcattaaatatgtgcattttacctaggacaaatcaaataatgaagttaatttcatatgtaatgaagttgtgggtgtcgagctgaatttcattcagttgggaataaacctttgtcctctactgattcttttttgtgtcttgtaagtagcagttatcaaagaataatgctgtgaatattgtcctagtttccttaaatagcactcttgaaaactgtgaaccaagaagtgaaataggaaatgttaattctacagaaacactgaaaggttaaatgaaaatataaaattagaattctcttgagataaaaaaaaaaaaacacaactatgtggtcatcccctcaccccacctcagcctcatgcatctgtccccaaacaagtaaatattaataactccagaccactgcccaaaggcctctagaggaatccaatggaaaactatcccgtcataatgatgctattaggaatttcttcatggtggctcacctgattggatatctttttatcactgaacactgccagtcaagataacatttttcagtggttgtgagttaggaatgacttttcagcatgcactctgcctccctctgccagcctggtgaatggttctctgccaatgtggctgcaaacacagtgattatgctattccccaaatcacccaccacttacatacctggagcatgccctacattttcctctgctgtgtgctttggaagaaaataaattgtgtagctgggaagagaaagatctgaattcatatttcagaattttgtgaaagcaattttgttatttaatgccaagtgttccaacccaggagattttgcgcataaattgctttgtagacctcctcctctcccaagtagtgggccaaggcatcaagccccaggggttcagccctggactgtcagtaaaagccctaggctgggagtctaaagatcagggtttgagctcagctcccagctgctcctagttcttgctgtattgcctagagcaggtgtgttagacccagagcctctcttctctgcttgataaaatgaagacggtgacacctgtcgcacagggtttgttgtactcaaaggaaaaaaaatgtcttttttctagaacgaaacagggaactgaaaaagactttgtcctttgacaaaaaccgagtcctttctgatgagacccacctttgggcttccctctcagtcactgtagaatccagtctgagcaacaatcgtgctagttcagtttagtgaaaatccccagcccttggtatctgaccaccctggatatcctgtcactttggcctgccttcagcaataatcctatcaagtcagtttggccagaagtccttatccttgatgtttcctcatagtaattttccatctgctggcgctcaccttactccatggttctaaatctccatgtacgcttgttggggtaagggttgagcccttatacctatcaccatggctccctacccctttgaataaagtccactttaccatgtttaacaagtgtttgtgtacatttttttctttaacagtttacgacagctcagtcaggttgaatgagtgtacgaaagtacttcaggaactgcacatttctgtgcaaaagtgagatttaagaaaagcttaaggccttgtgatcaatcacacacacagacattgcaaaattcaatgagtgctctgttcagtcgtcctttaaggaccccaaggagtcagcctcagcactcctggctcttacaggacccgtcgggcatggctgtgctcacttctgaaaacttgcagtggcccggtgatgcttgaagcactttcctcgcccacctcagcgatcacacctaagatgccatcagctgtctaacatgccatgaggaatcctggcagcctggccggatgcagggagtattgtttctgtataaaaaaaatcctgacggctcggcccagtggctcacacctggaatcccagcactttgggaggccgaggcgggcagtggctcacacctggaatcccagcactttgggaggccgaggcgggcagatcacaaggttaggagatcgagaccatcctggctaacacggcgaaatcccgtctctactaaaaatacaaaaaattagccgggcgtggtggcgggcacctgtagtcccagctacttgggaggctgaggcaggagaatgtcgtgaacctgggaggcagagcttacagtgagccaagatcgtgccactgcactccagcctgggtgacagagcaagactccatctcaaaaaaaaaaaaaaaaaaagtcctgacaatcctatgttgtttgtttttcctagaatttctgcttagccattattagcacgtgcagtgtctcactctctccaccgttatttattttttcttaagacagggtttcgctctgtcacccaggctcaagtgcagtggtgcaaacgtggctcattgaggccttgacatcctgggctcaatccatcctccctcctccacccctcaaatagctaggggtgcccaccaccacacatggctagtttttttatttgtacagatggggtttcaccatgttgcccagactggtctcgaactcttgagctcaggcaatctgcctgccttggcctcccaaagtgctgggattacaggcatgagctactatgcctgacctcactggtcatttgtaaatgcgttcatttattttaaaataccttcacagaaaaggatactgttgctactttagcctgaattctgtgctgatgtgttggacgctatgtgactgaaagcatacacctcaccagaaaagctgaaaaatagcctgtgcagtggggcagcccagcttgataaagtatcagcgatgctgttgactctgtaatctcctaattccccttcccatacacccagctggtggcaaaggctgtcagtgacagggaaaagagaagaaattgccgtcacctgcatgcctctgtgttccatggcgatggtagatgtggggcccggtgctgcacaggagctcctgtcactggtgctcgggcactgcatggttctcaccgtgtcacccttgtggttctcccacccacctgcaaagacttttaaaaactgcccctttgggctgagtctgaggactgcatttcttaaagaggcattctgtgccctttaggcctgtggaggcaaagaatccctgttttatatagaacatcagtgtgcaaagtacacaaacacccccaggatctagcaactgtagcaaaacgtcagataccctcctgggaaaaccctctgtgctccctggctgatcttgtgggaggacgcaccactgggcccaataagtgtgaatgttaccaggaaagtgagcagtgcttttaacagtctcgtttttgaagatggaaaaatggaagacatttccctaattgcaaatgaaacaaaatagtgtaaattaatacctaaaatctttttagactttcataggaaagtgagtgattgatatcaaaatggtatgacattttatgattcagaggctgttttttatacagcatttctcccttgcccacaggccgtacgttctaagaaccccagtggatgcctgaaaccaccaaacccaacatgtattatatatattgtggttctacacattgcatacctgtgataaagtttaatttataaattaggcatagtaagagattaacatcaatgactaataatggaacagttataacaatatagtgtaataaaagttaggtgaatgtggtctcaaaatatcttaattttttctcttttatgtttattggctatttggatattctgttttgtgaagaacttctactcattttcctattgggttttctatcttttaaaatagattttttatttcaaatttttattttccaatttttatattaggttctattttaatatttttggaacagagttgaccaggggtagctgaagcctcagaaagcaaaattgcaaataaagggggatactgtatagcatagcaacttgcagttatcatcagcagccattttgctttcttgcagctaaataaaataatggcatgttggacaactgatggcatcttaggtatgatgaaataggatgcatttccttatgaccccattttctcattcttggtgctcctatccacccacctggttagcaacccttcttctctccctcgcttgccttccaaggccttacacagtccacagaaaatccttggatccctgtcttggcattggctttggccttgtgcctgtgcctaccgcacagacctagatgtctggaatgagttcattttctgtaccagaaagcaccaaacagaccatctatgtcatttgcagggcccaatgcagaatgaaaatgaagggctcctgagaatttaggatggtggatgcagagcattaaaccaagcatggggcccttctgagttcagggccctgtagaactgcacaattagcacatccacatagccagctctggtgccagattctggcttcagcttccctatcaatgccccagccccctgcaccctcacagccaccagggatatgagaggcaacctctgctgctctctcagaccgccttggacccagaacagatgctcctttgaccttcaaagaaagcttgctaagtgtcctatcccaggccagggcttatctcatggtcctgacaagcttctgcatactctgttttactctcttcaagtatacaaaatgaacccatttcaccggagcatgcctgctttggagaattggatatgggtttcttgcccctttcccctgccatttctcattttggatcaattcactccttcagagatgagtgttctatgcagatttgaaaggggggatgtggaagaatgcttttgaccctgagatgtcattgtgatcccgtttcttattttggtgggtaggaagggctcttgatctttaacaaaggactgtggaaagtgaggaatctctggacactcacttcccaaggagattcagaactggaaaggtgactccagtcctgtattcatccaagtcccgaccttcctcgggaggcagaatccctcatttgccacagctggggtccaaatgctgcctgtgtcatgaaagccagacccaccattgttacctcccctcacagtctgtgtcggttttccttccagagaaagctggtgggcttccctcggagatgcaggcgtagtattgtagctactcacctactttccatcctgattctttaccttttgctgtatcatcatattttctagttgccaactctagccacaaaaaaagctgcaaatctaaaattccatgaatacagaagataatctcttctatatagagagcttttatattaatattgtgggttgcattctcttggagacaagagtgttcaaaattaccttcaacatttcaacaattgtgtaaatgtctatattcttgataaaaaatcagtgttgtctcttaaagattcctttttggactatcaaatgtaagggaatatttttaacactttgttttttgttcagtcttagaagataacaatgaatggtgactttttcaaaactaagaaaagtgacattaaactttaaagaaaaaatatcatgactcaggatcccttttgggttgtattttaacagataataaagttgacatcatctagacttgaaattaataaaagttatgcttctaagaaaaattagagatttgagttcccataattttgattcttttacatttaaaagcaaacctttacttttggaaaaaagtacttttattttcattgatgtactgctcatagtatggattctttaaatctatggttatacttatttctaataattttttaattttttttaagttttttgacacaagtttcagggaaattatggaatctgtgattatatgaccactaccccgtggacatgaggggcagacattgtgtagtgagggtaattgcagaacattttcatcgcctcaaaatctgtatcgtttagctttcatctcccaataggaattttaatctaccctctgtctctatatttgcctattctgaacatttgatataaatgaatttatataacatatggcctttcgtgcctggcttctttcacttaacataatgttttcaaggttcatccaggttgtaatgtgtatcaatactttattatttttattgctgaataattttccattgtatggatataccatgttttgtgccatacattcattcatcgatggacatttgggtaatttccatctctggattattacaaataatgctgctatgaatgttcatatgcaagttcttctatgaatatgtctttccatttatcttggttacatgcataagaatggaattgctgggtcatatggtaactctatgtttaactctttgaggaactgccagactgtctttctaagtgaatgcatcattttacactcctactagcaacatatgagagttccaatttctccacatccttgtcaacacttattgttatctgactcattaattacagtcatcctagtgtatacatagtgatatctcattgtggttttgatattcatttctctgatgactaatgatgttagacatctttttatgtgcttcttggttttttgtatatcttatttggagaaatgtctgttcagatcatttgaccattatttagatgagttattctttatgtattctagatacaggcctctaatcagatatatgaattgcaaattttttcctttttgtgactagtctttttactttcttcatagtgtcttttgaagcataaaagttttcaacagaaaatccagtgtatcattgcatgtgcttttggtatcatgtttagaatccattgccaaattcaggtcataaagatttgtccttatggcttcttttaggaattttgtagtttggctcttgcatttagttattttatcctctttgagctaatttttgtatatggtataaggtaaagatccagttttatttatttatctatttatttgcatggaactatcctattatcctgtcactatttatttaaaagactattctttcacccattgattggtcttggcatccttgtcaaaaatcaattggccatagataacgtggatttatttatagactttgattctgtctcaatgagttatgtgtttttctttatgtcagtaccagactgtcttgattaaatcttgtagcttagtaataagttttgaaatcaagaagtgtgagacacccaattttgttctctcttttaacattgttttggctattcttgatcccttgagtttctatatgaattttaggattagcttgtcagtttctaccaaaaagtcagctgggattttgatagagattacactgaattcacacatcaatttgagaaatacttccagcttaacaatatggtcttccaacccatgaaggcaagatgtcttcccatttatttagctcttctttaatttttttaaacagtgttttgtagttttcaaattgtagacacttattttttttaaaaaagtttattcctaagtggtttatattttgctgttgttatagaattgttttcttaatttcatttttgcatgttcattgtcattgtatagaaatacaattgactttttatatgtttatctggtatcctgcaatagtggtgaatttatttattccaatagtttttttagtggattccttagagtttttttttatttatgggatcatgtcatctgtgactagaaataggcttacttccttctttccaatctggatgccttttaatttgttttcttgcctgattgtttctactagaaatggagaaataatttatttttattttcacctacctctagctgaaatgtcaattacctttgattgtgaatgtagacaacaatccacagtcacattagtggtacccgtgactctctcaccaatgtaaatcacagacattgtcatatttcactactattgttacagctgtctcaaaatatttttgtactttagattattgtcatcataattagatcttaccattagatcttataatttaatgcattattacaagtacaattaatacagaggtagaatatcacatatttttatattttgataactatagctaatataattggtttttcattgttattctttgcattttattttatacatataaagaaaagtatttaaaggtgaccaggggataaaaaagttccagagaagatgataggatcaggaagtcctggataccactgaggctgcagctctttaaggttgtgcataagggcgggcacattctcttccatccttaggaccctctgcctaaaatcctagctcctgtgttacagatggagaaaaggaagcatccattgtttcaactagcgagtgttttagtctttgtaaaacctactaataaacttctatgctattgtcctaccaggtaccttctcaaaccagatttcatgaggcggcctgatcgaacatttgaccccttctctgaaactcctgttgatggtgttattgcagccacttgctcagtgcaggtaaggcccctgctcatcacaaggtagtataaatgtatacacaagtggtccttgaaagaaattataaaatattgaatgttaaattgcaagatccatgtgctgctcacaactttgacttaagattccaccccctttttaaaaaatgagacccattttttcactagtaaaattattagctacttaaagtgaaagataccatcaaaaaagtacctgctacttgattccatttatacaaaattctagaaaatgcaaattatagtgacagacagtaaatcagtgatggcctttgaaaaaagggcagggaggaatgggttacaaaagggcacaaagaaacttcaggtgatgatacaaatgtttatcatcttaattatggaggtggtttcgcagatgtgctcatatgtcccaactgatctaattttacattttttttttgttttttattttttgacactgagtatcactctgtcgcccaggcaggagtgcagtggcacaatctcggctcactgcaacctcctcctcccggtttcaagtgattctcctgcacctgtagctgggattacaggtgcccaccgccacacctggctaatttttatatttttagtagagatgggtttttaccatgttggccaggctgttctcaaactcctaacctcaggtgatctacctgcctcagcctcccaaagtactggcattacagggatgagccaccgtgcctagcctaattgtacattttaaatgcatataatttattgtatgtcaaatatacctcaaaaaagctgtttcagattgttagctagaaaataatgtaaacaaaaaaccctaataagtggctatagtcatttaaacactaaatgaaaaatcatctctccatagctttatcgtagatagactaacattataaaactgtcctagctgaccagtgtcaatatcagtaatgacagacaaattctagcttcacttttctgtgtgtctcttttcaagacttctaaaagaattcattaataagtatggcatgatggaatttcagagctatgaagggtcttaggacatacctgaattcatcacttcatttcataggtgtagacacttaggtgagatgaagaggccgtggacactatttgtattatgattcatatatattttttctttgttttttttctagacagttctagaaggtagaacatctgcttgaaacagctggggtttttttgcctatagtagttgttcgataatgttttggtttgatagaaatgaatacattattgccatagataattgaaattcctgctcccacccaaaagacagaatttcttacttcctgattattttttgctactgatgcttacacagagcttacttctctttgctctcgttcgtgctgctacaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtaggacattttcagcacgtcaaacttactctaataacttgggagccatgttttagttcacagacgctacacgatacaggggcacttattcaaccgacaacatcttctttttctcttctcctaatggctaacttctgtagctgtcataggatcattggttctatttggccctgccctccttttggttctcctctcctccttggaagagcccatctcctgcacagcagtgcctcagctctgggtttaccatcttttagaatgagtccttgctggtggacaccatcgtacactagagagttcttccctaccctggaagttactggtaacttacactattcctttagccaagtagtcaggtaagatgctgcactccaaaattttggtcaatagatgtcactacatgggtcagttggcatggtcctgtctctcctgaaagagtgacacctgttgcctacttgcaggtcttatccttcttgtactgttgttagtgttttatttttttctcctaataccgtatgttggatcctaaaaacaatcacagccattctctctaacgttcggttgttaatctcttattcaccttttcccttggtttattttttgtctattgaagatgcagtggaaaatccgcacaccggcagtgctgtctccaagaatgttcactttcctttcttacttactctgttgtcctgaccacaatgatttcttgctgcttctttaggcacaagttttccagctggttctgctccatttgtacatcatgcaacacagataatcagcttctttccttaacaaaatagggattatccatttcagaatagagtaactggcttacagaaaccaaatgaagggagatcaatgtaggtttgatgaaacaggccattttgacatttaagtttacgctgggatccacacaatcttcgcatcccattgtcttcttctctgcccctgtcaggatatggtgtaaattacatgcatagctgtgatttggttttttccttccctggtatttccaatttgttatagctggatccgttaccagtatggctagtgttctttggcatagtgaataatccctactcacatttctagaagctgagaaagttgactcaggcattctttgttttggatgaatgagaaaatacccagcttagtgtttatatataatagttctggcactagaaacgagatgccaattctgagtccttctctgttcttcagaagttaaatcgtttttttcattgctagcaagtgctttaaaaactttgttttctttcttgtcatttttgtatttttcactaatctcacatggcaagaatggcaaatcccaagcctctattcactgcataaggagcaagagagagggaaattggctaagttaccatggtttctcctcttcatcttcattaagctggaattaaattatagccttcagatgtaaataggcaaccagtccattgtctagctttaaacatagcactcagatcaagcaagatgtcctggttgcttttagccaataaaaaggcattcctgattaaacacattggataccctttttgtaatgttgctattttgtaactgaatcaggtttctgctatctgaactcagattttatgttcatttattccgtttggggatagcaggagtaggtgtcttagaatcaaagtatgttaatgtttctagctaccgcatcttactctatttaacatcccaacatttgctggaaactgaggagtacaagaaacaaggaggacccaaatttatgtacaaaagttatctcttatgcatgaagcatttattcagagatacttaatttatttattcagagatactttatttattcagagatactttcgtattcttaaaaacaaacaaatatagatgtcagcaatatgccagatattagatcacaggattagatccccaattcccaggccccactctgtcactgatatgtctaagatcaaggaaagtggctttatttctcatccattatatgggtggggacaaggatcaatcacaagggttgaagtggtaatctttaacattcatttcatctaacatttttcacgagataatttccaggaaacatgttccaattgcttttctcagtgtcttgggcactgtagctcatgcagtacattttggggaatgcagatggatcatggacttactttcaacatcagggaacatttaagaacagcatggatttggtccacactccttagagtcatggttcttgggcgctgcattggaaaaatcagtgaaagtcctgttctgtttgcaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggaggtaagataaacatttgggtacggaatatgatatagatgaggtcctagattataagattataaaacatcttgtccatgctttaaaaaacaataaaaatactgtctattcctgctaatgctgccaaccctgattaccttgaatacatcaagaatacatcataacctcaggtttcatagtaagaaatgaaagtacaaaacgagatgatctctaaagtcctttcttattttaaaatactataattttatgttgtttatcaatttttacaaacacattttgtgaagggtatatttatattgacaatcagactagggaaaaaaacataaataaggtgaaaccatagatatcttatcaatagtatcgctaaaagatttaaattgaactcagctatcaacatgcctgaattttcttccaaatccacaagaaagttcaatttcataaaaaatcctagtcatcaatccatatgctttaaggtaatcaatgggaggaatccaaagctagattaagtcatagaattttgcttacatgcaaacatgttaactttttatggcctccatctaagccaatacattaaaagaaagcaaagatcctctatattgtcagcctgttgaaccataaggaaatagtacagcaggatgatggcatccgattagccaagggttcaaatccttactctccactgctggcagggtgatcttgggaagaggatgtaacctctcaaacccctcatttcctcccctgcaaagtgaagataataataactacctccctcatagcattattgtgaggtgcttatcattagagtacatgatatagcaaggctcagaaatgtatgagcgcatgggggtgggcggggtgtctgtagacacagatataatttctatacttcactggaacacatcactattttatctggggaatatgggataattttgctgtttgtttttagtagtgcatgcttctgtggagggcagattttctgcaactaaaccacaactttaccagtctaatatcagagtcaaaaattaaaataagccatgaggatttttccatcccaaaattcatagtccaggctccttcctccttctcctttgtctttcataaaaaaaaaaaaggaagcacattagaagctacaacatacagtaatagaggtaacaacccataaaaagcctggaaagggatgctgtgaggctgggtaagaggatcagaaaggggcactggagacaagtggtaggtttaggagcagcagtccgtggcaaacctcagaaacctccctgcaacacagcatggtggtggccatggggcatcagctgatgagttaaatcatactccacatacgtgagcttagaaagcaggaactgtggaatacctcatacattttagaaatagttgtataaacccatatgatggaagatttagaagttttgcctctgcatgggttaacttcccactgaaactctaattcattcttgggaactaagccactcgaatagaaaagggaaagaaatcatttgtttagcttctactttatgccaagagctttatgtaaagagatccaaaagcatgaagttgttcagaatggatgtaagcatagggagatctgtgctgcagaaacatctgtatttacaatgtagcttattacccatgttgtatttaagtatttagccaaattaatctctttaatattagtcctgccagtattctttcctaacatgtcattgtggctgcttactttttatcagaagcgtttgaaatttctatgtaccattgatgagattctgcagtcgatgccttaaccagagttgacattcaaatacaatttattcaaaattctctggtcatttattttatatgtgaagaaaccagggacagacattatgcggtgtcagggacttccctgtagataacagaagaagaatatgagaactgtctttttccaaatctctgatcttctttatagcttcttgacttattcaaaatatacttatattttccctgtttagccaacctcccacattcatatctcagtgtgtttatgtgctgaaccagtgagataggaaatctatagagtctgtgttccctggagtattgatattccctcttcattccacaggaacaagttcaagatgaagctcagcaccatcacactcagcattttctagaaaaaaaaatgttttttttcccctaggaaaaaaaagaaactcatcaatatacatcattagatttatatttagctaaagaaagatagtgtggattttcattacttttttccacaaatatgcatagcaggtttattctataaaaagttaagtagctaaaatatgtatcagagagcaattctgagaacacagaggatcaaatgagggtcactcacaaatctgctgcccagagacagctattgtttacttccagtctctttttttcctgtttgtttatttatttatttgagacggagttttgctcttgtcacccaggctggagtgcagtgacacaatctcggctcactgcaacctccatctcccatgttcaggcgattctcctgtctcagcctcccgatagctagaactacaggcgtgcaccactatgcccagctaattttgtgtttttagtagagacggggtttcaccatgttggccaggctgatcttgaacttctgacctcaggtgatccacttgccttggcctcccaaagtgctgggattacagacgtgagccactgtgcctggccttttctgttttatttttaataaaattaaatcttactatactgctaatttggaattctaatttttttttagaatatgtttccatgtcatgaaatatttttatatttttattagctgtataggattacattttatgtcggccataatttagttatggataaacactgaagttttcttccttggccgctgaggaaacagagttaggaatttgagtgcaactccttctgcttctccttctcatttctatagcataaaaactctcaaaactggccaggcgcggtggctcatgcctgtaatcccagcactttgggaggccgaggcgcgtggatcacatgaggccaagaattcaagaccagcctggccaacatggcaaaacactgtctctactaaaaatgcaaaaattagcctgccatggtagcacacgcctgtaatcccagctactctggaggctgaggcacaagaattgattgtacctgggaggcagaggttgaagtgagccgagttcatgccaccgcactccagcctggttgacagagcaagactctgtctccaaaaacaacaacaacaacaaaataactcccaaaagacacaaagaaataacagagcagtgatggctaccatgagttctgaacccttcctggctgtttctaagcagcccagatgcaaaatgtccaacaatacagtctcctatcagaaaaaaaaaaaaagtaacatttaggacagatgattaggaatgaatcatgaaaacttggcttaattttttcaatattattttgctacaaaacgtaaagaaaaacaaccctgtcttttactccctctgtcatacacaaatagaagtactagattgggtgctaggagcattcttcctttgtcaaatccaatgagactccgagtgctgggattatctttgctgctttatctgtgggtgccaacgccaccgtagatggcatttgcccattgcaaggctttatcagtgttagacactgctgtaggagacaggaagcagttccagggctaatggcaatgaaacgagggtcagtatttctttttcacccactgttgctttgggtgggttttatcacttgtgtttattttattattactgagtgatagggaggggagcaaataagagagttgatgctttgcttccgaaatctatggagcctcagcattgtattgaaatgtcactccccgctgtgtttcatgagcctcccagcgctttgttcctcgggcagtgctgatcattacttctgcaaccataaattttgcctcctcttctacaactattttatgtcagggaagatgaagtgaccctctatttctttgtacatttcccctttccaccttccctatgattaaaaatacatcttgggtctctgcccagggttttcatagggttgctttccaaccatttttacaaagatagttgactgtttcttatatcagatatttccagagaaagaatgttcttaattaagatgccattcctgggaaataatctcaggacttcctgatgcagtttaaacttgttccatctgtcctcttccttaagggtgctaaaatgtcatattttattaaatatttgttgaaaaacccagttgcatattcacagtgatatctttcttgtggccttttctgtactacagaaaatattagtcagacttcaagaagaaaagctctggaggggaagggggcaggatggattatggtaaaatactttggaaattgctagactaagcaaatttaaacaggcttatctattgcatggctcctgggatgtatggtgaatgcccaaggggagggggagaacatgagcatttcccaatcttatttgacacaggatcttgttgcccaagcacctactgtattttctaccattctaggaaatgcagtttgagaaatgcttaatcttttggtaggaacccaaaggactaagacaaaatcatagacttgggatttgcctttctttatcagcaccacattgcagctgataggggaaaaggatttttcttctgcctgtacctcttggtaagttaggaatagtagaggggaacgggagggaacctgggccaggagtgagcacataggggtggggagggggagtgtaggtgccatgggcagtgctcaccactgaggcactcaatgatttgaaaagcattggttaaacaaacgaaaatcaactgagttctcctgaaaagccaataagcatctggaagtctgtactaaggaattgctatcttcatttccattcttagagacacctacattgatgctttcaactctatatgaaagtcaggaagcatggcagggaggaagggaggggaaaagcagggcctacatggagagtctttactaggagagaccagcttcatggaaatgacattatgcccagaaatagatggtgtttttaaaaatacacataagtagagctttaagttaaatcttaatgaaagaaccaaatcagaaaaagcagactggtttcttttaaaaagagaggttccggagcccctgctgtggcctccaagaatctagggtgttttaggccacctacatgggttctgcagagtcaggagtttgcatgcatccatctctaccctgttagatgtacaatgtggctccccccagcaaggcctactcacctgccagtggatgccgatcagcactggaaatgaattcttgccacagtgatttatcctgtggaaccctaaactaaatgggaaataggcagccacagtattccccaataaaaggaaggaagcccagtgaaatgtcatattggcaccaaagaaagatactgggtttacttgaatatgcaaaactttggccaagaatataccagatttatttaaccacttcctcaagttatttttctgggctgaggcaaggaaaaaataaataccatttttcaagtacagttacacaagtaggtaagtatgagatatttgaggtagagcttttcattctctgattacagattattttaaatgtggctattaaaaatcaatttccttttttgatatgcagcactcttcgtatctacctatccatatgtctcacatatatatgcctctggccagtggagaaactgaattacaatgaaaaattatcttaaagatgccaaggcaggccttggctccctaatgctgagccctttgcactttggcagagaatttttgtcagaactgtcccaggtattcaaatgccattcttctgcattgttctataactccagctacagaatgaacacctgccaccacatgacccaattagacatcctagaaaggggtatccaatcttttggcttccttgggccacattggaagaataagaattgtcttgagccacaaataaaatatactaacactaacgatagctgatgagctataaaaataaataaataaataaataaaatttaaaaaataaaaataaaaaaagtttgtgcataattctcatgttttaggaaagtttacaaattcgtgttgggccacattcaaagccatcctgggccacatgtggcctgtgggccatgggttgggcatgcttatcctagaagtatctagtttgttatatgaaattgctaggaatgaagcatccatttcaaatagcctgctaactttagccttgctcaaggcatttagtccttttgtaatctcttttttgtcttatctgatttaatttgaacaaaccttactttacacttttcatatttttgttgcattttgttcaagaacattatattgcattattattgtatattgtaatttcttaaaggtaaaggcagcctctaactgcaaataaaacatctcaaataagacgtttcaaaaaataagaccaaataaggcagcatgttaggatctggcatcatatgtccctaatagtgtctagatttgttaatattggtaattcaagatagagttaagtaatgatatttatccagctaatggataaatcttcagcaggctccgattttgttgtatcatttaggtgacatctacataatccgatagcagatggctgatgagagcatctcagatagcttgcctgtgacaaacaagacaatatgtggattcagctaggtcaggattgtgtagaatcagccctagaagctgagaccaagacattgctgcataaacaggaggaaaaccactggtattctagcaggaggtctccaggggctgctggaccctccatagtcttaatgataaagcctgccttgtacacttaagcacatgactttttatggaagatgcatacccaagaatttaagtagtgaatttttttcccctcaattactgttggcaatcgaatgtacagttgtcttgttctccctctgccctagtttcctagaactactgtaacaaataaccacagactgggtggtttaaaacagcagagatttatggaggctagaagcctgagactaagtggtgggcagggccatgccctctctgaaggctctcgggaagaatccttccttgcctctttctggcttctggtggcttcagacagtccttggcattccttggcttgaagatgcaccactccagtctctgcctctgttgtcacatggccttcttccctgtgactccatgttctctcccttcttatagcgacactagtgattggatttagggcccaccctgatctagtaggatctcatttcagtcctcttctaaaacctaagcaaagaccctgtttataaataacatcacgttctgaagttctaggtagacaggagttttggtggacactattcaacctactccaccctcttaattctgcttttaatttttattttttattctttatgagacagagtcttgctctgtcgcccaggctgcagtgcagtggcatgatctcagcttactgcaacctccacttgccaggttcaagcaattctcctgcctcagcctcccgagtagctgggattacaggtgtgcaccaccacacggggccaatttgtgtgtgtgtgtgtttgtgtgtgtgtgtgtgtgtgtgtgtgtgtgtgtatttttagtaaagataggatttcaccatgttgaccaggctgatcttaaattcttgacctcaaatgatccacccacctcagcctcccaaagtactgggattacaggcatgagccaccgtgaccggcctccgctttattttcttagtactccttccattcatcattcttcaataactattttaaagcttattaagaataaattttgttaggaatgcctatcaggcatatgagttatataaagtgctatattatttaactaaaccattaactttctgataaaatgacaaagaaatcattttttgcactaagatattcctaaattcatctttttatagaaaagttgaaagcccatctaagtatctaccagtggggaatagtttgatatagaaaatcaatgtgacatttcccatttactaaaaataattttcagaactatgccgatataatatatgcatcaatgaaaatgcaggttatataacttctaataaaccatggaaaatatgtattcatgtgcaaaaatgacacaaaaatatacaaaaatgcttggttaggatagatggatcatttaatatcttgctttattgattctttaatgtcttgctttattgattctgtaacttgttttaagtaattaaagtattatctgttattcctatggaaaagactaccagttactcctcaaaaatgccatatactctcttcaggcccccagactgattatatgttattaaaaattagcgagtatttgtttcctaaccacccagtcctgtgtgttatcactgaaatgtgccattgggattggatgcttggcaaaacatatctgaagtgagaatgtacagagaagcatagaccaagtatatctcctccaaagaagggcagaaaagtttaatggatacaagttaaacctcactctgcctcataatggtgtggacaagtggcaagaagaggcatttgggagtcaggcacaaagagttgtgctaaaagtctaggttggtcaaattgtgtcttcatgtgctgaaggaccttaatcatgcccacttcatggcatcctgatgacgatgagaaagccatgtggttctcctaacacagcatcacctcatggttgaccagtgaccacagggcagaaggatgctgagtagaaagacatgaattggcatcagaggagtcttctgaacattgcatttcctctctaagcaatggaggtagaccctgtgtctcctccagacactactgactgaagagagatgtcagcaccatcagcaccactaaaagtaatgttgggagccaaagtattgccatgagaatcaccgaattgttgtgaagagagatagcagcagtatgaatgcagagatcgagttgccacctcctgcaagcacctctaaaagtaatgttgggagccaaagtattgccatgagaatcaccgaattgctgtgaagagagatagcagcagtatgaatgcagagatggagttgccacctcctgcaagctgccacctcctgagcctacttgaggaacttagcgtcacaaatgggacaaccagcctttatgtccctcaatgtgatgcatataaagtcacagcacctcctagaagtatccttaaagaaagatgtcaagagggattgctttagactaaaattgacttaagagacataattatcagagacatagtgtgaaatctggtaccttgattcaagcaatgtaactataaataggggaaatattaagatgggctgtgtattatatcatagtaaagaattacgccaattttgttggatatagcattgggatggttggctccaaattaaatttagagctgcagagacaagttattaggaattaaatgttctgatatatggaattcaccttaaaatatttcaatagagaggaaagagaaaaaatgaaaggaatataaaggaaatgtggcaaacaaatgtttataattgttgggttatcatcataaatatatgaggggttattgtactgttctctccacttttgtgtatacttgaaatgttttgtaacaaagagtttaaaatatataaataaattcctagaatattaacttgccaaaaataattgtctgtgatttttttttcctgagcaagatttaagaactaatttttccacagctgttgttgagaggcaaagagttcttagggatcatgggtgataaaaacagaccttctcacatgccactggtgggagaataaattgatgcaatttcggtggagtgcaatttggcaataactaccataggacaaatactcttacccatcattctaacttctaagaatctattctgtaaatatatgtagaggtatgctacgaaatgttcaaagacattcactacaatactttaatagcaaagaactggaaggacaagctgtctaccaataggaactggttaaagaaattatcaccattcagagaatggaaagtttaagcaacccttataattaatgtattagagctatattgccaatatgagaatgtttcccaagatatttgacattaaaaaatggtgcagaaaactatgaacccatttggagttttaaaaaatatcagaaaggatacaagaaatggataataatagttaccttctgggcgtaggattggcaggagagaaagttttcacttttcattttatatatttgaatgtttaccatgtgcagatgttattttattttatttgtttattattatttttttctgagacggagtctcactctgtcacccagcctggagtacattggcacgatctctgctcactgcaacctccgcctcctgggttcaagtgactctcctgcctcagcttctcaagtagctgagattacaggcatgcgccaccaagcccagctaatttttgtatttttagtaaagacggggtttcaccatgttgcctaggctggtcttgaactcgtgacctcaggtgatccacccttctcgtgttcccaaagtactgggattaccggcgtgagctactgcgtccggccaaccatgtgcaaatgttattttctgttataaaaaggaaaagaaaaaaaaattgaaacctagagaattatgtgccccgtgtactgagaatgttatcttaagaattatcctaagattgtaattaggaaggcgattctgttagggaaaactttataaacttacacagtatttaaaatgtataaattatggatggtttcaagttaacaagaataattttgccttctatagtatgagtaaattgtgcacgattatatgaaactctgaaagtacttggaaatcttcaaatggcattaatataaaatattaaattctactatcttttaagttcaagttatacctgagaaaacactagagaaagatttcattttgtctaccatggaaccaaaattggctttgaatatgtattatccttctgtatcgaaaaataagacctacctgcctcaggtactttttgtgttcatcatctcattgaattatcatgattattctgcagggcaggtggtatccaccctaatttccagataaagaaactgaggctggggacattaatcaacttgctgaaagtcacacacaagtgaagaaacagtctagaacccacacacttcactcagtttgtcctgacactttgcctccttcatatcaggaaaaactttgtatcaggaaaaactaaataaaaaaatcatctggtctttggcccttgcttttaactcctttcttgttttctgcaactagctgtgccttcctcagtgtgtcttatgtcctaggaaaagattattaacagaaagcacaacaggtatccaggattgtagtttattaagcagagttttaatgaatattttcagtaaaacagagaattaacggctcattgggtttttttttcccctagatatcgtggatgctttatcagatccaaagaaatttctctcaattacagaaaagagagcagaccaaatgagagctatgggcattgaaactgtaagtagaaatggttgattaaaggtggccaagttgtgggagtttgattatcaaacagtgtttacaaaaacaagacaaagtaatgaattagcaaatttaaggagggtttttaaaactgagctcatcaattcaacaatagttaactttctacaaaagtgtggcatgtttaataaaatgtgactgccatcagaaaaatccacttcatcatcagtggcttaactcacatctggggaccccttccccattagaaagaaaatgcaaaacatttgttatacttttgggaaagtttaaaatgtaggtggagcatttctaatcagaaaaatgcaacatccgaaaagttccaaaattcaaaaccttttgagtgctgacattggatagtcatacctttgctttttgaagtttcactgtacataaactttctttcatgaacaaaattactaaaaatattgtataaaattaccttcaggctgtgtataagttgtatataaaacataaatgaattttctgtttagacttgggtcccatccccaggatacctcattatgtatatgtaaatgttccaaaatctgatatccaaaacatttctggtctcaagcatttcagataagggatattcaaactgtactgtacaggatgtttctatgatacactgaaataccagttaacctagttcagtgaattaatgataattgctttttatttttaattatttattttttaacagataggatctcgctctgtttcccaggctggagtgcagtagtgtgatcatagctgactataaacttaaacttctgggctcaagccatccttccacctcagcctcctcagcagttgggactacagatgcatgccactgtgcctggctaatttttttactttttttgtcaagacagggtctcactctgttgcctaggttggtgtcaaactcttggcctcaagcaatcctcccaccttgacctgccaaagcattgaaattactggcgtgagccaccatgcccagccaaaatggcgtttattattgatttttcactgtttgccagccttacatcccaaccttctcccattccagtgcacacgtggattgtttctttgtttttaaatgttctctttaccagactcctcagtttggaatggatgtagcatctctccaatagctagaaaaagagaaagtattctctgcttgttaagaagttggatcttctttccttggctggatcctttgcctttaagagagtagaagtctaggaagagtatggtagaagtttactggattcagtaaaataaagaatgtacaagatatttgaccttgagtgacattcatttgggtcaatgtaaatgtttctgttccagagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtgagagagagccgttgggttccttatcttctgcacccaccttaattacacagtgtacaatatctatagctttaggaaatatataaattcgaagttctttgtgggaaagaaccttttacatagtgatgttaactaattcatccccactctcttccagaccctcccataggtagttacctggacaggccgtgggctcatgaaccaacatagttattcctattggacatttctaaattctcatactgataattttccctcataagtagaaacatgattatttgtttgtaaaattatcaaatgagcacttgaaggccaattccatgtgcttacctgtagatgaaacaaaagatcattaagaggtggcatcacaaagaatcacgtgtctcatattcagccagtatgtagggaaacaactgtgctggttattttaattggtttccatatgaattggccagacatccattgattggatggtgcccattccatactggagggaaagtgggcagggagaatgctgatagggagtggcaaggagttcatttttcttgttctggaaagaattctggggtcatcctgagaaggtcatgggaaatgagtcaaaggagtatttgaagaaaattatagtcttggcagaagaattcattgaaagtgggcatgctaagggcaaggtaagaattatgatactcatgcttctgttataacacacctatcacattgtgttaataaagtattaacaaccagagaaagaggttattgcagatgagaccacacctcatcatcagtgtgtccctggaaccatgcctagttaaaatctagtagtctattttctcaggaagtaaagcgctgtttaatgaatgataggggcaaggaaatctagattaagttggaaattgtcaaaaggaaggaagaatagaaataagttggcagcttgaggccaggtgcagtggctcatgcctgtaatcccagcactttgagaggccgaagcgggcagatcatgaggtcaggagatcgagaccatcctggctaacatgttgaaaccccgtctctactaaaaatacaaaaaattagccaggcatggtggcgagcccctgtagtcccagctgctcaggaggctgaggcaggagaatggcgtgagcccgggaggcggagcttgcagtgagctgagatagcgccactgcagtccggcctgggtgaaagagggagactatatcttaaaaaaaaaaaaaaaaaagaaagaaagaaataagttggcagctttgatatgggccttaggcagaaaggggctttttggtaactcagacttcaaggacagatcccagagatagattgtaccattgagagaagtagaggagttaggaggaggagctgcttttggtaaggaagatgattttggttctgtatatcactgaggacaagctgttgctgatacatctgggcagaaatatgcaattaccaaatctatatcaggtggagaagaagaaggagggacagagaaacagaataagaatacttagaaggcagaatgaatggggaaaaaagagaaaagagagatctatgttctaagaagaattagttttgagaagatgctgtagacaagtccagagaagtgaagactacaaaattatagttgaaccaggggtgattggatgatgaaggtagaaacatggttaaaaaaatgtgagacataatttaagacataaaatggttgttctggaggacagtagcatgttggtaggaactaataaagaaaaacaaggaaaatgcaaaagagagtacatggtaaaacaaggctataaggaagatctgaatcaacagaaagggtgaaattcagctggataaggaaggaagagatatgttctgtctgagctaagaagaatgatgagtgaatagaagtttcaggatagacaggaagaattcttgacagacggtgtatcagtcagcttatgctgcataacaaatgacctcaaattttagtagcttaagacaaccaccatttattgagatcatgtttcattgggttggttggtctaagctggcttggctaatctctgtgtcttgcttatgcacctgtgatcagctgataggttgactggaaggtagatgtgggatgaccttatgcacacatctgtcatttggcaagttgtttcacattatcctgaagcctgagcaggcttgttcatatggtactccctgagtttaaagagcagcccttttccagcctctgctagtctcccattggctacagcaggtcacaaagtgaaccaatattcaaggggtagagaaatagactctacctcttgattagaggagaaagaaatagtggtcatttttgtagtataacacagatagattttatctgatctaagaagttggttaggtggctgctctctgctgagaaacgtagaggtagaactgaaaaacagcagtatagaaaagctttggagttgcccctggctggaatagaatgatccacaggaaataaggagaaggtctgccacatagcacacaggaccctggtgagggttggtggtgtgtactaagttgatgtagcttgatctcattacttcttcagcagtgcccagaaactcagcaacaactgtggacaaagtacagcttagggagttgcaagcctgaaattatcacaatttatatggtctgggaccaaaagtttgaagaccattaagttatgacactgtaacagttggctattgatgtgtaacaagcaatcacaaaagtcagtaatttaaataagtaagcatctattatagctcatgaggttgtctgggtggcttttctggttatgggaggattagtatcagtgactcagctgatcttagctatgcttattcaaatgtttggggttcagctaaagtgtcattggctgggacaagtgggctgtcttccttgtggactctcatctttcatcagcttagcctgggcttgttcacatggtagttgcagtgttctaaaatggaggtgaaagtacagatgctccttgacttatgacagagttacatcctcataagctgaacatatcattaagtcaaaaatgtgtttaatatctaagctaccgaacatcatagcttagcttagtctagcctattttaaatgtgctcagaacacctacattagtctacagttgggcaaaatcatctaacacaaagcctattttataataaagtgttaaatatttcgtgtaacttattaaatgcagtacagtgtagagtatacagctgattgggagctgaggcttgctgcagccccagcgcatatccctagcttaggaaaagatcaaaattcacaattcaacatatgctctctactgaatgcatatcacttttgcttcatcacaaagttgaaccactgtaagttgaaccatctgtatgtcaggttccttgatgagtcctagacttagaactggcatggcatcctttccactacattctgtcatcccaagcaagtcacatggcccagctcagattcaagagttggggaaacagattccacatattgatgggagaaattccaaagtcacatgtaagtaggtgtggaaacagggaggggtggaattttttggccatttttgcactcagtctgccaccctgatcataatatataggttaatgttccagtggggtagatactagaggagagagacttttctaggaaaggaaaaggttaaagggaaccaggaacaagatgaaagtaaaaagcttgcttggtaggtgtgagggagtgagtgaagttggcaggatggagattgcagtcagaaagaggttactctaagctacttgtcttggaggaagggcagtttcaagcagtgttaacatcccgtttacaactgtcagtgggaggtgaggtaaagtagagatgaagatttctagaatggaaggcatcatgaaaacagaaagaaaagtcactcagcacattcttctcatgcatattgaatcactgtgttggacgtctgggaatgcctgcataggaaaaccacaattcagatatgaagttcatggggccgggcagtgtgtgacctaaaaggacacatgtggaggtagttaggctcagcagagcctggtgtaagtgagaggtctgttcttttgtatgatagtttttaggagaatggcatggaagtacaagagagaagtctataggtgttcttcccacgcctctccatggattggggtggggtggggaataaactctactccaggagcctttgggggaagtgatgtcatttgagaaagcaagcctccatttctttccagaaaactgtcttaatttgagtcaccccaaagaccctgagagaaggcttccagtgcaagtagtttattctgggaggcagtggacatggatagagatgtgaagaagtgacaccagggagggaaggcagccagtaattagaatgttttaaagccagttgccagtaggcacctggaacttaatgccctggagaaactctgggggctggtattggacatacttctcagaggtctcctcttagagggatgagggagctggggaatgtataccctgactcctgtcagccttttcttgagggttcccgtggaagggataaattctcggcattcagacgctggcaattggaagtgaactagaagagctgatgtagagagggcatagtgtgtggctggagcagacggcatttgctgcagacctctatgaaggtggggaggtgtgaaattccaaactgtttttcttagacattcagccaaacagcaacaactgcaccaacacgactttttttttttttctgattttaagaacaaaggattaagaacacccagctcctaacttccagattagcaattaagagaaaacaagttattgttaaggaactatgctgatatgaacaaaaactttatgtagtgaaacttcaattagctaaaacccaaaatgtgctgcctaacctactttcataccagggaagcctgtagacctgcacagtcctatatagtagccactaaccacatggggctaccactaaccacatagggctatttgaatttatttaacaattaacttaaaagttaaaccttgagttcctcattcacactagccacatttcaggtgctcaagagccacagatggctagaggccgtcagttggacagacccacgcatggaacattcccattattgtgcaaagctctatgaggaaggctgttcttggcacgcagatggaactgtcctcttctgtagagtgtggtttttttttttctaactaaatcacttatgggaatcaacatttttacaaattgtgtctttcccccaaaacacaaaaccaggtagttgagggaagtttatgtttttgtaggttccttttaatcaagacttagttgaaccaagacaaaaagaaaataaaaattgagagagagagtgtaagtttcatcagactgggtcaaactcagaatttgctagatctctggaggaccttgcatactccccaaatcctgtatgttcattttacagatgagagagctgaggcctaaagacagggagctctttgtgtgccaggagtcactcccttgccttaccctgcctcagtcactagagagacagcttgtgaaagccaacttaggagatcagtagagagccccatggaccctttataccccgatcataaaatgttacagatcacaaggctgatttccctcagccaaaactttccttctgcggcctgaccaccctatcattgaatgtgcacatcttaaaatgaataaaagggaaaaacaagagcctgggacttgatgcctatctttcttgaatatatcatacctagcctttgggattctaatggaaatcaattacagcacagagtacacattcattttgtttgcctaagatgaaaatctgcagtcaaacagaaactgtttgaggatctggctacaactgttgttgccatgacaacacctggcctagcatcactcagatagcaggatgacttagtgtattaccctagctcctcctggtatgctcctgttatacactggtttgattttattatttcctgtatgtttaaggcattgctgtgctcaatagcacattgcttaaatgctaagattgaatttggtaaaagggagaagccagaaaaaaatgttttattctttcacaatgactgaattgagaatagagttgggaattagttgactggcatgatatgccttgaaatacaaaggtaagaataaggataatagatacttttgtgcctgatcagctcccctttatgggttcactatcccatctcacagctcctatgaattttggctgattgggcatttcagctgcccttctccatagaattgccctgggaccatgagagttcccttgcctgaaaggttttgtgaaacctctgtagcactcagctgattgatccagggttacaaatgcccagcctctttttgccaaggtggaatgactcttgggtgccatttgtactgaagagctccctgcaggatcagactgaggctggatttctactggaaacacaccctaccttgttcctctgccctgctccacttctttcattcccttaggggtttctcctgagagtctgccctcaatcaatcacttgcacatgaatccccttctcaggctctgcttgtaggaaacctgacctaagttaagacattcaacatttcaattgtccagttaattgctttgtaataggaacttaagatgtttatattcatcatatgtaaagctgcttcaaagtctttcgatgagatttcgatatgtcagttctatattaccagttattctctctgatttttagtatacatagtgacttaattttttttgtttgtttaggtattgaacttatccctcaagtaaggatagaagacttaaagcagatgaaggtaaaattgcttgactattttgcaagcactcttgtattacacatattggtgacaccaatatatttttgtttctcaccaagtgtaatcattgtgattacaaaaagaaaaaacaaaaaacctatttttgattctatttttctcccaaaggcttacttgaagcatttaaagaaacagcagaaggagctaaattctttaaagaagaaacatgcaaaggtacagtgctctacagctactattttgtgttatgtatggatgaatcatttgtagccaaaaacactactttgaagctgataccagaccacttaacagtaataactcattctaactggttaacaatgaaattaaaaaatagaatcggtttgggagtgcttgtcacttgtttgtagtctgcatttctaacaattctttcaaatgcataacaaagcttcatccatttaaaaattgtttcactaggccgggcacagtggctcacgcctgtaatcccagcactttgggaggccaaggtgggtagaataggatgtcaggagtttgagaccagcctgaccaacatggtaaaacctgtctctactaaaaatacaaaaattagctgggtgtggtgacatacccctgtaatcccagctactcaggaggctgaggcaggagaatcgctttaacccgggaggcagaggttgcagtgagctgagatcgtgccattgcattccagtgtaggtgatagagtaagactccatctcaaaaaaaaagaaaaattatttcactaataacatgactatataaaatattgaagaccagctcacaattctagccactagttacctaaattgccaggtcactgtcacatagtttgccatacacactggtgcatggagggagatgctagcaatctgtcaacctcccactcacagcacctagagagagaacacttgtcactttttctcccttatgtaaatcttgcccagtagcctacttctgaaatagatttatttttgctttttacccataagaagtggtattttgacagtgattgtgaaaaattacaagagctagttgcaaattgtaagagaacagcaggaggtggccccaggaattctcctgtgggttgaaaaacgtcatggccctcaaacatcgtcacttccagactccctcacaggtaaagaagaaaaaggtagtacctctttccttcctaagaacatataataaccagctgctgctggtaggataatgtctgtcctcttttattaagggcaatgagagcaagagaaacttaatttataatttattaatttgaaagaacttctgagttcttttaaactaatcttgcattcctgtttctttattctctgacccaagcctcaaaccaaggcatgtccttcagaacttggcttgagtgatgtaccttttaatcattccacgtattgagatgccgagaacattgtctggaaccctgtcccctgtcatttctttaagagtttgtgctaacactgattttttgagaagtcatttctttaagagtttatcctaacactgattttttttagaagttaggcctaatcttatcctagtaatgttccctgtattacagaactgttgggctcaatggatttgctgatacagtcacttcacttcaaagactgtttctaagtttcatgaataattccattcagtgaaattccttacattgctcaatggggttattggagacagaacaatttaaagtaggggcttcaatgttgttggttattgacaacaggctgaactatggaaagccaacagaaaaagagtaagaatgagaaataagagagaaagcaccttaaatgactttaattatttggaatagagtggatgcccgtatgctgcagcactatctaacagatttttcttgcatttaaattggatctcttttattgagcagacacctcagtggcctttgggctagttggaaacataaagattttggcttcatttaatattttcttgaggcatggccagaaaatatgctgtggcgggtggtaataatagcagcaataatagcagctagaattcctgcatgctcagtaattctcagatgctgtgctcagcaccttatatgcattgtctcatttaagactctaccctgtaaggtaaattctatgtgagtctccatttatatgtgagggaattaggaattagtgaagttatctgatgtcccagagttaggaagcagcatagctgatatttgaaccaaaatcaagagtccagaatccatagtcttgcaccatactcctgtgtaggatatgggatgctcactaagtggacaagttccctcattgggtcaaatgcagtgacagcacatgggacattagggaaaatcactatcaactttgggcagtgttgatatactgctgattatcaggactgtgactaaggaaggatgcccctcaatttttagaacttaacctacatcagagttgtccattaactccctggagccatcatgcccggcccaagctaacttctaagatgaagaatataatgaatatttacttgcctaatatacaccgatgccagctctgttaacatattgtctttaggcgagacatggtggctcatgcatgtaatcccagcactttgggaggccaaggcaagcagatctcacctgaagtcaggagtttaagaccagcctggccaacatggcaaaaccctgtctctagtaaaaatacaaaagttagccaggcatggtggcaggtgcctgtaatcccagctacttgggaggctgaggcaggagaatcacttgaacccaggaggcggaggttgcagtgagctgagattgtgccactgcactccagcctgggtgacaagagcaagactctgtctcaaaaacaaaacagaacaaacaacaacaacaacaacaaaaacatgttgtctttaaaaccaaaaaatgaaaaactgtttaaggagaggggaacaatgtggtgaatctattaccattggacatacttcatgcctgatctccatatgacgtgtttatcctaacactgatttttctgtcagtcaacacttttaaagtggcaatactagcttgtacatattgatacttgcttaagcacatattcttaggtattctcataacagttatataaaggagtactataattatatgagttttgtatctgttagcttttgcagggtaacaaaccaccctaaaatgtagtgacttaaaacaatgaccatttatttggctcacaattttgtgcatcagtagttggagctgggtttagctggatggttcttctggtctcagctgtattcactcatgaatctgctgttactaccagtttggttggcagatgggggactggctgatttaggtcagcctctgttaaaccacttcctctctgctttatgtggtctcctgtcttccagcaggctagtccaggcttgttcacatggctggggtcctgagagaccaagcagatcaagcatagtttcttgtggccccagctcagaactaacacaccatcacttccacctcattttttggccaaagtaggtcctaagtctggccttatgaggtctctaccttttgacaggtgacaaagttacatcagaagtgggagtggatgcagaaagggaaataactgtggccatttttatagcctaccggctattcaacagattagcttattaatacttaaaaaaacacagcttcattaaatcatctagtttttaagtggtggagtcaggatttgaaccaaattcagcccggcttgagaactcagacttgtaaccactatactcagctgcctctgatgtttctcacactaatttttcttctcttcacacatctttttctttatggtctcactaacaggtttttaagagcaatcatgaacctatcagggcacaaatatcttgggttccttcaggactggtttttcaacataaggtcattgggccaagagctggaggctttacaaaaatatgtattcttatgcctatctgacacttagctatcatctctaagaaaagaatataggaaatacagaaatacattttagataaactcctctcctctgcatgctaaattttgaggactgtttttttaggaacattatgtagcactttttactatcttttgagcccttagtagaaaccccactaatcgcctgcaaagacacttatcaagcctccttaaagaaacagaggttttatcctcttgccacataatagtaagaattaattcctacatcctttctgtgaaaggacatctacagctcttttataatagttttcagccacccaacatggagctaaggcttaccaccccaaagccttatgtcataaaatgacctgctgatgaagaaatatgacctgggctgcactctccctactagtgtgcccctggcccaaacagcccttggtagctaagaacagggactattatttagtctatatccagcaactgtagggagatctcagctcttacatatcagcctagatcaagcttgtccaacctgcatgcagctcccaggccacatgcagcttaggatggctttgaatgcagcccaacacaaatttgtagactttcttaaaacatgagatttatgcacagactttttttttttttttctctcattggctatcattagtgtcagcgttttatgtgtggcccaagacaattctttttccaatgtggcccaaggaagccaaaagatttgccactgctggcctagataaataattctactttttagacttaaagagaagcagagaatctatgaactatatctcagcagtttaagaaataaatgtatggtcccaaggagagcttatttccaaacttgcaggttagctaccagatagaaaggaacagtggggtgagtgtgaggttctgccatttgcaaataggtgtgcaatttgctgttaggatattgagaagaaaagatgggggtaacgaccatttgcaccccagatggatataaaaatgctcattaaaatgtctatttttggaaaatggcaatgatcaactgcatttgaccctctgaatgtactggcaatcaaacttctacttgtctcatactttctagaaccacttcaattcgaaatggaaactagggtaatggtttttcaagtgtctattatatgagacacagaaaaaggagaattaattaacaataatcctcccccagcacatgactcattgggatccagagctgcagttactttcattaagagacaggcatgcttttcaattgtccaatgaggtcaattccttagagccaaaaatgtaaaacccaaagttggatacatatctccagtaacgtgttagaaggggaattacaattcaaatgcctatggggtccaagcaggaagtagctgagggaagttggacaggtgttgactccataaaagctgggagcactcatctctatccacaggccaagtcagtctgagctaccaccattggtgcctggagagtagatgggtcagtcgtgtcctcttaaaggagagtcaaaaaatcagaaagcttatctgaatttcctgatcttttactatcggcgtctaattcaacctctttttgaaactgcgtaggaaaaaacaaaacaaaatccaaaactaaaaactacatctgcaggcaggatacattccttaggccaccagtttgcagtatcaacattaaatgagtcaaatgaaatgcctgagaagcctactaaactctggcatttttagtaaagctactgatggaaaattttctctttgctatgcaagcaatttagccgacagcaccaagactgttgttaaactcatcaattttaattcatggtcagaccttagtaccagacctataacttagttttgcagtggaaaggggcagagacacagcagttgccctcagagtccgcctattggtaatctcagagttacatgctgagcaaacatgatttactccaatttttcagcaccctctgtggtgcgatcattcacgcccatagtcacatcagtcacaagaatgaattgcagcagcagttttccccaaaagaagctgaatttactcttaacttggataagaaacgtacacaaattcttctgaatgctatacatgtttttccccaaaatgtcccagttaagatttactttaagttaacacatttaattttggtactcttggcttgaatgaatgagaaatgtatgtctcttcaatagtgtttcatgatttaactaaggaccaaaagaataaaaccaataatggacattttttttaagctaagatggacttagagatcatttcatgcctccttcattttacagcacaatgagctgagacttgaccagagtcacatggaaatcagtaattaggatccccatttctttctgaaaggacaagtggtgtctgggaatcaagttatcccaaaacacttcagcaatcactgcctaccacacagggatggagttttgaataaaaagagaaacagagacaatttttcaggaccagctttcctgttactgacattaattatagtcactttaattcaatatgctttcagtttttcaaattatttttgcatatgtttagtaaccttgcatctcataagcaactcatgaattcggttaggcaaaggtacctaactcagttttcttttcttttcttttcttttttttttttttttttttgagatggagtcttgctctgtcatgcagtggcatgatctcgactcactgcaacctatgcctcccgggttcaagcaattctcgtccctcagcctccagagtagctgggattacaggagtgcaccaccatgcccggctaatttttgtatttttagtagagttgggtttttgccatgttagccaggctagtctcgaactcctgacctcaggtgatttatgcgcctcagcctcccaaagtcctgggattacaggcatgggctactgtgcccagccctaactcagttttctaataaagacattgaggcctgggaagatttatatatgttacacaagggcagttgtttaattattggctgagctgggaccagaatctaagtcctcttgctattttcctatgctgactttttattcatgcgataaatacttattgagcatatactttgtaccaggctttgtgccatgtactggtaaagagaaaagacctgccctgctcttgtagagcatattacatagagttgaatccatcataaacaactttgtggtacaaagagccctattcctcatatctaattggattaataaggttcaccaaaatattttcttaggaaaaaaatctgtgtcaatttacatccaagcctcaaagtctctacttgtcctgttctgcactaaaatatttaaagaaatagccttcaccctcctttcaatgatatttgcaagataatataggactgtggcacttctgatatattttgagacctgcagaaagccccttatttatttaattttttgcccaggaaaaattaacacatgggttagccaaccataatgatttctaaatcttagaaagaagactaggaggagggcattttagtaggtaccaaagtattacaagagtagttaaatacattcagggatacatcaacatgttcctctattcctggggcagtagatcaagcatggaggaaacatttattgatttaattagtctgattgatatccctatctcaagtcactctctgtgtgttatcatgggtattgaatagtatagataggtttgtatgtcactgtgttttgaataagctgtaacacacatttgatacattagattcacttttaatcctaacaaccctatgaagtaaatgtcactatcccaattataaagatgagcatactctggaaaggtaagtgactcaccccagcactgaaaaacccatgtccttaacccagtgccacattgcagaagctctggaggaaatgtgtttatagcacaaaggtgcacacacattggtaatatggctagatttatggggcattccaattacaaattaagcccagatccacagcaagcccacctagcctttgttcccactgtaagttcctatgttgggaatctccctatccagcatcacccttctccactccttctcctaaagacaagaatgctgaggccttgtgcatgaatgcgtttctaaagaatttatatataaatgaattgtagatcaagtcctgtgttaaatctcttagctgggaaattaaggaagtcttggtaaagacttaaaaattccttccccatttatattttatgaaaccgttaaaagaagttcatgaattagatttgcataaagtcaagcctaccttagaaagaaaataaatttgcttttaaattaaggcactattttcttcaataagtgaaaggaaatatgacggtgagaggggttatataacctgaacaacatgtacacccattccagtcatgaatagcatcccatttttctggttctcaagagtaaggttaggctataacatcaagtgtcatttagagttggaaatttctgattgtactgatttcctctgtgcttgggaggctgagcagctaaagaaatctgatttcatataagtcattggctgtagctaaatgcctttttcattgtccaggaagaaataatgtttatattgaaatacctactttccaaagcattgcagccccaatttcaatggttacgtgaagcagatgggaaaatgttttaaatatctgtaaaacagaaggccatagctcctgaacactttatcctcataaactgcttctagataagtaagccagtgaaaatattaagtgatgtagattcaaattcagctgatggtgacaaacacagtgatgcctctcattatataataatggcattcaagagctccaaaatgtgcaggtgtttagaaaccatgtcacatgatgaatagttacatttagcatatacaagagaagaaacatggtggctgaacttgcatgtttgaggaccaatgtgtggaaggggcagtaggctaattacatgtctcaaacagcagaacaaagatgaatgggtggaaatactacagagatgtgtatatgtagaagaaaggacttcgagatgattggcactacccactgctgagcaggagtgcatttgaactgggcatgttcactagactgaggctagagactcccatgttgggaatgcccttggacaaaaaaaccggtgttgaatgggagatctggagtctgtactgttctcagatttggttattccttgactttctaaatgaagactctagggaagctggtgaaagttatgccagccctatatggtgtgagccatgctaagagtccaattcataactgcaaatccttcttgttcaggaacacagtaccatgcagaagttacactgcacgcaagttgacaaaattgtggcacagtatgacaaagagaagtcgactcatgagaaaatcctagagaaggcaatgaagaagaaggggtaatactgtttatttccttctgaagactttctctatgtttatattttgtcttttcccacagttttgctgctgtttaggtcaaggaagaacttagtgttgacttgattttcatcattaaaaattattcctgggaagtaagaaactcattcattttaaatgctctaacatcataacaggtcaatgagtggatgtagcttctggtttggggaaggttctcagcagagattctgatatcttttaattcatcataattatttctaatatgagaaagaaatcttagcctcaaataattgaaaaaatacctctttactctgagaattgattgtcctttttgattttgaactaattttaaatttacagaaaagtttccaaaatactacagagttcccttatgcccttaactcactttccctaaatgttaacatctcacataatcatagtacagttgtcaaaccaggaaattgacagtggtgcaataccattaaccaagccacagtgatttttcacattttaccagtttttccacaagtgcttgttttccactctgggatcacctccaaaattaaatagcatttagttgtcatctcagtatgtgataattcctcaatctctccctgtcttttgtgactttcacttttgaagagagctggtcagttgttttgtagaatggctcttcttttggatttgtctgatattttctcatgatgagagtgaggttatgcatttgtggcaagcacaccatggaaacaatgctgcttccttctcagtccacgatattggggggatgggggtgtgacattgatatgtcccattattggtgatgttaacctggatgacttggttaagctggtatcttacaggtttctgcactgtcagattacttttttccctttataaatactttggggaaaattccatgagaccacgcatacattctatttatctgagaaattatttttcctgcctttgaccttctccagggattccctctggtttttatctctttccttcaatctctgctgatgtcttctagttttccacaacctttggcacaagagaaaaggagaatgagatttctttttcctacttgggttttttggcatttggtttttgttttttattttttgttttaacagtcacccaagatatacctagaaaactaaactctgaaaacagaacagattatgttagttataattttcttggacattggttcatattgccgaaatttcagatcccaagatctaagttcatgacatgaaaccaatgtaatttgcttgaggagtaaatggtgggtaactaaaatgcctgccctggtatcaggcctcactatttgagaggtaccctcatttttattaaagttgtatttttcagaaaaatacaaatcaggcactgattattgagcatctgttattatgcatcatctgccttttgttttccccgtaggtttcactgtgtattattgaggcagaaatgtgcctgttgcttagaaaacattttgatctgtattttaagtgagtaagtgagtcacccacctcggagctcatgtggcaatattggtagtgattacagtaagttttgaggagctgtgattcttctagattctaaccacatcagctttggcctatttcttttttgtaaattaatttctcatatttaatgacattttaggctataatattgaaactgatggtagacagactctaataccaaggagcaaattgttgatgactttatagtactctccaagaataaggttatttgtatttacaagatatcttttcaaaaaatgtttcatgcatttttgtggatcggtgtatttagaaacacagttttggcttaaccaaaccaaaaatttttattaaggagatttcagatccaagcaccatagagtaaatttctttgctaaaaataatattacagttttctgattcaatcaatcatgagtgctacctttagaaatttttaaaaaattgataaaatatatctttacctcatgattgtttttactctcaaagataatgtgggatcaaaatgtaatttattataaacttggtaattattagaagtgtccctggtgtgacacttaaccccccaaacaggctattgagtgctcttggaggtctctcagcaaataaagccctgttttatcctaaacgtagatgagactggaaaagtctaatctgtagatttcttcctgagcctctgctgtcaaacgcagcactcctagcaggctcttcacacagagcatttccaagtactctaaagagtagaatcttagcaatacattaaaagttacttcaaaatcagacatcagatactttcttctggaaagccatatctgaggagagtttctcatcattaatattcaccatgatatcaaggttgcctggacttagtcttgctatgttgcccaggctgaagtgcagtagcacaatcttggcccaatgcaacctccgcctcccaggttcaagcaatcgtcctgcctccgcttcctgagtagctgagactacaggtacatgctgccatgccggctaattttttgtatttttaatagaaatggggtttcaccatgttggccaggctggtctcgaactcctgacctcaagtgatctgcctaccttggcttcccgaagtgctggaattacaagcgtgagccactgcacccagccttcctggacttttaactgcaactgagttgctaaaaagttagtgaaaggggaaactgtgacagtccttggagctttctcatgcaggatctatttttgaaacaaatgaaaggtttccccttactcttacctactcagctgaaaggaaagattgacctgggaaagggaagctttattcaagtgcttccagctttggctaatgactacctctcatatgctttccactcaaggatctttaaggtgatggtaaaaagatgaatgggggaacaagggaagacaagctaaagttgggaaaattctaaattacagaaattattttgcatagcccgaatataaagaaggttgatgcactagaaaggggaaaataaaatcttgattttcaaataaatattacaagtgcatgcccttatgccctcagatgagagtgttgaataaaacctctcattgcatttactgtgaaagatttgtctagaattaagtcacgggaatgtttcggcagtgctgcaaacttattgaataacagaagagagaagaaacttgctcagtgccagccattgagaagtgctagatttgatgcgagaccttgcatttttagagtaatgcttctctcacaggaacttggaattatattataaggaagcattctgacttgagctataataacctagagtatacatgctgaagatgaagctcaggacctgttcttgtttcagcagcgatgtggatattccaaaaggaagacataatcactgaaataagcagtaatagttgctgggcactcgcctagcatatatttcctactcacaatagaataagaagcaaaaattgccctgtggtgccaaggattgctattttctccttcactggcatatttaaaagacaaaaatctggctttataatgaaatggaagaatgaaaaattcacttcaagtctgaggacctattttccagttttcatcccaaataatattttattgaataagtgaaaaatagcttgagaaaaacaggaaccaaaatggaaactgacaacagccccttaatgatgaaataattgttaggtttgaagtgcctctttgtatagtggttgaattgagtaatcatgaaacagataatattttgtaaggtgtgaatctattactagaaagaccagtgttgcccaatgagccatgacatctcatatttgatgaatatattatcttcatcagaaagctttgtagcaaagacccatgggaatgggaaaatatctaatttctggcatgcatttgcaactttccattttcaggggaagtaattgtctcgaaatgaaaaaagaaacagaaatcaaaattcagacgctgacatcagatcacaaatctaaggtaagaaaatgcccatttttacagcagtgacttgcagaagacactttgtaattttttagaaggagtacctagtgtaaattagaaataacagtagcccagagctggtctagtagcctgcagctgatctgggatgtcaggggagcccagggttcatgtttgcctcagactcactggctttaagaagagccatttcatggaacatcttcttttgtcttgtctgttgaactatgctaacaatatttatgttgcctgcctcagaggcatcaaggaaaataataaatgaagatactaaaaggaaatattatataaaatacagaatatacttccctatagaaataacattaaacataggacagaaaaccgcccaaattgggaggtgatacttactccatcctaactttacatggaaatttggaatgagaaaaaattaagagctgatattctaaaagagaagcctaattactcacattttcttaaagacaggagaaaataggagcttgagagactttaatcaactttgtgggcatttggagaactaagtgttaagtcccagttaagaatgaaaacaattcttccagcaatgatagtttttaaatgaaaaggaaaaaaaaagaaaaaaaaaaccaacaacaactgttaaagaaagctcccaaaaatagctgtggttgaaccagccagcctcatctatctatatgcagctgtgtcatctggcctaatggccctgctgcatgcatggagcaggcaagatgttcaagatgttcttggtagctgtatgttttgtagggcatgaactctatagaggcagtaaggcatgtgtctttaagagttattccccactctctctcttcttaactggaatgtttgagaattagtagttgtgcaaactgtcatgattcttagatgcttggcatcaataagaaaagccttggcaacagtatcagtttgcttttgctatataatgaactgtgtcaaagaagagcacattgaaacaactactacagtttattaggtcacaattcagtgggtcagaaatttgggccatacttctgctgattttggctggagacacttgtgtatctactgtcagcagggggcgtatggccttacttatgtatctggtagttgtctggctgttgcttgttttcctacatgacctatcaacctccagcaggctagcacaggctcagtcagagggtagccacagggatcccagcatagcagaagggcaagtactttccagcctctgcttgcatcacatttgctactatctcattggctaaagcaagtcacaggtcacccagcttcaaggagctggagaaacagactccagctcttgacaagaggcactgcaaaaccccactgcaaagagcttggatattgggtggggaggactttctaccctagtgtctatcagggttgacacagtaagtcatgatccagaaataaaagaacacacagctctctattcagacatgtgggcttgtggacatgaagctggagaaacataaggtgataaagaaaatcctgatggaattggtaaaagagcctaaggcccacacaaatcagagtgttggctgagtgtggtggctcacgcctgtaatcccggcactctgggaggccgaggcaggtggatcacctgagatcgggagtttgagaccagcctggccaacatggtgaaaccctgtctctagtaaaaatacaaaaattagctgggcatggtggcacgcatctgtaatcccagctacttgggaagctgaggcaggagaatcgcttgaacccaggaggtggaggttgcagtgagctgagatcatgccactgcactccagcctgggcaacagaggcagactctatctaaaaaaacaaaacaaacaaacaaaaaacaaaacagagtgttgctaagtgaggcagtaaaataagggttcacagttaactattcagagccaaagcaattgatttattttgataagcaataacttcctgcttcccattgattaatacatattattttttggtggttataggtgtctcatgattcaccaattaagttggtgggaggaacctgaaatacctgaataatgttgtgcttttgggttcatacctgacctatgaggattacaatggcaccgtcccctttttcccaaacaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacaggtgggggaattgccgtctccagagtaaacatctaatatttaaaaacaaaagctgattttgtgtgtataagagagccaaggtaataagtgaaatcaatttgacgtacaacatgtagctcttttgtgtatctcatcatatggctgattatgagcaagatgagctataagaaatggcacccaggggccaggtgcagtggctcacacctgtaatcccagtgctttgagaggccaagacaggaggattacttgagcccaggacttcaagacatagcaagaccccatctctattttgaaaaaagaaatggcccctgccatcagagggcttacaggtgttggcaagatacaacacccatatgaacagttaagtcagataacaaagtagcgtatgacacatattttaaaatgtcatgggcactaaaggcatccagctcagaggagctctaccttttcagagtggtcatggagacttttcaaaatggtagggctggaactggcctttggagaatgatctggagtctcttaggtagaaaagacacacagagagataaagaccaatcagttcagctcctagagtgaccaggttctgatcatttaatagctacctgtggagagagtctccatttcccttccttacagtgttaggacttctgtgaattttgaaaagataagcctgattaaaaaacagcaaagtatcagtttattttggcctgtgcccacttcagcaaagtgaatattgcatttgaaatactgcaagccatgagctggacttatccctgagcagaagaaggttggtgtttgttacatctttttatcatagctcggttgcagcttgcttggttctcacttagtgcctaccgtatgccacagttagggtctcttgagacacaacaagagtagaaaatagaagcattatacaaataaatcaaacaaaaaaatgtgtttaatgccaactgcataagttatctggctgcatgcccaaattcccaacattactttggagtgacagatactgccacaagaacaaagtgtttttgccctggtttcccattctcatttgaggcaactaaatgcagtctcccatgctccattttctgtgggataatgtgctgtacccccatgcattttaaagcattctatttcgtcctataggattagaagttgtcttttcttttttccttagaaatgctcttgattcactatgcagaaagttgtgttcatcattctgcctttgatgattgctacaatgccagattttaggtgcctacccttattcaaagatacttcacggaatacagcatggcacttgtctaatcttcttttacattgttgaataaagagaaaaacattagctcacaacagtaggcattatctgaaaggaaaaaacaaaatatactaattcttgaattgcttaggaagtcatttgaagagatcatgacctagttactaaaatactttaaaaaataaatccatgggcttcattccaagatggctgaataagaacaggtccagtctgcagctcctagcatgatcgatgcagaagatgggtgatttctgcatttccaactgaggtacctggttcatctcattggaactggttggacagtgggtgcagcccaagaagtgtgagccaaagcagggtggggtgtcacctcacccaggaagcacaaggggtcaggggacttccctttcctagccaaaggaagccgtgacagactgtctctggaaaaacaggacacttctgcccaaatactgtgcttttcccaaggtcttagcaaccggcagacaaggcgattctctcctgtgcctggcttggcaggttccacgcccatgtagccaggctcactgctagtgcagcagtcagatcgaaccgtgaggcagcaacctggctggggtaggagcgtccaccattgctgaggcttgagtaggtaaacaaagtggccaggaagctcaaattgggtggagcccactgcagctcagcaaggcctactgcctctatagacaccatctctgtgggcagggcatagctgaacaaaaggcagcagacaacttctgcagacttaaacatccctgtctgacagctctgaagagagcagtggttctcccagcatggcgtttgagctctgagaacggacagactgcctcctcaagtgggtccctgacccccatgtagcctaactgggagacaccaccaagcaggggccgacagacacctcatataggtgggtgcccctctgggacaaagctgccacaggaaggatcaggcagcaatatttgctgttctgcagcctccgctggtgatacccaggcaaacagggtctggagtggacctccagcaaactccaacagacctgcagctgagggacctgactagtagaaggaaaactaacaaacagaaaggaatagcatcatcatcaacaaaaagttcatctacaccaaaaccccatctgtaggtcaccaacatcaaagacaaaaggtagataaaaccgcaaagatggggagaaaccagagcagaaatgttgaaaattctaaaaaccagagcacctcttctcctccaaaggatcgcagctccttgccagcaatggaacaaagctggatggagaaggactttgacaagttgacagaagtgggcttcaaaaggtcagtaataacaaacttctctgagctaaaggagcatgttcaaacccatcgcaaggaagctaaaaaccttgaaaaaaggctagatgaatggataactataataaacagtgtagagaagaccttaaatgacctgacggagctgaaaaccatggcacgagagcttcgtgacacatgcacaagcttcaatagctgattcgatcaagtggaagaaagggtatcagtgattgaagatcaaattaatgaaataaagcaagaagaaaagattagagaagaaagagtaaaaagaaaggaacaaagcctccaagaaatatgggactatgtgaaaagaccaaatctgtgtttgattggtgtacccaaaagtgatggggagaatggaaccaagttggaaaacactctttaggatatcatccagtagaacttccccaacttagcaaggcatgccaacattcaaattcaagaaagacagagaacaccgcaaagatactcctcgagaagagcaaccctaagacacataattgtcagattcaccaaggttgaaatgatggaaaaaatgttaagggcagccagagagaaaggtcgggttacccacaaaggaaagtctatcagactaacagcggacctctcggcagaaaccctacaagccagaagaaagtaggggccaatattcaacattcttaaagaaaggattttcaacccagaatttcatatccagccaaactaagcttcataagtgaaggagaaataaaatcctttacaggcaagcaaatgctgaaagattttgtcaccgccaggcctgccttataagagctcctgaaggaagcattaaacatggaaagaaacaaccggtaccagccactgcaaaaacatgccaaattgtaaagaccaacgaggctaggaagaaactgcatcaattaatgggcaaaataaccagttaacatcataatgacaggatcaaattcacatataacaatattaaccttaaatgtaaataggctaaatgccccaattaaaagacacagactggcaaactggattaagagtcaagacccatcagtgtgctgaattcaggaaacccatctcacatgcagagacacacacaggctcaaaataaagggatggaggaagatctaccaagcaaatggaaagcaaaaaaaaaaaaaaaaaaaaagcaggggttgcaatcctagtctctaataaaacagactttaaaccaacaaagatcaaaagagacaaagaaggccattacataatggtaaagggatcaattcaacaagaagagttaactatcctaaatatatatgcacccaatacaggagcatgcagattcataaagcaagtccttagagacctacaaagagacttagactcccacataataataatgggagactttaacaccccactgtcaatattagacagatcaatgagacagaaggttaataagatatccaggacttgaactcggctcttcaccaagcagacctaatagacatctacaggactctccaccccaaatcaacagaatatacattcttctcagcaccacatcacacttattctaaaattgacaacataattggaagtaaagcactcctcagcaaatgtaaaggaacagaaatcacaacaaactatctctcaggccacagtgcaatcaaattagaactcaggattaagaaactcactcaaaactgcaaaactacatggaaacagaacaacctgctcctgaatgactactgggtaaataatggaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatataaaattgacaccctaacgtcacaattaaaagaactagagacgcaagagcaaacaaattccaaagctagcagaaggcaagaaataactaagatcagagcagaactgaaagagatagcgacacaaaaaacccttcaaaaaaatcaatgaatccgggagctggttttttgaaaagatcaacaaaattgatagactgctagcaagactaataaagaagaaaagagagaagaataaaaaagatgcaataaaaaaatgataaaagagatatcaccaccgatcccacagaaatacaaactaccatcagagaatactataaacacctctatgcaaataaactagaaaatctagaagaaatggataaattcctggacacatacaccctcccgagactaaacctggaagaagttgaatctctgaatagaccaataacaggctctaaagttgaggcaataattaatagcctaccaatcaaaaaaagtccaggaccagacagattcacagccgaattctaccagagatacaaagaggagctgataccattccttctgaaactattccaatcaacagaaaaagagggaatcctccctaactcattctatgaggccagcatcatcctgataccaaagcctggcagaggcacaacaaaaaaagagaattttagaccaatatccctgatgaacatccatgcaaaaatcctcaataagataaatactggcaaaccaaatccagcagcacatcagaaagcttaaccaccatgatcatgtcggcttcatccctgggatgcaagtctggttcaacatatgcaaatcaataaatgtaatccatcacgtaaacagaaccaataacaaaaaccacatgattatctcaatagatgcagaaaaggccaacaaaattcaacaggccttcatgctaaaaactctcaataaactagatattgatggaatgtatctcaaattaataagagctatttatgacaaacccacagccaatgtcatactgaatgggcaaaaactggaagcattccctctgaaaactggcacaagacaaggatgccctctgtcaccactcctattcaacatagtgttggaagttctggccagggcaatcaggcaagagaaagaaataaagggtattcatttaggaaaagaggaagtcaaattgtccctgtttgcacatcacatgatagtatatttagaaaaccccttcatctcagccccaaatctcctcaagctgataagcaacttcagcaaagtctcaggatacaaaatcaatgtgcaaaaatcacaagcgttcctatacaccaatgacagacaaccagagagccaaatcatgagtgagcttccatttgcatttgctacaaagagaataaaatacctaggaatccaacttacaagagatgtgagggacctcttcaaggagagctacaaaccactgctcaatgaaataaaagaggacagaaatgaatggaagaacattccatgctcatggataggaagaatcagtatcgtgaaaatgcccatactgcccaaggtaatttatagattcaatgccatccccatcaagctaccaatgactttcttcacagaattggaaaaaactattttaaagttcatatggaaccaaaaaagagccctcattgccaagacaatcctaagcaaaaagaacaaagctggaggcatcatgctacccaactttaaactatactacaaggctacagtaaccaaaccagcatggtactagtacgaaaacagagatatagaccaatggaacagaacagagcccttagaaataacaccacacatctacaaccatctgatctttgacaaacctgacaaaaacaaaaaatggggagaggattccctatttaataaatggtgctgggaaaactgtctaaccatatgtagaaagctgaaactggatcccttccttacaccttatacaaaaattaattcaagatggattaaagacttaaatgtcagacctaaaaccataaaagccctagaagaaaacctaggcaataccattcaggacataggcatgggcaaggacttcatgactaaaacaaaaagcaatggccaccaaagccaaaacagacaaatgggatctaattaaactaaagagcttctgcatggcaaaagaaactaccattagagtgaacaggcaactcacagaatgggagaaaatttttgcagtctacccatctgacaaagggctaatatccagaatctacaaagaactcaaacaaatttacaagaaaaaaacaaccccatcaaaaagtaggcaaaggatatgaacagacacttctcaaaaggagacatttatgcagccaacagacacatgaaaaaatgctcatcatcactggtcatcagagaaatgcaaatcaaaaccacaagagttgccatctcacgccagttagaatggcgatcattaaaaagtcaggaaacaacagatgctggagaggacgtggagaaataggaacgcttttacactgttggtgggagtgtaaatttgttcaacgattgtggaagacagtgtggcgattcctcaaggatctagaactagaaatcccatttgacccagcaatcccattactgggtatatacccagagaattataaaccatgctactataaagacacatgcacacatgtgtttattgtggcactattgacaatagcaaagacttggaaccaacccaaatgtccatcagtgatagactggattaaaaaaatgtggcacatatacaacatggaatactatgcagccataaaaaaggatgagttcatgtcctttgcagagacatggatgaagctggaaaccatcattctcagcaaactatcacaaggacagaaaaccaaacaccgtatgttcttactcataggtgggaattgaacagtgagaacacttggacacagtgtagggaacgtcacacaccgggccttttggagggtgggggactgggggagggatagcattaggagaaatgtctaatgtaaatgacgagttgatgggtgcagcaaaccaacatggcacatgtatacctatgtatcaatcctgcacgttgtgcacatgcaccctagaacttaaagtataataaaaaataaataaataaataaaataaatccatggcagaagcacttttcaaagcaacagcagtattttagctttttctcaaacccctggtggttgtgtttcttcctcatgatcacaactattattcttggttaaaaatctttgctttcttgacatttgtcagcaacgtttggtcattggtgtttgttgaatgaatgaatacagaaaggtcaatttcctaacaagttatggtaaaatctgagagtgatcttcttgtgtccagagtttctatacatgttcctgctggagtggctctagggtagctgagtgagcaactctccagttcagtattgcccatctctttggatgcagagcaaatagcagtgcctaggtaacctgactgcttgtatgctggtttccaggcagtgctttcaatagatctccataggttatagaaaaaaatttttgtaataatatactatgtagcattttaagttttattcctttaatgcatgtgtgtcatgcatacacatgcattcccacatgcagtggttggtcacctgcaaacctacttttttgctattccctgtgcttacttgaaaccatttagtccctttcattcctgtggctgatagaaacaggaaggccgtttgtgatggttagaacattttctctctctcttccagcccatctgatcccaaataatatgaagcaaaactgagatctttatatttatgggcaaaaatactgtctcctcatcacaggccatcactgtcacttcaccactaggtggccactgcccctcaaggatcagcatccacatagcttggggtcccgtccctcctttttccaaaatacagaagtcgatgagctcaataatagaaagaaaaaaaaagaagagtgagaggagtgagcctagtcatattgctataaacagaagtatttttgtttttttccatgcttaaattatgtctatatatataaaatgtaaactttactgttgtaaccattaagtgcatgacattaagtacattcactttgttgtgtacccgtcactgccacccacctctagaactttctcattttccccaggtgaatctctctacccattaaacacaaactctccatcccccctccctgtttgttttcttgtttttaatacatagggaaagcaaggaaatgcgagcacaccaggctaagatttctatggaaaatagcaaagccatcagccaagataaatctatcaagaataaagcagaacgggaaaggtaagtctgagagtgttcactgcaggaatatggcattgacttgaggacacagtctcaactttctttatgtgtgtacacacacacacaactgagacagcaaaacacttgtggcttttgactaggaattctgctattataactgcaatggagatttgttattatcactgtagaacaatcgtccacattttctggttgcttactaccaccagtaaaattagtttacattcaatatatatgtgctgctttacaaacaaagttgcataaaatatgacataataatataattcttttttttattttattcatttttttttttgcttgtttgttttgagatggagtcttgctttattacccatgctagagtgcagtggcacaatctcagctcactgcaacctctgcctgggtttgagcgattctcctgcctgagcctccctagtagctgggattacaggcatgcaccaccacacctggctaatttttgtatttttaggagagatggggtttcaccatgttggccacactggtcttgaactcctgacctcaagtgatctgcccgcctcagcctcccaaagtgctgggattataggcgtgagccactgcgcccagcctataatcaatataattctgaagcatccttcccaggttccactgggtcattctgcaagcctctcccctgctcaggtgtcagtccgttctggatgggccagttctgaatagcagcaacagtcaggagggcggtcttcttcagtagtccttcacatgggatcatcttgaaagcccccatcccatttgtctcatttgtccttatgttaggtgagttttctggaagcagatcaaggcaggaattgatgtgcttgtgattcactgaggaagggaccttcagagaaagggagtgagaaagcaggaaggcccagggcaggccctaagcaaggatgtggtctcacctagggtcccagtaacctcaaataaaaaattccaccacagatttgtccctctttgaagcaagagtacctggcttttgtgtttccatattaggcagtcattggccgcctgagactggggggaaggtttgtgtgtcctctatagaaggtgccaagtgcaagccctttagacacagctggtgaaggggatctgaggagctgtcaatagtcatgttacccaagggataggcacttaattcccagcgatcaccagtgctgcccatcatccacctcaaggaacatctgagaatacaaatgctatcagctccataaccaagagcctggattacgccaccagcagttagggacagtggggttccttcttttgggggaataatacctagcaagaaggtggccttttggccaaagtccaacagagaaaagctgttttatgagccaggtgcagtggctcacacctgtaatcccagcactttgggaggccgaggtgggcagattacctgaggtcaggagtttgggaccagcttgaccaacatggtgaaacctcacctctactaaaaatacaaaaaaattagctgggtgtggtggtacctgcctgtaatcccagctactcaggaggctgaggcaggagaattgcttgaaccccaggggcggaggttgcagtgagccgagatcctgccattgcactccagcctggccaacagagcaaaactccatctcaaaaaaaaaaagaaaagaaaaaatgtcattctctggatgttattctcagataagcaactttgtttaagggccttatatacatggaaatgacaccttcttcagtttgaaaacaccaaatattccagccatgataaaacctcatgaatttgaactgttttagactatccaaagtgaaatatagaattaaccatgacaaatgtgccaattaatagctttttaccatctttttcaaatatgttacaaagtagactttagctcggttgaggtcaaattatcttcaatttggagttactgctaacttaattagcaagggtcttaaaaatttatcttattttgaaaactgtacttatttgttgtaactttctatttttatttgtgcaactgtatgggggtacgtgagaaaactttacatgtatacaatgcccagtgatcaagtcagggcatttaggttgtccatcacccaagtactatacatttgtggctaagtatagtcaccctactctgctatctcttataagtttgtatccagtggtatgtggttccaaaatatctacaaattggctgttttttaaaaaataatttttctataccaaatgatagttatattctaaacccatactgtgtgtatgtttgtatccactttatcaaactgaggagaaataaaatttaaaaatttgtcatagcactaagaaagatacatagaaactgaaaatcatacttacatttttagatcaaagaagacattttaacagaaattacccaatatttataactgaatgacaatgtaaacactatttatcaatgtgtagagggtagttaaagtgatatttggagggaaaaatatagcctagatgcatatattttttaaaagatgtgaaaattaatgagctaaccactcaaagagaatatgaagttggaaaaacagagtgaacccaaagatctctgatggaaagaaataaatttaaaaagcaaaaaatactgaaatagaaaacaaaatgcaatagagaacattcagaaaaacaaaagcttatttgaaaagaataataaatcagttaactttcaccaagactaaagaagagagagaaagcacgaattagtgatgttaggaatgaaaaggggaattaactacagagaaaaacgctttgaaaaactaagtctactattaaaaaaaactaccaataaatttgaaacgttagatggagtggagaattgctttgaaaaatataaatatccaaaactgactgaaaatggagaaaacctgaacagactggcaattattacagaagttcaagaagttataggtcttttcactcatgaaaaacactctacctcaccagtagtcagggaaatgcaagttaagacaataagctccattccataggagcatccaactgacagaaagtctgatagtactaagagtgggcaaagatatggggaaagggtaacacccagacactgcagatggaaatgcagttggggacaactggattggagtaaggaagagcctgttcgtaccctgccaagtgacaagtctgagtatacaccctacagcagcctttgcctgtgtgcacaagaagatatgcaccatacttcatccactcatctgtttattcaacagacacttattgtgtcaggtattacagggcccacgcacccgatcgttgtagcgttgtttgaaaataacctaatttttgttaatggcaatgaggaaatagtgtagtctgttcataaattgaaaagtccatacagcaaatgaaaataatgaagtggtctggaacataggtgtatctctaaaacataagactaagtggtaagctatgggaagaaacccagactatgttactctatgggtacatttagaaaacacaggaagcgatgccactgtgcctggccagcaacatcagcatcacctgggagcttactagaaattcagacctcccaccccaggcccactggatcaaagtcactaaggggaaggcacaacagtctgtggtttttatcatctctccaggtgattggtatgcacaggaaagtttgagaagctcttatattacacatgggcacatctgtatgtggtttaaaatattaaaacatgggtgagaagatccacaccaaattcacaatagtggtaacctctggggagagaggaataaggaaaactgaatcaggaagaatacacatggggctttaattacatctggaactgtttattgcctttaaaaatgtgagataaacatggcaaaacattaaaaatatcagttaatctgagggacacatacacagatttttaaatattcttctctggacattatatgtttgaaaatactgcaataacaattagaaaaataaagcaataattccatccagagaatttgatggaatatagctctttattatttgatataatattaatttcattcaatgtcataccaaccgttatttgtgcccattgcttttaggcgagtcagggagttaaacagcagcaacactaaaaagtttctggaagaaagaaagagagtaagtattttattatatttttggcattcttcctttaaaaaactataaacaataacatgcttagccaccagacctctagctaatttgtttaatttgatttttctgtacattaaacattccagcttctctgctccctgaaagctaaaataatgtctcactaaaatctttaaggtaatgatttggcaccattttatacagaaaatgaagccaggtttagtcatgcgtaagtcctctattattttctaagattttagcaggaaagatcttcccagaaataattatgagtttaaactctccaaattttgagatgattttttaaaaaattattatctctttcacttaaattataaagttacaagtcatctctcatccctgttttaagattgtaacccaaagttcaatcagaattttttttttttttttttttgcagcttgccatgaagcagtccaaagaaatggatcagttgaaaaaagtccagcttgaacatctagaattcctagagaaacagaatgagcaggtattttacctaaaatacgtaaaaacatgcaggcagctagccagctttgggatacacatgccatggcccacagtgaccagtggcttgcatattgtaattgaaaggtagatagaagaatttgttgcccattactatattttctccattatatccaaaaagaaaagaaagtaccagtttttggagcaggagcagaatctggctgtgccaaaaaaagaatatttggataaattatggggattatgtgaattctaagaatgaaattactaaaagtgagaggatgaaaaaaagagattacgaagtatttctccattttcatttagagttttataatttgcaaactataggcaagggatatgatgtttaaaagcaaatgagagaaaccacctattttcaaactcaatctgaaaacgaagtttaaaaacctccctgggacttacaggtggtatctaaagtcatgagcccccatcactctacaaatcactgagcatgagtggataccatagtcttggtctttttccctgcaagacaagacactaaataaagaaatatacacaaataaagagttatccaggccgggcgcagtgggctcatgcctgtaatcccagcactttgagaggccgaggagggtggatcaggaggtcaggagatcgagaccatcctggccaacatggtgaagccccgtctctactaaaaatacaaaaattagccgggcctggtggcatgcacctgtagtcccagctactcagttggctgaagcaggaaaatcacttgaacccaagaggcggaggttgcagtgagccgagatcgcaccactgcactccagcctgagcgacagagtgactccatctcaaaaaaaaaaaaaaaggagttacccaaacaccaactgtttagttaggccaatgggcatataccagcaccaaggtaaatgtatttttatctggtgcatagtacaggtgggcacctttccaaatgggctacagcccatcagccttctacagtaacctttaattaatggaaatccctctagttcctatggcaacaagaccctcagttatcatttacatttcagactctctcagttcaaatgttattctttaggtgtagttggtatagaagttattattcctaggtaattcaatttagaaacggagaggttttgatgaaatatgtacttgtgccacattattccttcctgttttctcccatctataaaacaatcctatttaaggaatacttttttccagagtaaatgactccccttgaagaatacttaagtaggaattatactaaaaagtacctttgagaaagtaaaaataaaataaaataaaataaaataaaatcttttttgtatggcaattgggtaacagataaatctgacttctagtttcagattctttactttttggtggacagaaattttattcatcaacatacttcctagttatgtttcccatttccttttcagctaagtgcttctattcataagcaagtccactccaaggggacaatacatggttattgtcccacaggtacaattcatttgaccaactcataaacacatcacattctggtacaagttacctagcttatgtttttgctcttaaagcacttctcagaaagtgctcctgggggaaatatgggaatatgagtaaggataaagtcaccatctccaaagctttagaagccacttcagtgattcaacaatgggtagggataaggatgccttggagaaggtttttaaaaattctccctagaggaagggcacagtgaaaggtaaggcacagttatgtgttagttaactaaattaagaaactacttggaaattaattgtgttgcttagcaacaagtttgactaaagaatgtaaatgtgctcagaattactcatcactacaatagtggtgtatgccagagctagagaaaacagtcatcttgtgtcgctagctttggagccgaagtacataatttttaaaaatcagtttgagcttttatcctaacacatggctaattcaagccacaccagagttcttgcattaaactgctagattagtgatagctgtattgattagattgtattgggagggtgctggctttttgttgcagaaattcaaatatgtcttttaaggtctaccacccacaactgacactttgagtcacaaaagcttgggaaagcatagaacatgaaaaggcttgagacctgataaagatttaatgagattcaaggaaaagacattcaagatatcatactgatgcttctggcaagcaaagaatttggacttgagtttctgtgttaagctttgctttagaaatatggcctgttcaattgcaaattcaatcccagatctttctagtatacattttttggcatttaagggtgagaaagctctcaattcacagttactctgtatggtacaacactgtcatgggcacagtgcaaaagatacagtgacttcatttctttcctcataaaaaggcaaggtctggaactatatagtataactgccttcataaccaggtaaacatttcatcagcaagaacagttctttgtctccagacaatgcaaacttctacaacaatcttctaaataattgttaaatcccaagacattttttctaagccagagataaatgtaaacattctcccatagtatttccctcaaaggtttctttctgttctcctgtgaccctactcctaatcggtgtcccaaatctccccttccaaagcaaggcctggaatggattcagtccattagctaaaccagtgttgggggcactggcagaaacaaaccaggcgtcagtatgttttggtcctgattctggatcctcaccttctaggttatttgtaagccactttatgtccttgcctacttggtcagccaactattcacttaacactctgaaggttggggatgtttttcctacttgagttttttcatagacttcccagctacacagtatatctcatctgtcttgacatgtaccatttcaaacattaacgactccattactgtcacacactcgagtctcaaaaattgatttttatcatcaatcctatcatttaataaagagaggtaaaaggttttgcttaaaggccaggttctccacttactgccacagaagagaggcacagtctgggaatgacaggcgttggttgtttgtttcgtttcttttttttctgttgagatcaactaggggaaagtttgtcactgaggggtgtgtacatgttttatccttagctttttgcttttctgtatatggttttgcattcatttttcaaattcacttcaatattcatttattttcttcgttttgtatgtatgactcaattttgacattactatttttgtacaaacagcttttgaaatcctgtcatgcagtgtcccaaacgcaaggtaggaccgaaactctgataagcaagacgttgctttccttctcgactacgtccgtattctctgtgcagtctccatttatgagtcacatctggtcataactaatatctgaagggtttggatttaaaagcttgactattccatgcttggatttctgatgtcatattcatgccaaaatgccctaagtctttagagaattacttctgagggtatttgaacctgtattttctattgcagatttaggaaacagatcatggtaataaagacataaccagaacagtgatgtgcagctgtcatttggactgaccagagctaagacagggtcacagagtcaggtcactcacaaatgttaatatgactccaattaatttttaaagcgctcgctgaaagttggttggtggtttttaatgatggagctgtgctgtgcatgtagaaaccttacacgatgactcttgtcatgctctctgctaagtcccatctgccaaagaccctaatcactcctcataagtaaggtggtcatataatttattgtccataccaggatagttttgagagtgaaaggcagctctgtttataatatctaggactacaggcataaactggaattgcctcagacaaatgagaatgaatggtcacccaactcatataagaacttagctgttggaatagtcttgtaatgtcctatgattcttccttctacaccgtggtcaatactttcttcagaagctaaagggggacaagcacagagaatcatttgctactatttaccgaacttggaagtatttaatttccagtgctgataatgtttcactgtcatcccttttgaatactgtttgtgtcatagtttcatgtttgtatatttttctccatttcttcatttctctattagagtattactatactttaggcataaaaaatatctgggcagagggaaccaaccatcccaaatttacacagaaagatttaattctttggtgttattatatccatcctcaccaaaatgaagcttaacgccaaaatatagaagtaagaagaagaaggaaatcacagtatagtctgtgggttaaattaattttgtcacaagaattcatttggaagatgcttctcatatatctacagagttgaccaaatcccctcccagtgaccttccatttagttggaatatctaagcagacataaatagtaacatcagggcacttcagaatcttcatccgatttatatcttcataggtccatgtttctattttcaaatgtcctttatttcaaagcagcatgtcactaaaaaaaagaaatgggcaatcatcattcctcaaaagatacgtgcatttggttgggcaaaatcatccaggctaccagttggataataaaagtcgaaatgtactatttgattttttcctatgtttccaagcaagtatttctcaccagacactgcccccatcatatcccctttcctcttctcgaattagctggttttcttagtgacaatctgaactcatgaggttgaattcaccattgcttacttcctggtagtccataaaaagtaccctagagaagtaagagcccacagggatagagtttgcacaataagattcctgaaagcctgcatgttcctgtaacattccatttacagaagactccagccaatccaatgtaatatgctctcacctgaacttctctatcaattagatttttagggaattacttttaactaaatttcaggctatttaggaaataagttgtacataagcaatacttattctaatgtgataaaattatctacacacagtcaaagcaacgtgtcaatctgtagaaactaaatcaaacagtttgtggtatggtctaaagataaagcaagtggtctaccctcttctcaagtggttctcctggcactgtgtaaaccagtccccaaaatttaatgtgtataaaaacttcctggagatcttgttaaaatgaagattttaactgattcaatagatctggggtagactccaagattctacgtttctaagaaggtcccaggcaatgctgatgctgcttgtacatggaccatattttgagtagcaaggatgtggtgacaggatcatatttatgggagaagagaggccagggttgttaagtgccttcagataaggatttcaacacacgtaaggccatgtttctgatgttataggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttccagttttgtttttttttttttaaaaaaaaaaaaacattttcagggacatgtttagttacttgagagtcaaatcccctgttagagatccctccccattcaggagatcttgcttttttccccagatggcatctgggtatgagggaagctcacgtgtccacct

SEQ ID NO: 16425 - DNA, 13198 bp, Human
tatcactctaatgttacattgcatacttatttatttggtttactatgtctttctcagtaggatgtaaagctccgtgagggaaaggactctatcccaataatggtgcatggccttagtagatgctaaataaaaatgattttaaatgcatgcatgaatgaagtgttaggcagctgggtaaggtgggggcaaatgaacagctgaggagccagacggacctatattcccactctgactccgccactttgggcaacataattcatttctatgaggcttcgcctcttcatctacaggtgacaggaaacgggacaacagaacacaccctttagagatggtgtgaagatggcaaagcaccaaggtggaagctctccttgctgggtttgaggaacagcaaggagattagtgtgactggagaaggatgaatgagggcaatgttgacggagatgaatgaggttggagaggagcgcagagctagattttattccatgtgtgctgggaagtttttggtaagtggagaccaggacatgacatcatctgatatcccagtacgtttagaaggatccctctggctgccgtgagaacaagaaaggaagcaaagagacaagttacgggctcgttcaatgatccaagacagagacgatggtggctatgactagagtggacgcaatggagtgggtgacaacaatcatattcaagataatttgaaggtgggggccacaggatttgctgatgaatttgattattcgatggcagagaaagagaagaatgaaatatgcttcaaatttgtcattttcttttttaatccaagaaacttcggggatggggaacactggtgaagtggttttagaaacagtgaatagaatcaagaattcagttttcaacatgttaaatttggtatacctattagacattcacatcacgctggcagctggatataaagggccaagagttaaatgaagagaccaaggttagaggaacaaacttgaaagccttgggtgtatatgctgtatttaaaagtcataggaagggcccagtgtgatggttcacgcctgtaattccagcactttgggaggccaaagtgggtggatcaggagttcgagaccaggagttgaggtcaggagttcgagaccagcctggccaacatggcaaaaccccgtctctactaaaaatacaaaaattagccgagtgtggtggcacaggcctgtattcccagctactcgggaggctgaggcaggagaatcgcttgaaccggggaggcagaggttgcagtgagccgagattgtgccactgcactccagccttggtgacagactgagactctgtctcaaaagaaaaaaaaaagtcatagaaaaaaaataaatgtcatacgactggatgcgattatcagcaaatatgggtagagcccttattttgtgctaaagtgttctaggcactacagcaatgagtaatacacaaagagaaaaattcacacccttatggatcttacattctaatggggaggggataataaaataactaacaaaaatatacagcgtgttagatagcaagagggaaatacaggagagatgaggatgaggtgggtgggaaggttacaggatggctagggaaatcctcactgggaaaatgttatttaagcttaaaccttgaaagaggtgagggcagcagccttctggtataccttggggactaccattccaggcagaggcgaaagcaaatgcagaggggctgaaaaaggagcacgtccagccagtggagtgaaaagcaagaatagtgactgtagaggagagagccggggagggtgatgggaaatgaggaccgagaggttaatgggaaaggcggggtgaagagaaatgagtgtgacacagagcagctctcagtacggatttaagctaggaaggtgtccaaacaggaacttaaggctctccttacgtcaaagccggatgttaacgcccagtccccaggccccgcctctgctcggcagaagctccgctccggggccggaactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatggtaaggagggcacaggctggcggcgcgggagcttccgagtctgttgtggagtgggaaccgcgactgatcggggaggaagccgtgggttggagccacttagggcggtgaaggcctgggccgaggccgctcggtctgggcgggaaagaccaggaccttggcggttcggctaggcatggggtcgaggaaaaggttggaaccggtgtcggaggccgaggtcgctcggcaggggcgagggtagaaccgcggctctcgacaccgctgtagccataattcctgggacccagtaggcactaagttaacttttgccgaataaatatatgtcccgggcttcggagcaggcactggagccgcagggggacccggtaaaaggctcagactgcggaagtttgtgagtctgagaaagagttggcggaagtgggtggaaggggctcgtggaccacgctagagtctcgctaggtctgctggatggagaggagggcggaggagggtgatggcgaatggaggaagagctccactcagttgctcatcacgtttccgtgtttgcctgtgcctgacttctcaggcgctggggctactctctgaaatatgtttgcttccttcacagaggtagctggggacacataatataattcagtgtggtcattcggtaaaagtaacggcagctgggcggggtaagaatgttttctcaaatagatggttcctgagcagattcctaaaagattagcaagaatgttcccggcgaaaatggggggaatattacagacccggagaactgaaggaacaaaggctgaagggtaacaagatttaaaaagttactggatttttctgcgtttgttgactgagaaaaagttgctggaggagaaaggaagaaagaagggaagacgggaagaattggcaggaggctagttactaaaggccttgcatgttaattttacctcagtggtggtgaggcatgtcattgaaggatttaatttaatttatttttatttttttgagacggagttttgcttttgttgcccaggctggagtgcggtggatcgatcagggttcactgcaaactccacctcccgggttcaagcgattctcctgcctcagccacccaagtagctgggattgtaggtacccgccaccacacttggctaattttttgtatttttagtagagacggggtttcaccatgttggccaggctggtctcgaactcctgacctcagttaatccacccaccttggcctcccaaagtgctgggattacagccgtgagccaccacaccctgcccactgaaggattttaaccagcaaaatgacataagcttagtggtgtttagaaagattgctctagctctggcatgtatattcgatgggactggaagcagggaaacctggtaggatattgtttggataactggttagaataggcgctggattcattttgtctaggttccaacacagcttcccagctgtgaaactgggcaagttacttaacctctcctagcctcagtgacctcatctgtaaaatagggataataatgggcccaattttggggattaaatgagatgtactgtgcttatcacagtgccagatacacagtgagcacccagtaaacatgagttgagctggaccagtgaatgttgccctaaaggttcagatcccttgtggttagaagctggttaaaatggtcattgaatggaaactgaaccacctaacctgagggaggctcgcagtatctttgtgtggagtcaagttttgtttttgtttttttgagatggagtctttccctgtcacccaggctggagtgcagtggcatgatctcagttcactgcagcctccacctcccaggttcaagcgattctcccatctcagtctcccgagtagctgggattacaggcacctgccaccacgtgtggctaatttttgtaattttagtagagacggggcttcgccatgttagccaggctggtcttgaactcctgacctaaggtgttctgcccacctcggcctcccaaaatgccgggattgcaggagtgagccactgagcccggccatggagtcaaggttttgatctgcatatttgcaggttcagaactttgttgtctgagctcacagagatgaacagatgtccatagaaggcacttggtgggttaggacttgggtatagcagtcagactgatgggaggatgatatacagatcaaatgccaggtgatttgtttatagagagaaatacaactgcttagggtacctgacagttcacaaagtgatacctatatagtcacttctttattttagcacattggaacccaggttatgaaagcagaaatgtttgttgggttaaagaccattatatgtccaaactggttagcaccctaaccatcagaagtttccctctgccaaatatagtcttggaggcacactaacaaattcttgatatgtggatttcatttttcaccttgaagctgatctccttcctgataacaagcttcttgttgattagatttttagtttcagccctattctagctcttcctttactcagtgtttttaatgagatttgaatgttccatagcacttgagtcacatatctataatctgcacactggtagatggctctagtatgtatgcattggattattttggggacaccctatactctcatccctgcaactgacacgacaaggagaaaggcaattataatatgagaaagaccgatttcaagggaagagagaatagcagattactgggtagaggtaagggctaaaacggtggcatgggagaattcctaggaaaaggctgtgggtgggagactgagctaagaatctgttgagaaagttggacacatggacaagaacgccatgggaagttttggggagggccagaggtgcttgggtccaaaagagcagagtctcatccctgtccatttctccttgcagacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgaggagtggactgtggggggcggagactggaggatgggaatggattgagtgggtgggccaagcaatagaggtggtgatgtagctagttggttcttctctgtttattctccagttttagagggcagacttaaatggggacattgaacgctaagaaatctttttgagtccagcaaaccttgctctctagtctagcaaagtacaagttgtgaagggctgctaggctttttgtttctctcactttgcgtgcccctgggtactggggtaaagggctctcatgttctccccacaggtgtgtgaggggggagagcttgagtttctggcctcattgcctatttgtaaagctgtagcctaaagggctctcccaatgcagcctggtctgaaactgctttaagaagcctctgaccctcttcagggtaagtgctcagctccccatgtgggtttggggccagtgatttttgttggcatttatacaaacaattggagatattgtctactttgctacaattccgtaagttattggctaactcccttgccttgagtctcacagatcttaagcttttggcccattaaaagatatgatttagcttcccatcatgttttacattcaaggctacttgaggcacaaaaagatgatgtgacttccgtggccagcagctcttttgtcatatgcagtgtccatattattctgtcactcactttgaattccctttgattctccttggggctgatttcttctgtgacccaaggtcaagaagtatagtttaaaaatgtggtagggatgccttggtgccaggtacgtattagagaggggccaacagatgagcgtggagctactccaaagttccctcctgattataaaaaatgtttattggaaaatatttttgaaaatacaaagaagtctatgaatagaaactaaaataccccgaagggtttttttctaattatgaaaggacaatacatggttattattttaaaaaataagaaaatgtgagccaaaaaagggaaaaactgtccatccacagacaaccagttaatatactgtaaaatatcaaaacaaaatcttttgagttctttttttaaatcaggctattttttcccctttatttttaggatctagctttagcttttttccccactttcctatcctgttgcagttatttttcctacttcacatttatattttgttcatctttttctggttgttgctttttgggggtttctgtttttatgcttttgaggaacagatatgaaatttcaatttctgtgtatgtgaaatttctcttaaccttttccttctatggcttctcctatttctgatgtaagatgaggggcagaattataggcctgtgaggttgaattgatattagaaggacactgcacgtaagtgaggtgggtgggagtcatttgattggaattgtttaggcagcctcctgatgttggcaagaccttaagctgaagggagggaatagggtcctaagaaagaagacttggctgagggaagggccttcacggttgctgtggaatagcatttgggcccgggctgggctttgttgaccttgtcctatctcttggtcagtgtgtcctcttggcatggtaggaaacaggtagatagccacctaagaggttatgtgttcagcctgtagagactatccaggagggctatcttgggaaagtttgtgtactgtttgttaggagatgcagtataagcaaatcttggaggccactaggcaggtgaactttacccacctctaacactttttttgttccttctaaacctctctttaggccaaagaactccaaacaagcagaaagggaagagaagcgagtcctcggtctggtgctgctgcgaggggagaatctggtctcaatgacagtagagggacctcctcccaaagatgtaagtcagagcaggaagccttgtggaggaggggaggccctactgtgagccaggctctgtgttagattctgtttcattgcagttctcacaggcatcctctggattttgccccctttttcagataataaatgaaatcttaaagaggttaccctgcaagaggccgggcgcggtggctcacatctgtaatcccagctctcagggaggcaagaggcgggaggatagcttgagcccaggagttcgagacctgcctgggcaatatagcgagaccccattctccagaaaaaggaagaaaaaaaaaagacaaaaaaaaaaaaaagaggttaccctgcaagaaagaagtggaaaaggggaactagaatttgggtatctcagactttaaagctctacctgtttctcagttgatgtacatagtgagtcagtggaggaagcacctgaagccatctgggtcagttcttaatgtgacgacaaagcctaggtagaccttaaaaagttgtaactccgaaacaataggaaatgtgtgtattttgttttgtacagttacagttcatagttactgagaatctaccttgcgccaaccacttcagtattttatttgatcctttaggtctctttagagataaattctcatcttataaatagaataaaccagggcttagtaacttgcccaaggtgccacagccactaagtggtgaaactgacatttgatctcagacagtcttgattctgtaaacaccaagctacacatagaaatagagcaggctttagagacctagtcaaatttgttttccctttccctttttcatttgaagggttttttttttttttttttttagatttttagatggagtctcgctctgtcgccaggctggagtgcagtggcacgatcttggcttattgcaacctctgcctcccgggttcaagtgattctcctgcctcagcctcccgagtagcggggattacagatgtgagccaccacgccctgccaagacgttattttaatcaaaagagaataatccttttaactttttaaaaatccacatatattatctggatttttttgtacttaacacatagtgggcatatattatgttgttctgtgttttcacttaatgttaacatttttctagttgctcaacacttttaaagtcaagttaatgactgagattttctcaaatgagtacagagtagtttatcctaatcattttcttttttggagatttttacgtttttgccttttccagttaaaaatgtctgcaagggatgttagcatatcttggttcaaagtccatgtacatattcaaatctcttagtacctacttccagtagaattggctggtctaacataacccatcataaacctttgtgatcacaaccagttgtaccataaccatgtcatttgcagataaggcaactcagcccgggattgtgggattatttgtccattgtcacctagcggattagaatcagctgggaatggatctcatgtccctttaatgccttgcctgctgaaccctgagtggaaccctggccctttgctcttggtttaactttcacaggagtgcatataggtggttgagttgtggcatgtttctctagacttactcttaagttctaccctgcttcagggataactcatagtcttggatggaggaagaatggtgttggcacacatggagaggtagtatttataagctatttcgatagtatttataagctatttcgaggggctctcttggcaatgatattccaaagtatacttctgatcttcagatcactgggcatcagagcatatttgtttatttttcagactggtattgctcgagttccacttgctggagctgccgggggcccagggatcggcagggctgctggcagaggaatcccagctggggttcccatgccccaggctcctgcaggacttgctgggccagtccgtggggttggcgggccatcccaacaggtgaggagttggggaaagggtaccacctcctggtggctaaaataaaggataaaggggagggtccatagttttaaaagggtccagagtgaccaacctgtgattgtcagactatcagtgtttcactgtggtttatacatggccctagaagcaagtgaaaaggataagttgccattgtaaattatgttgatgctattaaagagatgtacgaattagccaactgtatttaaggaaaatatttccatgacagcatttgaaatcatgagtcatatttgaaaatgcagttgccttctctcacttggattggacatgcttacattcaggtctagaagatgggagttgggcattcaagcttgatctttcccgacatgtggttttggatgggaagtctggtgctgagagttgtagcattaagggatttggtgtctgttatttcccactgtccttccccaagttggggaggagagtgggaagctgcattgtactgtactcttctaactctttcttcttatgtcctcttaggtgatgaccccacaaggaagaggtactgttgcagccgctgcagctgctgccacagccagtattgccggggctccaacccagtacccacctggccgtgggggtcctcccccacctatgggccgaggagcaccccctccaggtgaggagcccataaggagaccagtgctaattgatagaagatgccttagctggattaatgatgagatataaccttgactgaagctgatgatgagtttgtataattaagcaggattactctgagatccagcgtggctgactgatgagactaggtggacaagagccattgggagccctgggtgttaggctcaaatgtcagttttctgggagctgctgagagggtggaatggtccatctatctcagaacttggtggaaagctttgtagtttttttgctaccttttcaagatagacacttgagctatattcttggggcttttctcttgcaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatcatatcccatgggctttcaagccttaaatctagggaaatccagaaaggaaagagaagagggaacatttcttaaattgggcttacctcccctcttagaaaagttagagcagccatgcacccagggtgtttctcaatatctaaggcagcggcctcaggacacaatgaaataatgcattctgaggatccctaacagaagttatgagattgtcttatgctctttggtttgacagtgcctagtaattaagagggggctctgggctttgctgtactattatggatttctctttaacttcagttggagaaattctgagatcagtccccacatggatgagaaaataggcccccagggagtttggactccaagcccagtgttctttccctataagataacccatgggcaaacttggtgacccctgtttctctagtctggattattcctctatgggtttttatagacataggaacccagtcagcctcagagtagtccctagttagcacatatgccatgtatacccctctcctcactcgattactgcagggcgtgggaggctggggcagggttggggattcaagttgcagatcaggcactgactaaacttcttactcttacttcaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgcacctatggatctttatttttagaaaaatctttgatatattgggtgcttaatagagtcaagaagggttgccttggaaaaaattaaccctgatcttaccttcttccctataaaatgttttactacccatttgcatctgtacatcctcatacactaagatacttacaaaattgaacattttcacttatcagattcaaagatcagttttgttgaaatcagtacccataatatcctcttgggaaggcacttgtctagatagctcctccatgaagcaaatgctaaaaatgaaaattctgctgggagaggaacaattttggcataactttctgccagggtcacacacgtaacatataacctaacgtaacttttgaattgtggtatcttcatgagttcttccacccaaagcctgtgttcactgagcagcactctagtacttagtgcatcaagctctaagggtacaaaaataaggtgaacactgttgtaaagttactgtgtagggggaagataattgtaaatgcaatcagtggcacttaccacattaatggaagaaaaaagccataggatcttctcaacagatgcagaaaaaacatttgagacgatttcaacaccctttgatgataaatacacccagcaaattaggagtagaagggaattttttttttttttaaagagatggcggggtgcaggcatgagtcactgcacccagctcagaaggcaatttttaaacaagattaagggatttatgaaacacagctaacataatagtgaaagactgaaagttttacccttatgattaggaacaagacaagggttcccactttggccactttcaacattgtactggaagttctagccagaacgattaggcaagaaaaagaagaattggaattggaaaggaagaggtaaaactatctctgcagaagatatcctgtatatagaaaaccccatcaactagatagctactagagctaatgagtgaattcagcaacgttttagggtacaagatcacataaaaactattccatacaccaccaacaaacaatctgaaaaggaaatggaagagaattccagttaggatagcaaccaaaagaatacctaagaatcaaagcaagcaataccagaatacccaggaatcaatcaaaccaaggtgaaaactacaaatcctgaaagaaaactaagtagatgaggaaagccaacatgttcatggatccagacttactattaaagtaacaaataatagtctccaaacattcaatgtaatccctataataattccagtggtcattgcagaaatggagaagctaatcctcatatatatgaagctacaaaaggccccaaatagccaaaacaatcttgatcacattagaagtctcacaaaacctacaaaattgtaatcaacactgcatctggcataaagatagacaatggatagatgagagtacagaaataaacccttacataaatggtcaattgattttctgcagtggtaccaaaaccatctattgggaaaagagtagtcttttcagatggtgctgggacaactggataaccacatgtaaaagaatgaagttggaactctacctcatatgccttcatttatcactcattaactcaaaattggtaaacaatctataagagctagatctagaagaaaatgagtaagtcctcatcaccttggatttggcaatggattattgcattggacattgaaaacaagcaacagaagaaaaaatatgtaaatgggacttcatcaaaattaaaaacttgtacatccaagaatggtgaagaatgaaaaaaaaacttatggaaggggagaatatttttgcaaacgatatgatagtctgatatctgtagtttgctatttgaactataaaaaattcttaataaaaaagataacctttttcaaaaatgagaggaattgaacagatatttctccaaagaagatacacaaatggccaaaaagcacatgaaaactggttcaacatcat

SEQ ID NO: 16426 - DNA, 4897 bp, Human
tggatgcgggccacctgggaagggtgtgaccctgagccaggcagctctctgcagctgaagcaggctctcgaggagctacccctgagggccacctgcagagggcactcccagcagctgggtggcaggtgctttcacaaagggagagttgagcagcgcctttcctttcttgttcatgatatctaccaatacctctcccactggggtaatccatcttttcttttaattattttccttttgagatatattaaaaatgcaaaaaaaaaaatttttatttttttgagacggagtctcgctctatcacctaggctggagtgcagtggcatgatcttggctcactgcaacctccgcctcctgggttcaactgattctcctgcctcagcctcctgaatagctgtgattacaggtgcctacctcacgcccagctaatttttgtatttttatatttttagtagagatggggtttcaccatgttggccaggttggtcaaccaccacgcccagccaaaaaaaattttaatgtcgaaaatgagagaaatagaattacaaaagaaaccaattacagggccaggcacagcagctcaagcctgtaatcctagcactttgggaggctgaggcgggtggatcacctgaggtcaggagttcgagaccagcctggtcaacatggtgaaacccccgtctttactgaaaatacacaaattagccaggcgtggtggtgcatgtctgtaatccaagctacttgggaggctgagacaggagaatcgcttgaaaccaggaggtggaggttgcagtgagccaagatggcgcccgccattgcactccagcctgggcgacagagcgagactccgtctcaagaaaaaaatatatatatttatattcagatatcaaaatgttaaaacacttttttttttttttgagacagggtctcgctctcgctctgtcactctggctggagtgcagtggtacgatcacagctcactgcagtcttgaattcccaggcttaagcggtactcctgcctcagcctcccaagcagctgagactacaggagcacaccaacacgcccagctaatttttgtattttttgtagagttgggggttctcgctatgttgcctaggctggtcttgaacttctggtctcaagtgatctgcccacctcagactcccaaagtattgggattgcaggcgtgagccacagcgcccagccaaaacacattttgatggtgtcataaacgtgcttctttaaccattagatagcaagatctggtcgtggcccaataactgtgataattttgaagatataatgaatctaaacagtatatagaggcatttgtgacagctgtgataggaagttatcttctattttgatttgtgacaaagccacaggtattgctaattctgctgtggtttgttgcctaatttatagtgaaaggaaaggtggaatatcagttacagattagagacagatgtgatctcttcctatccaagtttcaggtgcagggaagtgggtgttgctgtgtggtgagggtgaagaggttttctggaaatttgggtttaggaagaggaaatgttcctaaaagaggggacaatgatccacatgcgtggtgggccaagagggtgggcggatcctgccagagcctcctcccacctggaggggtcccagcgtccaccttccctgccccagcccccctcctcgaggtactgggaggctggataaagtcttcggctgggccacaccccaccccaaattctccctgtcccaccctagtggcccaggccaccccggcctgctcccttccgcaaggcacctcaccttctgtgcccagaccattagccaacgcggtgaccttgaccccggcccaggccctgctaatgaagaggaaagcccgtacgcactcggcctgacccacggcgaccctctgtgaccaatcatactaccaacctcttaaacagagctccaccgacgcaatgcccaggcataaaaaggccaggccggagagaccgccaccagtcacggaccctggacccagcgcacccgcaccatggccggccccagcctcgcttgctgtctgctcggcctcctggcgctgacctccgcctgctacatccagaactgccccctgggaggcaagagggccgcgccggacctcgacgtgcgcaaggtgagtccccagccctggtcccgcggcgctccggggagggagggacccgcagccacaggggcgcgccccgctccggcctcgcctgagaactccaggagctgagcggattttgacgccccgcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgccccggctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagccaccccagaaatggtgaaaataaaataaagcaggtttttctcctctaccttgactcgtgtctaagtgccagaaatgggacggggagggggcattgtgggactggaagatcgcgcgcgttggacctgtggcttgttgcgctcagagctggcccaggaagacgtgtcccggctacccgaggggacagagcgggtgctgttctggctgccaccaccctggaggggctggaagagggaggggcacaaaggctctgaggacgtggaaacagccccagcttcccgctcccagcctgggctgaggcctacagcaggctgcacctcaggggatctttcaaaattcaaaaagacgaggatgagggagcaaatacagacaagggtctgagcgggatgaccacaggaaacgggcagtgcacactgaatggcttcctgacccctgaaaggaggtttgagccacacttagaagttgagggagcggagcgggcctggggggagggggccctggggagcagctgaagggccaccatgtttccaaggagctggcccccaggaggccactggcacgctcagaagaggagcccaagctgccgggactgggcttgaatgccagcatgaccgtccctggtgtccccagggctgggtctgacccagcagctctactcctgcctgtgcaataaaacatgtcagggctggggaccccacaagcggacaggggatcttgagagcccagggccacagaaatgacatgaacaaagagaagctcttaacctctatctcctatcggtgaagcaaaagtatctgagacaggtctcaaacaacttaatcttttttttttttgagatcgagtttcgctcttgttgcccaggctggagtacaatgatgcaatctcacctcactgcaacctctgcctcccgggttcaagcgattcacctgcctcagcctcctgagtggctgggactacaggcacccaacaccacatcttgctaatttttgtattttcagtagagatggggtttcaccacgtagaccaggctggtctcaaactcctgatgtcaggtgatccacccacctcggcctcccaaagtgctgggatgataggtgtgagccaccgtgcccagtcaacgtttcaatcaatttagaaagctgattaagggccaggcacagtggctcatgcctgtaatcctagcactttgggaggcctaggcagtttgatgacctgaggtcaggagatcgagaccagcctggccaacatggcgaaaccccgactctactgaaaatacaaaaattagccgggggtggtggcaggtgcctataatcccagctacttgggaggctgaggcagaaaaatcatttgaacctagcggtggcagaggttgcagtgaaccgagatcatgccacttcactccgtcctgggcaaaagagcgaaactccatcgcaaaaagaaagaatgaaagaaagctgattaaggacactcctcaggaggtcccctgaggacatgtgtccaagcctggttttttgtttgagatggagtctcgctctctggctctgtcgcccaggctggagtgcaatagcataatcttggctcactgcaacctctgcctcccgggttcaagcaattctcctgccttagcctcctgagtagctaggattacaggtgcacatcaccacgctcagctaatttttgtatttttagtagagacggggtttcaccatgttggtcaagctggtctcgaactcctgacttcatgatctgcccgcttaggcctcccaaagtgctgggattataggcatgagccaccgcgcccggcctggttttatacattttagggagacatgagacattgattaatacatgtgagatgaacattggtttgctctggaaaggcaggacaactcgaaggggggttgtgggggtcccaggtcttaggtggataagagacaaaaggttgccttcttttgaatctttgttcagcctttcactgaaaacacaatttacatgtgagagtggggtagaggaatagtcgacttatgcctcagtctggctcagtgaat

SEQ ID NO: 16427 - DNA, 5170 bp, Human
ttaattttttgaagacccaccatactgttttccatagcacctgcaccattttacattcccaccaacagggcacaagatgccctatttttccacgacctagctgacacttgaaattttctgttgcttttttttttcttaatagtagccatcatattatgtgtgaagcaatgtctcattgttgttttgatttgtatttccctaatgattagtagtgataagtacatgaaagattccttacatcactaatgagtagggctatctagtatgttagaatgagagaaaatgtatagaaataaaaagtattagatttatttagcaataaacacacagaaaacaaaatgaacaaatagaaaacaagtattaactttgtgtgaaaatgttgttctggaaaataaaaataatgatagtatactatgtggttcaggtgtaaataagtttcagtggttacaatgaggtaaaccctgaccactgatctaaatacaattaaaatctgattatttggggaggattatggtgttggaatctttcatgtagtagtggagataggaagatagaaggaaagaaaactaacaaagagataaatcctcatctttcacaatgagaagttaactgatcatgacagctgcggaaaagtaaatacataaaaaaaaagagcaagaaaataaaaaaatgaaaaatacatagttagcaaaataaaaagcataaagtaagatggtaggacacaataaaactgatccattctaacaatctaagtcaatgaagtaaactcggtgaaaaaacaaacattgtcagactaaatttttttttcagctattagtggtttatttgcttcagtaccatatttaatttttttattttagttttcctttatttcttctaaaaaaaaaaaagggatacacgtacaagaatgtgcaggtttgttacatgggtatacgtgtgccatggtggtttgctgcacctattgacctgtactctaagttccctcccctcacccccaccccccaacaggccctggtgtgtgctgttcctcgctctgtgtccatgtgttctcattgttcagctcccacttaggagtgagaacatgcattgtttgttaaattttaaaaatccaatgatatgctatttactatactcacactttgaaaacatggagatataagaaaatcaaaagtcaaaatatgatactctgcccctccaccaaataaaacagcattaaaaaagacttaaaaagcagcactagagagaacatgggtcactacataatgataaaactattttaaatatacatgcacctgagaatatggcttcaaaatatgtgaagcaaaaattgacataactgaaaaaaagttgtcaaatccacctccaaaatgggaggatttaactaacccctttctcagccactgaaaagagtcagacattaacagatttgatctaattgatatacataacattgcaaaataacaaacactataattgaagaatacatacttttcaagcagacaaaaaacactatgaaagttgtgcacaaattgttccgtaaataaactcttcataaatttcaagtttgaggaaatacagataacaatttctgaccaattaagttagaattcaataaataaagataattaggaaaccccaaaagttcagaaatatgaaaatgcacacaggaagaacttaagggaaaaaaaggaataaataatagtagttaccaaaaatataataaaaactaaataacacaaaatattaaaacattgtgtcatctggtttaagtggtacttaaatagaaagccttgacaaaacagaaagccttaatgtatgtattagaaaacaagcaaacttcaacgttattgagctaatcacgtaagagaggaagaggaagaggaaaaatagaaggaagagaaagatggtaaagaaaacagaaggagaaactaagaaacagaaagagaaaaactaaggtaagattagaaataataagatagaaaaaaaaactcaggggaacgccccggtggagaagctgaggtcaacatcagatttgaaatatttaaagtggatacaaaactatttcagcaatgcagacaattaagtgtgttgttgtgggcgatggtgctgttagtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaatgtgaaagaaaagtgggtgcctgagataactcaccactgtccaaagactccttttttgcttgttgggactcaaattgatctcagagatgacccctctactattgagaaacctgccaagaacaaacagaagcctatcactccagagactgctgaaaagctggcccgtgacctgaaggctgtcaagtatgtggagtgttctgcacttacaaagaaaggcctaaagaatgtatttgacgaagcaatattggctgccctggagcctccagaaccgaaaaagagccgcaggtgtgtgctgctatgaacatctctccagagccctttctgcacagctggtgtcggcatcatactaaaagcaatgtttaaatcaaactaaagattaaaaattaaaattcgtttttccaataatgacaaatgccctgcacctacccacatgcactcgtgtgagacaaggcccataggtatggcccccccttccccctcccagtactagttaattttgagtaattgtattgtcagaaaagtgattagtactagttttttttttgttgtttcaaaaaaaatttttttgtgtgtgtttttttgtttgtttgttttgtttaaaagcaaggcatgcttatggatgactctgtaacagactaattggaattgttgaagctgctccctggttccactctggagagtaatctgggacatcttagtgttttgttttgttttttttccctcctctttttttgggggggagtgtgtgtggggtttgttttttagtcttgtttttttaattcattaaccagtggttagcccttaaggggaggaggacggattgattccacattccatttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccgtcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaagtaatttctaacttctttcactgataaatgaagaaaagtattgcacctttgaaatgcaccaaatgaattgagtttgtaattaaaaaaatttttttccctttcaaaaaaaaaccaaaaaaaaaaaaaaacaaaaaaaactcaggatagagattaacagaagcagatggtttttaaaaaaaagtctaagaaaatagaaactcatctgaggtgtgtatgtatttaaatgaggaggtaaaaataaatgttagaaatgcaaaggggaacatagctaaagaagctgcagaggttaaactgacagcatctatatgttattttaaaaactttataaaatacatttgaaaagttagatggaaatgacaaatctagaaaattataacttaccaaggttggctcaaatagaaatgaaaaacttgaaattaaatcagtagttactaattattggtagtaaaatcttccacaaagaaaatgccagaccagttggttttacaactgagttccaacaatcatttaaaaaatgaaacaaacaaaaaattctactcttgtgcaaattctcccagaaaataagaaagaaaaaaatattctcttcattttatgtgactagtataatcttgataccaaaccagaaaatggtactacaataaaggaaaaagcataagccaatctcactcattaacacagttgcaaatgtgctaaataaaataacaggttgccaaattgaacaggtataaaaaagaatgttttacaaatctgagttatagtccaggtatacaagactagtttatcattagaaaattcattaatgtaattaaacactgattaatggatagaaatccgtgtggtcatctcaatacatacaaatgttaacatcatatatgtatacatgaataaaagtgttagtaaattggaaataaaaggcaatctccctattgtagtaactaatagttacaaaaaacctacatgctaaaaaacattctttttaagatcaagaaaaagtcaaggatgtctgctataatcaattctattcaacattacataaggtttgttaattagaggtacactgaaataaaactaactaaataatataagccccagagaggaaaaaacaaaacaaaacaaaacaatcatttgttaactgtaagattacctatgtaaaacctccaaaaaaatgtaaggatgaattataagaataagggtttacatcaatgacagactggatcaagaaaatatggtacatatacaacatggaatactatgcagccacaaaaaggaaagagatcatgtcctttacagagacatggatggagctggaagccattatcctcagcaaactaacacaggaacagaaaaccaacgccacatgttctcacttgtaagtgggagcagaacagtgtgaacatatagacacagggagggaaacaacacacactcagggacctaactggggcaggggatatgggggggagggagagcatcaggaaaaatagctaatgcatgtggggcttaacacctaggtgatggattgataggtgcagcaaaacaccatggcatgtgtttacctatgtaacaaacctgcacatcctgcacatgtaccccagaacttaaaataaaataaattaaaatagaataaaatttatagagtttagctcagtaaacttgcttgatacaaaattaataa

SEQ ID NO: 16428 - DNA, 7266 bp, Human
aggctgaggctggagaatcacttgaaaccgggaagtggaagttgcagtgagccgagatcacaccactgcactccagcctgggcaacagagtgagactccatcgcaaacaaacaaacaaacaaaaaatatatgtgtgtgtatatctatatatatatgtgtgtgtatatacatatgtgtgtgtgtatatatgtgtgtgtgtatatatgtgtgtatacatatatgtgtatatatgtgtatatatatgtgtgtgtgtgtgtgtgtatatatatatctatataacgcagtgaatgcccttcctgaggagcactgcctctggggtagggagcctccttctctctcccacttctctggctggggtggtatgatggtggcctgtgctgtgcgaccttatcccaagagggaactgcccagctcaggagtgagcagaatggacctgtccctgctccccaaggggtcaccagtggggccagtctgagcctccactgcaggacacctgggcagaggcagtgtgttctgagaaagccggctcttgtgagacctgctgctgccatcgtgcaccaaggtttttctatgttgagccacagccccgtggggagagtctcggcccatgtgctggtggaggctgtgttgggagaggttagggaacttgctggaggctgacactctggaagatctctgctgagagagaggcctttgagtgtgggcctactttgaccggggcaggatgtgaacacaggcccctacctccatgctctccaggactcgctcagcctcccaagcacagaccctctgagtacctccgctatagagacggggaggggtgtgactgtccctgactctgcccagagtcccaggagcctttgtgccgtctaagccctgtgggtgatttgggtttggtaagtgccggggctcaaaaaacaacaccccaacgtggaagcctcagaaacaaaagtttctctgtcctgctcccaccctcctgtctccagctcctcctcctctgagaggcttccccaaaccctgccataaaacccagaaatatgactccagttctccactccctcccctttctgtgtagaaaccagcctaaagaaaccctctggcctgctttatttgactgtaggtcataagagctccattcccgaaagagtcctgccccacacctagaaggaaggagagctgctcagagaggccccagggaatctgactcaacaggccctaccaggctctcctcttggtctgtgagcatccagccttacttttgtatccaatcatatttccatacttcgctgaactgtgtttatggatagtttccaccagatctttggatcttcatcttgaaggctgccgtgccacataagctatgatcaaatacatctgttatgctcttctcctattcatctgccttctgcccgttgattttcagcaaactcccagaggatgaaggggagttttctgtttggccccacaggggaggagcgagcgagattgacgtggaagctgggcctctgaaggacacagagtgctctaagaaagggacgatggggcagatccatgttcacaaacacgcccatgtgaattcactctcagatgtctcctcgtgtcagcacgctgggtgccagcacgctctgatattgacacaaagggccacggagtcaccactcactccacacacactcaccccgtgcccacttacccagggagggccaggaatgaggatgccactgtggctcagtgatggcgccgagacacaggtgaacactgtaaaatgtggatgcctggaggcagcccacaccctgggccttggctgggggaaaggttccagaaacgtcatcacaacgatgcatttcatcagaactgagcacatgaatggggaggggcaggacttcctgaatgtcccaaccccactgtcccaccctctgtgtcaatatgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcaggtgagccaggccggcagtgctggactcagcgggggctggggaagaaggggaaggcgtggcaggcagagggctgagagctgcggtggggtcggcggtcaaggggctcagaggcaagagggacagatcctgaaatgccctggaagcccagccaaggaacggacccaccctggcataaaggcaggggaggcgggagcatctgagcagggagagggtgtggtcagcttgatccttgaaacatggggttgaccccagtgtatttgtgacaggcctggtgggagagtgggactcaaacctgtgcagtgggggcaggggcggaatgcaatccagggctgccatttgcaagtttgccaagcttgccaagcccttgagccctcggggctgtcctccaaggctgccggccataaacgccccagctctgcctcccacttgcccgctttccctgctcccattcccaggccccttgttgcctggtattagtgggtctggcaggaaggacgggaggaggctccatcctggcacctgtctgcgcagagctgtggacctcccttgggctccctgccagggaggagccaccggcctgagcctcacagaaggcccctcagggcggccaggaccagcttccttccgcccggggcagcctccggctgggctgaacagaagccgtaccctctccatttccccttccctttgacccctgtcctctccttctttctcactcccccactttcttccttccttcccctccccttcgggccccaccagactctgcctacctgctaaggggctaacccacatagatgctgataatcaaaaatgaaagcctgaaattttcagccctagaatcacttcaaagacatgaaacacttcagaatattgcttctattttcttttcttttctttttttttttttttgagacaagatgtcactctgtcacccaggctggagtgcagtggcaggatcacggctcactgcagcctcgacctccctgggctcaggtgatcctcccacctcagcctcccgagtagctgggactacaggtgcatgtcaccatacccggttaatttttgtattttttttagagacaaggtctcaccatgttgcccaggctggtctcaaactcctgtgctcaggcaatgcgtcagcctcgacatctcaaagtgctgtgattacaggcgtgagccccgacacctggcctagttctattttctaaatgtgaattctgtaaagatatcttttaaaaataaagttctgtttttggtagaaaatgtaaaaatagataaatatggagggaagaaatcccccctggaatacagacgcttcctctcccttccagccttttccccatatgaacattgctgtgagtgagatttacatgcaatgtaatttctttttgagcttaacattacaacataaattctcaaactctgatgttcattaaacaccccagccccatcctgggaacttgggcttggggctcggggtgttctgataatgatcaaagtatgagaattgaacccatgaggactttgatccaagatactggggtgtggggaggggcaggcacaggtgtcctgggaacacactttgagaagcaatggcaaagctgggggtccagctaatgtgttacattagaatcacctcggggaggccctgggtgcccttctcagccctccctccggaggctgctgaagcccagcaaagccggagtcagagaacaatgtccgcctgagggcagggctgggctgggctggccttctggccctatctgctccgtgcccaacccagcgccccgcacagtcggagctttgtaaatacgaggtgactgtctgcctacaaactttgtaaacatcacttgaaatggccgcagggtattgtgacatggccataccactatttgtttgctattgaatttgtacttccctgccttacttttgctattgcaaaccatgctgtcactaaggtcttcatgcacacagttgtgtcttggtcagatgatatgtttctaccaattttaattgtgtttctttccacctggacacacagctctctggcccagggctgggtcatcagcacaccctgctgctgctgttcagatctgcatcctggtcccgcttggtcccacagtgagaacgctttgctatcacatgggcaggctctgagagccctgccggcctggccttctcaaagaagacctgagagcttgggacccaagcagagaggaagaacagggctcagggtgcttgctccatgctcgctccacacctggggctcaaccctggctttccccggctccctgtgtgacttcagggcaggtcccttgggccctctgggccttatcatcttcatctgtaacagggcgatgcctctgccgtgtctggtggtgttgaggagttcctgtttgtgtaagcagctagttcagtgccagcacgagatgggaggcccatgaagttagcagtgcacaaaaaatagagcaaagactggatgcatttcctgagaacaaccatcactgtaaagcactttacaaatccaaagacaacccccggcaaaaactcaaaatgaaactccctctcgcagagcacaattccaattcgctctaaaaacattacaagttagttcatgtcatgccagatagctgaaggcagctcacaagttcttaaggccaggaatgccatgtgtctgctatgcacagctggccctggccctgagcctgaatgacagcaaaggtgacgcagatgtgggtgccctgctcctgcccagcagcagtgcttggtggaggctgaggccctgcacaggcaccctcactgctgaccttgagcctctctctcctctagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatgatcctggtctcagagaaactggttatttccttaaaacctcagtgtcctctccccacaaaacagaattcactaattaaacttgtcatttcattactcattgcctgcctgcagtggtgagacagatgaagaagacaaggcagtcgataaaaatccatttgttggccatcttctgagtgcccactgagacacagtcccacctttggccgtgtgaatgccaccatgtcctggacccaagggaggctcgggtacacacatccatgtatttattcatctacttcgtaattcatttagtcggtcacgtagccattcattgaacctgggcccctccatctctccaaacagcatgttttcttcaagtaacatacttctaatatttatttatttatttttgagacggagtctcgctcttgtcacccaggctggaatgcaatggcgccatctcagctcactgcaacctccgcctcttgggttcaagtgattctcctgcctcagcctcccgagtacctgggactgcaggcacccgcaaaaccacacctggctactttttgtatttttagtagagacggggtgtcaccatgttggccaggctggtctcgaactcctgatttcaggtgatctgcccacctcaacctcccaaagtgctgggattacaggtgtgagccactgcgcctcgcaaagtaacatatctttttttctttttttttttttttgagacggagtctcactgtgttgcccaggctggagtgcaatggtgcgatcttggctcactgccagctccgcctcccaggttcacgccattctcctgcctcaacctcctgagtagctgggactacaggtgcccaccaccacgcccggctaattttttgtatttttagtagagacagggtttcaccgtgttagccaggatggtctcgatctcctgagctcgtgatccacccacctcggcctcccaaagtgctgggattacaggcttcagccaccacgcccagacagtaacatacttttaatgatgcaatgctatttttgccacaaagactatgaaacaccataacagagaaacaatgaattccaagagagcattagaatcatcagtgaacaactgctcacatcacctgtatttagttttacgacactaatgttgggagcacccaaaaggactcaagcgaggtcttggatgataggtaggtaactggatctggttttaggacccctatcattttttggatacccagtatttaaagcctcttgctatgtttgaagacattttcactagagaagatctatcaccaaaagatcctgaacttggaggtggacacaacaatacgaggcttgggtggatccctctttggggaagggactgcagattgcaaatatttttgctagagagagagtcgtgttaggttagatgggagcagatacacacatttaaataaagtaaaaactaataatgagggagaagtaaagttaataatgggggaaacaaaaggggtggactgccagaatggaaatctttgtttctttttttctttgagagacggccttgccctgtcacccagtctggaatgcagtggtgctatcgtggctcactgcaatcttttttttttttgagacggagtcttgctctgtcggccaggctggagtgcagtggtgtgatctcagctcactgcaagctccacctcccgggttcacgccattctcctgcctcagcctcccgagtagctgggactacaggtgcctgctaccaagcctggctaattttttgtaatttttagtagagacagggtttcaccattttagccaggatggtctcgaggctcactgcaatcttaaactcctgggctgaagcaatcttcctgcctcagcctcccaagtagctgggaccacaagaacgcaccatcgcggctggctaattttttgtagagacggggttttgctatattgcccaggttggtcttgaactcctgggctcaaatgatcctcccaactcagcctcccaaa

SEQ ID NO: 16429 - DNA, 30054 bp, Human
attgcattgctatcctcagatgttgtctgtgctctttgagaggcttgggcctctcaaagctcctccaagttgcaacaattgctcaggactagaatccccaaatttcgcgtttttcagttctcaggtgagacctggacacaaatttttctgtctcccgatccaaggtcccatcactgagaaaatctttgcaaaacagtatttcccagagcaccctatattttgctttaaagtcagtccaggtcccctgacccccaccccgtaatggcaaaaggaatatcatggtctttatacctaatccaaaagcaactgctgccccaggacagagcccctcctcagggctcagcagatgattatagtgtgtgttatctggacctgagaactgcacagccaaagcctctcccaagaactaggcaattagggaattaagaactttctccacaatagtgttaagccctgaggtcaaacaacatatggtgcagtgcgtgagcacctaggcaagctgagtcccctaaggggacacagagctttcctgttagggcctgttgcagccacatttaacaatcaccccctctacagagagaagaggggcaatcaggaggcccactctggccggaccgctctgtgctctgtcccaggggagggtgcctgggcaacgggctgtgtgtacgctggtctccgaggcaagaggacccccaggccactgttagagactaagtttccctgtcactgtccttacaggagaggatggacttggtgccctccagtattagtgacaagcatttttctcattgcaacgtaataaaccagttttctggtcgtagacatcattcacctagcacttgtgctaggtgctagggcaccccacgtttgaccagctgtgtctgccctgagagagggggctggcagggggggtgttgaccccaaaaggctgggtaacggagaggggccagaaggaacaccaccgggtgagaagggccaccccgaacagaccggtcctcagaggcacctgccggccctccccagacagcagccctccctttcagcctgccctggcagctgcctttcctacggcttccacgaattaaagaacacactctggtcatcatctgtcctcaaggcaggtaggaatccaaaagggagagccgggaggtggcgcggaggacgccggctctgcccacgcctgggcaaggttgagctccgttccctccgggctgctcccgcctcctgtccgtgcagggcgcgtttccagccatcgccgcccagccgccgccgcacgccggggagagatcgtccggggtgagcagcgagcccggggacagctagcctgggtcctgtccctggacctactccccctgcagctggcggatcaggcccccggaccctcactccacggcgggaatcagagccgtcgggcgggggatgcagcgcccagactgtggctcccccgccttcccaaaggaatccccccatctgctccatccctctcgggaaacggcgaaatgctgccaaccgtccgcttagcgcaccgcggagcgactgagcagccccgccgaggctccgagccaagatttctgccctaatagtttctcccttctttctgtctgctccaccgcacccactaaatacgcggcgctcacacacggacacgcgtgacacgcggcgctcacacacaggcatgggacgctcacacgcgcgcgcgcgggtctccgtccctggcaccccgcagcaggggtgcagccgggggcagggggagccgggggagggcgcagggggccgcggggacgcgagcggagggctggatgcctgccgggctctctctccgccttcctcttccctcccagtcctgccgagctgacggcgtcccggatcacatggagcccccgccccaccccagcccgccccccgccgccaacgccggtggcccttccagtcgcgttactacccagagattcatttgtaccagggacggagggagagaggagagggaggaggggacacacacacacacacacacacacacacacacagagagagagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttttcctcctccatttctcccccagctcgcgggttctggagggcaagatgacaccctcaggtgtccatcacctgggcagcaggctttcacagggaacctgctagactgggagccaggggggataaggaaaagcttagggcaggtccaagtttaggaaattggagatctccgtggctgcaggctgccctgtgcgttgggagcccagccataaacaccttcacttctggcactagaccagggctacctgggggtgccccagatctcccagcagtggtttgagaggcaacagtggccaggagtgggtggggtgtggaggacatttttcacctggtaggactcttccttcaaatgggagcagggagggccaggatggggggcggtgcccccctcagccttagatccccagcctaatcttgctttctcttttaagtgtggccaaactggaaacacggccttgtgatttctgcccccctcgctgcccaagtcacttcctgcgtacctccctatctccttttaaagagctttcaaatggttcagaaaggccaggggtcaagcctgtgaggacagaggatagggaacagagaaggccggccttgtcattgctccccttctcttcaagtcagtgcttctccctgcagagctgttggccccctggttttatctgtgccttccctcaaacagggctctccaaccccaggggctgtggagggcctcaggtccggaccccaaagttctagggcctaccctgaacatcagggtgagcaacaccagcccaaaacctgttccaggagccttttcaaacaccagaagaagatcaacaggaacacgccaagtattttactctgtttcaatccttttaataagctgagattatcatcctcattctacaggtgaaaaattgaagcccagagaggctgtgcaatttgcctcaggtgcacagctcataaagggagattctctcctatatctgactccaaaatgtgcctcgttttcatcaaaagccatatggtttatcgggctttctggttctcaaagcacttttccatgtgaggaaaaggctaatatttatgaaaccaaggtgccgagctatatacgtttacatgagttcatcttgacaccagtcctgtggggcagagcttatttcttctgttttatagatgagagtaagggtaacagaattccaggcactaagtggcagcagcactgctatctccaaaactcttgtcctctggctttaaatccagggtctttccactaacaaaagctaattctgaaagctgctcttgtctttccacatccctgcttttcctcaaagccaggtgtaaattgcatcatctggctgaatgaggcgctcaggcttcctggaatctgaggaacgaacagggcagagcaaatgatgtgggagttagaggcccatggttggactctggcataaagagtttggtcagcttggctggtattttaaactatctatggaccccacctgagatggcaccattctgcctagaggcataaggccttcagtgggaggcctggggcacagcgtatgtgcttcttggaagagcagcagcagggccaccattgaaagacaggaaacaacacatagagaaattgctggctcaggaggctgaggtaaggggattacttgagcccaggagttcaagaccaactggggcaacatagcaagaccccatctcaaaaaaaaaagaaataaaaaagaaaaagaaaggatagaaaatttgcctatacattccacaaagcacaaggattgtccccagaacaacgttctagacctactacctagctctccaacagaaagggaaccagccactcaggcatggctgttttctggcctctccaaaagctgctataaactgccggcattactcacaggcagcattttttaagtagcctgcctgtgctctatccagtgagcagttcagctaaaggaggagccaagggtgaggggggggtcaaagcgaacctgggccacattcactctgcccagggctgtccccaaagcttagctgtcttctctgggatgaagtcagatcttagtggggttccccaccatggcttccctggagtctgctggcaagtcctgagcagtgcagagctctttgtctgtgggtccagcagagacacgtgtgtggccctgtcacagcagtactcagcctcgctgtccctggtgccaagcaaaatccctttggggctttctgcaagcacctgactgggtttcttgtccaggaatttgggagactctgaaggctgctctagtcatccgtgatgaagtaaacccccaaggagggaagaaacgactagaatgcccattctctggtttccatttccccttcaaatgacctgattcttcctgcctgcggtgggcgaagccacaaacaggtgtcctgtgctttcatgtacttgaaaactgcatccacttctgcattgtttttttttttttcttgttcaacaaccattcatttggtcacctatcatgtgccagcaatcattaatttttgaaaaccttggaatgtgatcgttggggcagcgttatgctttttgtttaggagaatgttagcaaacactcacattttctgagccaatactgattgactatttaggctggaggtggaaggatggtggagagaaggcaggggtcagggaatccataggtagttcaaaggggccatttttggatgaaaatgttcactgtgtatgagctatagacaggtcattgagggctggcagtgtttccaagtgcggatctgtcatcagataactgttaagatagtcgtcagccacgaaggaatctttctgtgttttgtttttattttctaaagaaaaaaacaagaagaatgggagttccagttcaaaagattgtagtgaggtatttgagtaagaatacctgagtgtatttctcaaaaagacttgtgaagtggctttccctggaattgttttaaaacagagtggacagcttccacttctgacattctgccagccagggctggcgtgagcggctgcctctgaaggccctgcctgtgcagcagcagcttatctagttcctcctaccttgacattctgataagggagctattctagtcaacagggcccaggatggcgggaacccttgccaagagccgtgctaagttaaatggtagagccaaagctttaatatgtgaccctggagatcctggctagtgcttaaaatgttaacttccattatcgttccaggccagagcaagctgagggcaaaggtcatggatcatctgaacagttggcaggtggcaacggcacttcctggtcaccagggatcaatcaatagggtggccagatagtatgggggacaggaaagggtgagggtgggggagaaatggaggggttggggagggaaggagagagcaaacttggagtctcattctcatcccctgtgacttggcggtccggggctgggtgtactgctcaccctacaccttctcccagatttcaggcacccgactttacagtcagggaggtccaatgccatcatcctacattatttcctgctgctcagaaaggaaaatgggagtggggtgcagtgcaagaaccaagaggacctcagatgcctcctgggaccaaacctgtgtcttccccttagagtgtgcccccacccccccccaaccccagggatgactgcactgctgagcacttggtgcctggaaccctgggcagtgggaggtgctgcttctgcttcagcaagggggctgtccagcagtgccagcagaagccatgggtgtcaggccccaggaaccagcccactggacatcacagtatgaaggcttccccggccaagtcaggttgctttgtgaagtgtccttctccagaagaactccctcaaaaatgagtagggagctcctaacacaggccagaccttgtgtaggcacctgagctagacagggggatcttccacaccgggcctgcctgccctctgagctctcagaccactgcctgggggcgggcagagctgctggagagactccagcatccgtgctgcgcgcccttagggagaggcacaggcatcgccggggcgaaggcaggctgctcttatggagcagggaaggcttctaagggggcttgagaaacaggtttgctggtgaaggggtagaaggagcccagggaggggtttggaaaggagggagccaaggccagacacagggcagtaggagggaggcctgggcctgcggctgtcccagggcacctgcccccagccccaaccacctctcctgcatctctttcaatctcccctgactcctcctagacactcacgcttggtcacattttatttcctttctcttcctctccctctctctctttctcagtttggttctttttttcccctccatttttgtcttttttcactcattctcttgatcataaatgccgtttagtgtatttatgcttctttaactcaatctctttgtctgctgcagtcattctttatttttccactaaatgctttgattttgagatcattatagattcacatgcagtttcagaaataatgaacagagatctgccattcccttcatccagtttctctcagcggtaatattttgcaaaactgtagtacactatcaaaacgaatacatagccaataagaaaacaacatttccatcaccaggaggacctcttatgtggccctattatagccacacccacttccatcccaccccaccctctccttaacctctggcaaccactggtctgtgtttgtcatctcaagaatgttatgtaagtagaattatacagtatgtaatcttttgggattggcttttttcactcaacaaaattctctggggattcatttaggagtgtgcatgtgtgcttgttgggggtgtgtgtgtgtgtgtgtgtgtgtggtttttttattgctgagtagcgggaatgtaccacagtgggaatcgtccatagtgggaaggtaccattgcttgtttaaccattcacttactgaatgacatctgggatgttttcactttgggactattatgaataaagttgctataagcatttgtgtactggttcttgtgtgaacataggtatacaggttttcatgtctctgggataaatgcccagaagtgtaattgatgggtcatctggtagttgtatgtttagttttttttattttttttcgaagaactgtccagctgttttccattgtgactatgccactttacactcccaccaacactgtatcagtgatccagtttctctgcatctttgccaacatttgttattgtcactatttcttattttagccattctagtgctatcttattgggtttcattttgcatttccctgattactaataccgtttaccactttttttttttttttttttttttgagacagagtcttactctgtcactcaggctggagtgcagtggtgcaatctcggctcactgcaacctccgcctcctgagttcaagtgattctccggcctcagcctcccaagtaactgggactacaggtgcgtgccaccatgcctggctaatttttgtatttttagtagagacaaggtttcaccatgtttgccaggctggtctcgaactcctgacttcaggtgatctgcccacctcggcctcccaaaatgctgggattacaagcatgagccaccacgcctggcctgttgaccatctttttatatgcttatttgccccccatatatcctccttagcaaaatgtcttctcatgtcttttgcccattttctaatttgattggcttttgttgttgtttctgttgagttttgagaatttttaagtatatattttagataccagtcctttgtcagtcagatatgtaatttacaaatattttctcctactttgtaattttgccttttcatcttaacagagtctttttcagagcaagtgtttttaatttgatggaagtttaattgatcagtttgtcttcttatggattgtgcttttcttgtcaagtctaagaactctttgcctgccctagatcttgaagagtgtctcccatgtttttctctagaaagttttattgttttatatttaagttcatgatccattttgaattaactttggtataaagtctgagacttaggtcaaggttcttttttttgcctaaaaatgtgcaattgctccggcaccatttgttgtaaaggctgtctttcctccactgaattccttttgcacttttgtcaaaaataagttgggcatatttgcaaaggtctatttttgggttctctgttctgttccatcaatctatgtgtctatccttctgccaataccacatagtctggagtttcctcataactgcagttatgtaatgagtcttgaacttgtgtagactgattccttccactttattcttttccaaaattgttttatctattctagttgctttcccttttcacataagttttagaataattttatctatatctataaaaaatcttgtgagattttgatagaaattgcattgaatctgtatatgaattcagagagaatcaacgtttttactatattgagtcttccaatccatgaatacagtatgtttctccatttatttgctattcttcagtttctttctttggcattttgtaattgtcagcagttctttttgctctgccatgaactaattgtgtcgccttggacattagtctttcagaccttcagttctctttctgtaaaatgtgtctaataacacctaccttgaaatgccatgggaaagtcaaataagttagcgcatgagcagtgccccatggcaagcgccaagatgcagttcccttcagctgggtctctcatctgttctttgtttcctcctcctcagctttcgttctaatgcccacatccacttacacttcactttgtctttcctttttgtcctttgcttttttaaatccttctttcattctcaactccttactctgatttttctatttctttctttctttcttttttttagacagagtctcactctgtcacccaggctggagttcagtggcgcaatctcggctcactgccaacctctgctgtctgcgattctcataccttagcctcccgaatagctgggactacaggaactcaccaccacgcccagctcattttttttgtatttttagtagagatggagtttcaccatgttcgctacgctgttctcgaactcctgaccccaggtaatccgcctgccttggcctcccacagttctgggattacaggcgtgagccgccgtgcctggcctttcctatttctttcactttgtttttctcttattctcaatggatttttctgtttcatttcttatcccatgatatttgtctatctcctctttcttgaatcatttaagcattccatttttgtggagttgctcagacactgagtgtgagtcaagggccactcagcctgggttcaactccagatcaaccacttactagatttggggcagttgactcaccctcctgcacctcagttttctcatctataaaatggggagaacagtatctacctggtaccttttctgaaatgattaaatgagtttatacatgtaaagcatttggaataaaattgggtatacggtacagccccagtaggtgacgataattactgggattttacctgttatgtccagtttctgtggctctttctcacatttaccatccctcaccatctcatccttttcacttgtatatgaatatattcaaactcacattatcttgctttcaggctgttgtctctgtgcacttctacctcatcttccctaatcatcactgataaattggcaccagcccaggaaatctgtcccttgggttatagacaggaaacaagtggtttttcattttgatttaattattaatcccttttattatttaatgtggaatacatacactgtggggttacaatgaagaaaatggattatcactgtgcggctcactttcaaagagatggcaggcttaaaaaggaaaagtaccagacagacagaaacaaacgtggggaaaaagcaaaattaattaatttgatttccgtgcccttttcatggccatgacttttcatacatcttctgtgagatccaggaggatgcatgtggattttgcaagtaagccaagcgaggtattaaagggaaggggtgtaaggagtggcgagtggcccacagtggctcaccagggagggcagaaaaatattcatcctaagcaaatgggagcctggcaggttgggaaactcagtcacaagctcacgggcctgctccatacgtacagtcctcaataatgggcttggtctgtgatgcaaagctacctgaaaggcactcacctatcactaaccctttcgaatctatattccataccttgaatcgggcctaatatctgccctttaaaaaattgctgaatatatttagactcacttagatacactgggcagagggatattttaaataccatcaaaatggtctttttgtctctgtattttctccaaagaattgaactccccaagcaaaatgccagatctgcctgcgctcctttcagactagaattctgtctccctttaaagatccttacatgaaacaccatttaatccttctctctctgcctttttgtgtttatggtgacctctcagtattttggtttctttaatgacaaagtaaccatggaattagtccacagcatttctagggtacgtgtttctctccagatatcaaaaaataatgcatgaggttttattacttccttaggcttgtggtggggaatcctccaaggatggagttaaaatgaacagccaatactctctcgctcctctgggctacccgaggctctgcaggccccaaactcaccttctgttgccccattcggcaccagccacccccctttgttgtgcagccagaagccagggccgcctggcaggcctattgctaaatctcccagtgtttgtattacataaaacttcacagtcggtgtttctgtgtctacaatgccagaatcctggaaatgagttaacccaaatttgtgtgccttctggcaagcccaactatccaactacaaaaggggactaatgtgataggattctcctgagccaacacaggagttgaaagagcccaacagaggtgcaaactgccattatgattccatgataataattccacatactaggaataccgggattatttcagaccttatatctgctcttaacctataccaatccaatccaggggggccaagtacattataccagtatttggtaggatagaatttttcctgataaaatggcagagatgtcatgaacattaggatttccacaaatatttctatttcttatataggaaagagacccagggtggtaacctgtagagtaacatgtaatgtggagcataggatgtggccaggagagtcagggttatgattcagaaccaagatggctggactcaaatgggtgtgaagtaggagggtgggaaagcgtgggttctgaagtcaggccgctgtcagttcaaacccaggttctgctgcttgcaagccatgtggtctctggcaagttccctccctgctctgaatctcagtctcctgatctgaataatggacacattacacttattccacagtgttgctgagctgatcaagtgtgttaacacgtgtaaggcacccagtccagagtagtgcacgcaaacacacacacacacacttcacttccagagctgttctgcaaagaaaaaccaaaaggcagtacaagctgctgcaggcaatgaattgatgacgtgtttaaaacaaaagcaaaaagagtgcaaaggccatggagaatgcggcacagacaggaaagatgctccctaaagagcttgcccaggtcaggatgtctccgagcaaaacgagggacactgagtgactctgggagcaacctcagtcctgcatcctcgtcaacaccctgactgttctcaacaataatcccacccatgtggggagctcccctttgagggactgaggcagcccagaaaggaggcacaggatgtactgagaaggggaaacctgggcgtcagtgacagctccccagggatggtgggtctgagcaacgctgatgcagcggagcccctcacccacctgagatgcctcgtccgccttcccagcagctcccttccgcagagtgcttaacagcttggcaatcagagaacgctgtgtgcacggacagctccgcggggatgaagtgtcccatctgacaaagactgttctgagatccgcgctgtccctgcctggctctgcgtttcactgaaagccccttgccctgattctagccctcagcccccacgcacagccaccggcgactctagccaccctggatagtaaaggtgccctttctggggcattctgcttcgagaagaggcggaagagctgtgcatgcctggagcccctgggagcccatgacagccaggagcatcctgggcataaaaatcagcacctggggcctcattccactcatctcgcacacctctgcagtcccttccacgatgccctcaccgctggtaatcagcatccattacatcggcgccaggaaccagctcaggaggccacctgatccgccctcctgtccctccagccctcctctggaaggactcagcgcttgcagtcagacatctctccccattgagaccatttttactgttggtgaactggaggactatcgcactgcccaagacactgttctctgcagcaggtttgcacagggtgccagttagggaggagaaggcagcgaggaaccccgcactttaaggaacagggatgtcatagcagccgtctgcatgggggagggggctggggagcacagggctattggcaaggagacagggctagttaggaccaccggaaccaggctgatgggcactgagggggtagcccaggcggccctctctactatcatgggccttgcagattgagttctcctcttcctgccgggccgcctgcctttgttgtcctgaggactgacaggtaatgtttgtggcagacctgttggtgcaaacagggaggctgtgagaggaattcagtggcactaccacaactcttaacagcactctcagcctaactcacaacgcagcccaacatgtccatgggcagaaaaggcctctctccgactccctagcccagaaatacgaaccggcagctgacagactgaatctgactcacacatagattctctatggcttgctcactttttcaaaaattgttgaattagtggtcaacatggaaaaaaaatttcatcttcaaaagtttaatttctggcttttctggaaaaagcaaagggaggatcttgcagtactggctccacggcatggcaaggcaataatgaactagagccgagtagcagctgccgctttagaactgcgtgtgtgtacagctcaccacagtccccaccaccccctaccatgtcccccaaacccagggcaagttttggttgcatttatcatgggtttgtatatgtgcttttcctaaaataaagagaatgcaacattttaaatgtttctctacatcaaaatatgaaaatgaagctctaagacatcccatttaaataaaaataggagaaagcctactaattgcacgtgaccaagaaggatgtagagtgtgtctgtgttggaagaacgcgatccggcagctgcactcacctcacacagccacagccgtgggtgtagacggcagagctcagcacagactcacaggttctggttactatggcatgcacatcctgcccagctgagaaattccagagtgaggaggtgttaccctcactcctgacagaggcagacctgccttagacgaaggagaatccagtgaaggggtgttaagaatgaaatcagtggctgctagttagtggtcttgtttctactgcgggggccgttgtccaagcagaccttcagagagtgacggggcactcttggtgatgatgccagaatgacaggtgttacctgggatgcatggacatcttatttcctgggagcaatcagggacctctgggggcaagtattgtgcttagaaacaccgaggagcagctgttagatgagtagggagcatgctggaggggagcaggagggagagggagaacacagccctggctggcgggaagtgacccgagctgccgggcagcttgtgcacagcggaccacatggcaggaaatcatgagttccttccctggtgctccccccggggctcagaacaaccccatcacacccagagggctcaggaggaaccaacctcccaggcagcggtggctgcacttagagcctttggaatcagacaaaacctagcccgctgcttagtaactgtgtggcctgaagcaagctaccacatcactctgcttttgtgacctgtaaaatgaggcgactaaaacggacttaatagatctgtttcaggattaaatgatacaatgcatgaaaaacactcagcacaaagatggcacagaacagggattccatgctggagctattattactgtttgctcccctgttctcaggcccacaaggctctgccacctcaccctgctcactggacgccttcctcaccagggccttcctgactcttcctcgcccaccccagacaagccaaattcaggactgcaccctggcctctctctcactctctacggcactgatttttttgcctgtgtactccccaccagaccaggaactccttgcggacagagaacgcatcaagggtcgtcaatctcattacctgttggagtcacctggggccagattctgggactaggcatcagcacgttgtccagctcccagctgatggcagcgtgcgtccagggcggagaggtcgtgctactcaggtgtgcactgaggaccagccgcgtcaacatcactgcggcttcttagcaaaaccgcggactctggaaaccccagacctacagaatcagaacccgcattttagccagatccccaggaagggaaagcacaggaacgaatgccagtgaagtgtgagtcgacctccttctatccccagagctcaacataattcaaacacccagtgggtgttgagtgggggttcgctgactgactaattgactgagtgagtgaagccctgtgtcagcttccactgggatttcacacctactccatcatgtgctatgaaacaaacaggctcaaaaagcaaacccgtaaaacgttcagaaattcaaaaatagacacagacctaagttgatagaacaaatagctgcaaaatggtgcggtttttaaatgaaatacctgacgggtttttaaagatttattaccaccgggctctgtgccattaaacctccgagtacactagaggataattttgttttgttttaaggttggtaattgtgaaaagctgggaaaccaggactggcccctgggaggatcctgtccaccggtgtggcttgggcacagtctctgggtggctggggccgctggcccgcccttcctccaggaagagagacccgctggcggggagtccccggcactgccaacggcctccccacgcccgttccctggggacagggcctctgtctcccctccgcaggcccctcctggctctcaccctcccaccccgcatcccccagccccgcctcctccgcagccgcagagctgcagctggccagggggccacacccaggcgtcgagcaccgccttatccagccgcactgggggcttcgtcccctgcggggtgaggggtctcccctgtgtcaccctccgaggccacgctagacgttgtggcgctcagggctcccggttcctgccgcgctggggctcccccgtcccagcctccctccccacctctcccaggctcccctcccctgtcgcagccaccctcccccgtcccaacctcctccccttctctcgcacgatccggccaagagatggcggggtggcgggaggggcgctctggcgaccccggaagcgagaagcaggcctctgcagggccagggatgaaggtgcaagggaaagccctgggacctggaccttaggcgtgggagggacgaaagggaaaggtcttagaaaattcctcaggcgtggcttctgggggggcggggcggggggaggaaaggggcacgggttcccggtctcgtagacgctgcagcggagcagagcctctaggcatgccctcatctagagcagctgctgcggaatccggggagcctgcagcactagccgtgcgattccgggcgaggtttttaaactctcacctgttttccccttttgtaaactgaagataatgcctctctcccgggagtgggagcacgatgctgacacaccgtaggaactcgggacttgctgattctccttccttatcctcaaggcgtttgaagcactcctgcccctcacccccacccctccagcccctttcccagccctgccccctggtggaaaatcctaagagctacctctcaggagggctcctgtaaaccaggcactgtacacacacctttcatttcatcttcgcagcagctctttttggtgagtactgttatccccattttgcaaataaagcaacggaagcttagagaagtaacttttccaaatgtgcctcagctccaggcaaaataggaacctaggtcatctgatgccagagtcagccttcctaactgtttatgatccgacttccctttctgtactggattttctatttctgccataacagatgaccacagacatagtggctggaaacagcacccacttatcagctcacagttctgtaggtcagaagtccaggcttgatgcgactgtgtcctctgctctgttcccacaaggccaaaaccagggtgtcagcgaggccagcattctcatgtggaactcagggcccccttcaagctcctgtggttctggcagaattcaggtctttgtggttgtaggactgaggtcctcacttttttgctggctatcatctgggggctgctctcagctcccagaggtcacccacattccttgccgtgtggccccctccatctttaaaaccagcaaaggagaagccccctctgtctaattcctctaataatttgaatctcttacttcgggaaaagcccaatcccttcaaagggcttgtgattgggtcaagctcaccccagatgaactttctttcttcagttcagctctgccatatgacatgccccagtcatgggagtgaggatttcctggggttcctcagggggtgtataccagggggcaggaatcacgagggtgtgttggaattctgcctacttacaagtgccttctctgtccccagcatgtattctggtgttacattcaagtgtaacacctcgaatgcttcctgctaaccctaaagggccttgaggggactggggcagcctgttcaccaaccagtttggagcattttcctatgagtacagtcatatatattcccacagaagagtatacaaatatctccatatgagacataagcacgccctcctccattcctcttcctccaacttcatcccgtgtttcaaagctcagagagtggtacattttgatccagcatatcttagaaagtaggaaattgataaagatgcttgtgatcacagatagggagactgagtctgtgaaaagactcccaagccagtggtctctccaggaagccctgctgacccccaagcaaggctcttaccaagttgttagggccctgactcctgacattctagaccacgccatgacaccaagttttcctccctgtgggtgcgtgatgtttgacattcttcattcagaggtccatctaaatggatgtcacattcactaacgcatcatctgaaatacaacttcctttgattttgcctcttttgagtctttctccacttgtgttttcctatcaaagggattaaaccactttgctggacttgaagctctgtcttttccaaaagctttcatcatgtctcaacacagcttcccattcacagacacaggagaggatggaagaagagaagtatcaggcttgatgaggcttaataggatttgctcaagtcagtgcctttccctgcgtcctgcagagagtagctaggatgctcagcttacctaggccagccacagcattcctccctgtctgtcctctacagacagttctgcaaaaaccctagcttcaaagaggaaatgctagaatatcaactatgggagggctggctctgcgtttatcttcttcactgctttatgtccagctcctagcacaggggtttggctatagtagttcctcaattaatgtgtgcttaatgagtgcataattaatagaacggatctcgaaaacctgattaaagaatttcatctccattgtccctgaaaatccttttgacttgataggcacacaacactggaagccagggtttcaaggatggggattttacttacccttaaaagaaatctaaacagtagaggctgcatgctggtcagctcaatgcttgccctgcaaattgcccactgggcctttagctatttgtcttagataatctctacctctctttcttcatctttaaaatggggttaatgggatattgcattaaatttcaatttgaggagagattatgaatacgtatgtttattttatttatacttatgtttgtatcatgtattctttccatgaatccctacaattggctcccagggctggaggagcagaggatattatctgggatttatagcagagtaaactgaggcaaagaaagttaagtttgtttgtatttggaccacaaagctggtttgttggacactgagtcagaatccagatgttaccctgggttgagcaagggatgacttctgcggatgattccagcgcacaggaatgcgtcccaatatcaaatcaaaagtaaaccaccctttcctatctgccagacgcaaaaagttttcctatctgggctgaagtctcctagaaaacattttcccgtttctagtacggcacaaagccttcgcctacaagaatgtatgcaagtatgtttaaaaataaagaaggaaacagtgcagaaaatcagcagcaagctgtttccccaaagagctgagtacaggaggatgtgagctcccatgtgccccggccaatgactcattcttgtggcactgtgcctgccctgcccaacctcagtggctcagggagtccgcagcggcacccccattggaagcctatcttggttccaacagctggggtgtccagaatacacggggcctcgggacagcagcattttccatcatctctgagcatctgtgattgagttttcaggatgaagtctcccacttaaggcagagcaaattcctgcttgggattctgcaaagatagccccaagcattttcctccttgtctcatttatccttgttaactgccacatgaaggagcaggaagcaggtggccctatgcagaatgggaaatggccaatggacatctgggacaaagcccttcagatgaccttttgatatgatgttttaaaggttatcttgaaattgctataatcacccaggcagcacaggaaaaggcctgccagggtcatctgactccccaggacagctgggatctaccttggtttgccattaggcagtcagctcagtggttgacaggcctttttccaggttgttctactggggacacagcttcccggtgttctgcctggtggaacctgcagctggagtcaccctcagaatggtggcaggggaattcctgcaagggactgcccaaaccatccccaaatggggtcagttgagattccaaagaagaaatcaccaagttccaaagcacttattaggggaacttacatgtagagcgctgcactggtcctcatgacagacagcaagaaaagaggtgctccgcttaagtatgtctgcggcaagggctctgggttatggagttatttggcccaaggttgggctaattcctacatgtttagcaacatgtttaatctttcagtatttcaggtaacaacctaaacagggtttcagtgccagggaatgtttccagggctcaggcctgcaggaaaagacatgcagctggccaagtgacagagcagtctaggcattctgtgtttctcgatcaggacagataagtaagtgggggttcctgggggaccctatacccgggagggagggtaactgcgaattcaaggaagacttacttataaagaggaagaagggttgaaagatagtatccctaaggtgatgtttcccagggccagaagctcatagaactttctgaagggagcaggtcatcagccttagcatgagccccggagcatcagtgtctgctggccgttgtgtggtgagtgctgtgggtcagcctttgggctgcagccagataaacctagacccaaaacctcacttggtcacatgctaagtgagcttcattcttctcttctgaaaaatggggggataataatggtatttatctaaccatgttgtgaggattaaatcagccaatggataaaaatttcctagtgcagttcctggcttctgagtgctcagaaatgttgtctgttattgttaattaaagaggtctttcccaactgaatgagagtcttaaagctcgttaaatgggttttgaggggactatcagacacctgtattgcaggtgtgtgggtatctcttggaagtgtggtaggcacccccacaaacacattacgccctttgaagagctttggggccattaacatcctgtccagttccatttcttagaggacagggaatcaaattttctaatggcgggcctacacagcaatttgtcattttaataagcactcagatggctgcagacttcacactcagacggtaggggtgaccaattgacaaatcagatacatgctgccttttcctttctgtctgctgctaaaagacctcaagataaatagagacagcaaggaatgaaagaaacagcacaggcttgggccagatgagcaggaatccaaaaatcagctctgcctgatatttggtggcctgggtgtcacttaacctctttggaagcctgtttttttatttatccatccaattactcagtaagtactttttgaatacatccatgtgccgggctgtgttctaagtgcttggaataccagagaacaaaatgaacacaaacttatgcccctgtggagcttacattctgatggtgggagagagactgtttgaattaagcctgattcataagcaaacaatatagtatttatatagtggggattccaatatctaatgccagtgaattgctgtggcgataagaagccacaatccacatgtaatgcgtgggacacagtaggtatttaataaactattgtgattattctttttaaattgctcccaggtttctcaaaccctttcaacacttaatgtgtagtttgcacctagatattgttcatttattcattcaacaaacagctagcaagcatctattttgtgctagactctgtactaggcaccagggatacaaaagaaccctataagagagtgaggcccctgcccttgaggatttcacgccctgacccctggataacagaagagaagcctgggagagccccggggtgggggtggccttccatcttgtgttctagtgaatcagaacagcccacttcactgatggtgtctttttaactcaaagcatcccagctatggctggcgattctaggaatgccatgaaccaggacatggagattggagtcactccctgggaccccaagaagattccaaaacaggcccgcgattatgtccccattgccacagaccgtacgcgcctgctggccgagggcaagaagccacgccagcgctacatggagaagagcggcaagtgcaacgtgcaccacggcaacgtccaggagacctaccggtacctgagtgacctcttcaccaccctggtggacctcaagtggcgcttcaacttgctcgtcttcaccatggtttacactgtcacctggctgttcttcggcttcatttggtggctcattgcttatatccggggtgacctggaccatgttggcgaccaagagtggattccttgtgttgaaaacctcagtggcttcgtgtccgctttcctgttctccattgagaccgaaacaaccattgggtatggcttccgagtcatcacagagaagtgtccagaggggattatactcctcttggtccaggccatcctgggctccatcgtcaatgccttcatggtggggtgcatgtttgtcaagatcagccagcccaagaagagagcggagaccctcatgttttccaacaacgcagtcatctccatgcgggacgagaagctgtgcctcatgttccgggtgggcgacctccgcaactcccacatcgtggaggcctccatccgggccaagctcatcaagtcccggcagaccaaagagggggagttcatccccctgaaccagacagacatcaacgtgggctttgacacgggcgacgaccgcctcttcctggtgtctcctctgatcatctcccacgagatcaacgagaagagccctttctgggagatgtctcaggctcagctgcatcaggaagagtttgaagttgtggtcattctagaagggatggtggaagccacaggtaaggcgctttgtcctcctcagccacaggtggccctacctacacttcagacttaggcaactgtgactccagaagatgcaggtctgtgcctgagagtcctggggtggcacaggcaacacattcaatccctaaattgtggtttgaggggtactggtactcaagattgagtaatagcaatagctaacactgacaggaacttcccaactttcaggcactgtcctaaacaataaacatctatcatctggccaaatgtcctcccacgccctatgagatatagtgggttattgttgttgttgttttgtttgtttgtttgtttatttttgaggcagggtcttgctctgtcacccaggctagagtgcagtggcccgatctcggctcactgcaacctccacctcccggattcaagcgattctcctgccccagcctctggagtagctgggattacaggtgcccgccactgcgcctggctaatttttgtatttttagtagagacagggtttcaccatgtcggccaggttggtgtcgaactcctgaccttgtgatccacctgcctcagcctcccaaagtgctgggattacacgcgtgagccacagtgcccagccaagatagtttttattaaggtacagataaagacacagggacacagacaggctaaattatttgcccaagagcaagcactttcgaatgatagagctaggatggaaattgagaccagggaccccagagccagcacttgtttccaacaggacaaactgccccttcttggaacaagtgttctacccagaagagctccctggtcagatagctctggtaatcacagggcgaaacaaaagcgaactggtttctttacagtggacttctcgctgtccttacccactgagtctcatcactgggagaggaggggatgcagaatttcctaaactcaaaaggttctcaccaaccccttacttggagagacctttgctgcaggggaagggcttttgtggctgggctccctctggggcagccagccctcagcattcttgcagaaggttggtttagtgaacccagggcaggtgaggctcctttctcacaaaaaaacagtgcatccatgctgaggcatcaacatccatgtatgcccaagaaaatgccctttgtgtggccagcatggcacctccctgctcagctactgactcaccagcagctggtagccaaggaccccccagttcctcagccactcagccatggcagacctctgtgaggtggctccagggagtccaaggcctgggaccgcctgaactctggcagaggaccctagtccccaccccactcgcagcaaaaccccacatcctgcatatttcatttcttcctcgtgccttcctttctctctctctctcttttttttttttcaaccaggtacaatgagcagctggtcaggccctaaggatgggttctagaaactcagtcacgctcagaatgatgcatgtctatttttccaattcttgcaaatgacagtgtagggctggcttcagtctcattttacagatgtcgaggctgaacctaaaaagcattatgtagacagtgagtgttcatattcagctcttccacttacaaatctggagcttctctcaccactctgccccactaaaatactagcggcctgtcagaaagatggccaagcacacattccagcccccaggaaactggctgccgggcaggggactcagacccagactgcacaagccttcccattttgaagttggtggaaccaggagagggcaatgacaagctccagggactggtgccagaggtggctgctcggccatctgctgggggctggagtctggcaggcagcatatggtggcaggtgggcagccccggggccgaggacagtcaggactcaggagggtttcccccacagagctaggggcttgcaggtcaccctgcccttgcctccagggtcagaatcaacaggctgcatttcaggggaagaactccactctgaagccacaaaaaagggattgggtgagagacatggggtcaaatcatagcacacctgaccactctccaaggccatcctcactccccagccatgcagcagggagagcgcccacaggctcgtagtggagggagccagtgctatctgccccgctgccccgctgcacccccaaccacacctccctcaaagtcaggggcccgccgttcacttgtcctcacggtttggcctccttcccctcccacaacccgggctatgcttgctctgtcccacaaactgtaggggagatccagggagatagggcaggagaccctggcccacatctgtcctggatgtgggtggtttggttgtcaagcacatgcagccaggtgtgggctgggaatccatgcctcagcttgagtagcacaactctgccgtatcctgcctgagcgggtttgagcaagctgcttaccttgtcagcaaagtgaggaaaatcaatctcttagggctgttgggaggattcaagatgaaaaggagctgtgctgatcactatacctgacacctggggaatcctttccaaacgtattgagcaatgacagggacacaccaggatctctagctacagggcagccgctgccacaccccatgaggagcaggaggatcccaaaggggaaaggtcctgcccatacctttcccaaggccctgggaggctgcagacgtctggcatggtctaggctgctcagggcccggtttgggcctctctgccaaggctgtggggacaacaagggtaacgactgaagggagaggcccggcccaggcaggcatcactgagagcagagagcaggctgtgggcgcacctgtgtgggtgcgctggggctgagaagcagccttggacctgggtctgctttgtatgagcccctcccagagaaagcccaaagtgggagctggagacggttgccttcagcacccaaccaacacagttaatgccttccttggccagaagattaaatatcagaaagctgctttcctgtgaccctaagcacagaggcctcctcatccataaacaaagctgccctcctctctggagagaaagcaacacctaaaaatagcataggcatggcacgggctgagtagacagggaaacgaggcattggagcagcctcaaatcaagaagccaagctctgtgtgtgcgtctgctcctcttcctgtgtgtatgtgtgtgtgtatgtgagtgtggagccctctctccgtatgtgtccgcccaaaacaatccccatatgttccaaatgcctgtcagattctccgtgttcattcatgctgaatttatctttgccctttcctgccttttttcccatcttaatcttctagacctgaatgctgttttcaggaacggagtccctaccttcaactattccaacatctattcactccaatctctaggaaatgactttcagaatcttgcatgtcgatttctaattttctgccaccactacgccttgaactcctccagggcaaggactgtgtcttattcagctttacatttccactatgcttagcacaaagtagatgttcatgaaatgcttgatgagtgattggatggttgaaggaatgcatgaatgtatggataattggatggatggatggatggatggatggatggatggatggatggatgactggatgggtggacgattaggtagatgagtggatggatggatggatgggtgataggatagatggatagataattggaaggatagatgaataaataattgggtggatagatagatgatgaatgattggatggatggatggatggatgattggatggatggatggatggatgattggatggatggatgaatggatggatggatggctatatctttgccctttcctgcctttttttccatatctggatggatagataattggatggatggatggatggatggatggatggatggatggatggatatatctttgccctttcctgcctttttttccatatctggatggatggatggttggatggatggatggatggatggatggttggatggatagatgattagatggatggatggatggatggatggatggatggatgaacagatgactggatggatggatggatggatagatggatggatggatggattgatggatgaatggatgaatggatggatagatggatggatgattgcatcataatgcatgtaacttccgtttccccaggcatgacctgccaagcccggagctcctacatggatacagaggtgctctggggccaccgattcacaccagtcctcaccttggaaaagggcttctatgaggtggactacaacaccttccatgatacctatgagaccaacacacccagctgctgtgccaaggagctggcagaaatgaagagggaaggccggctcctccagtacctccccagccccccactgctggggggctgtgctgaggcagggctggatgcagaggctgagcagaatgaagaagatgagcccaaggggctgggtgggtccagggaggccaggggctcggtgtgaggggtgcagcctccctaagacctcctgtcactggcttcagtgaacacagacactgcagagcctgggagcaggggaggggaatagttgagtgtgctgtttgggggctcaggagccatcaaggctgtggggaggaaccataaacccagccctcacagctcccagcacagggcctccctgagccagtggcatcctgcctgggccccccatggcagtgctgcctcttgtaggtgctggctaagggccaggccaggatgagtttccccatggtgaatgttaccggatggcatctgttctctccatgccctgggtcacttccttttttgggtctcacagacccctccaggggctgacacctagagagaaccatcaccttgtccctcattccttccaccctgaggcttgctgtggactcagagaggagacttacctgatgagagctcaaacctctagtctgggatgagctcacagagccctcatgagttaagatccatccatatcacataggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttctagtgctttttggcccaagaatctcagagtgcttctaatcatcacagtagtttttgtgttttgttttgttttgttttgttttgttttgttttgtttttttcacaatctcagccagcctgtggtgtgacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggccaagacactctgacctcagggctcagcaccttcaccatcaagttcagcctgagccaagctcccagcccactgctgaaaagcccctgggcctccctccgcaggcagagttacaaccgggagggctgggcagggagggcagggagattgcctggggaaggcaaagggaatggctgcccctcccaggctggaaacaagagggcaagcggggtcagcaggagaattcgggggcagggtgagtgttaagagaaaaagagtagagaagagcctgaaaatcagcaacttccagggcttttctgatctggaggcccaagagcaagggtggaggggggcagattgtcaggtcccgaaatgtgtgttgacacacatgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagatgtgttttctaggcctggggctgaaaggaagaggagtggggcagcctgggacgggaactgcctctgtgggctccccactcccagggaggggctccataagctttgctcctgggctggatcttgagaggtgggcagggtcttcccaccagtggcagggtgtgcagttgtggtcccaagccttggagggaatggggaatgggctggcacccggctcagggaaagcagaagcagacagtgccccagcaggggagctgcatgcccccaggagtctcagaaaggcaacccatcactaaggctgggtgcctttcggcagagctacagctggagccctccggctgaggccagcactcgcctgggactccctggaccccagggttactaacagcaaaaccattccacacccccttgccagatctaagcctgtcttaggaccgtcagtgcccccaggttagagctcatgggggtcaactaagcgagggagggaaggcgaaggcaaagctggccttgcacctggacagcggcctggctcctccccacacctgccttcatttatgactctgaaacatcccccacctgaccaagggagccactctccagttctctcactccaccagggccctccgtgagccaggaccgggtcacatctctcagccaagtctagaagctctggctagaggagaggaagcgtgcagagggtcctctgccaaagctccctgcctggcccgagcccgggcatgctgggattagtgcaacaccgccccagtgtgcctcctctgcc

SEQ ID NO: 16430 - DNA, 57726 bp, Human
ctgttcacctatcactacattttcaagtaaaggtggtgtatccatttgctagggtttccataacaacataccagggctgagtggcttaagcaaaagaaatttatttgctcagagttctggagactggaagtccaagatcagggtgccagcagggttggttttcctcagaggcctctctccttggcttgccaatgactgctgtgtcctcacatggcagcccctctgtgcacacactcccctgggggctctctgtgtgtccaaattccctcttcttataagaacaccagtcatattggattagaacccaccctatcagcctcatttcaccttacctccttaaaggtcctatctccaaatacaatcacattctgagtactgcgggtaagggcttcagcatatgaattttgtgaggacacaaggcagcccctaacaggtggcctaagagaatctttgtttgaatgctaataatcatgatacctaacatgttctgagtgtgactcactatgtgccagagacttctaagtactttgcatgtattatcacaactattatcacaattatagattatataattattgattatatagattatagatcaattatagatgactaccatcttctctgaagacttactttggtgtaattatgtgactgtagtgaacactatgccctggtccctgaccttggatgcctgtgattcgatgagacatggaataatgggagactcttaccctcatgttttgattggtagcagatctccggaatgtgcaaagttttttagttgtcgttgttgttgttgtttcgagactgtcgcccaggctgaatgcaatggcacgatcacggctcactgcagcctctacttccggggctcaagtgatcctcccacctcagcctcccaagtagctgggcacatgccaccatatctagctaattttttctttctttctttctttctttctttctttctttctttctttctttctttctttctttctttctctctttctgtttttgtagaaacacagttttgccacattgcccaggctagtttagaactcctggactcaatagattctcccacctcaggctcccaaaatgctgggattacaggcatgagccaccatgcctggccaaggcttcttttcttaatccatgatctcccaaagtcacacccaagtcagtgatgggataatatgagtgggaggacccaacaacctcttttggagggtcttgccctgactggcacttcacgtgtctgaggttcctctttcgtcctttggctggctgagtcatcaacattgagatctacaggatgcaccagcacctcctagagggccctcagcaaaccactgagcatttcttacaagctacacccccacaccagatcttctcatttaatccacctatcgactctgtgctaaaactatttttatccctgttacaaataaggaaactgaaattggcctggccacagccatgggcaccacccttcccttgtgtgaccttgagcagcacacctagcctctctgggtggatctcactggccttgcctggaaaataaatgctggatctcatctccccttcattgctgatgactccactcagctcgtaagaggcatttctgcttatgcctggaaaaatctagcattcacacaccaccacaatactatattccatgccaagtcaccactattcttggcctccctatccccaccctcctttttgggggtcccagactacagaaccaataaacaaacccactttcatgattcctccatccccactccactgcccaaagtccctcctcacccaggtaacctgcaaacacccatctggtttgcataagggcaaacctgccccctggagtgtgagtcaaacaggaacttccagacaagctgtcctggggcagccctgggccaccttgccagctcaaagcaagagtgtcacttgcttgggtgaagagtgacactgggctttctgtctcttctctggccctgcaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccaggtaagctcaccaggcctgtgcaggattgggggaaggcacaaagtcgccagatctgcagcaagtggcttctggcacttaaggtttttgcagcagatggggctctagagctgggccaggaagcctgtgtcagtccctagagagctaaggcagagagggccacagactgatgatggggtggagtagggctaggaagcccccctggctctctggggcccacgaagccctcagaggccaggtaggagtcaggccccaagcgcctatgcagacactcgtggaacacttatttcttgttaatcccaggcccaggtccagtcctgttggggacagcttagcaataagctactcttccctgtcctgttgaagatacttaacccctctgggcaggtctcagcagagcaaaggtgaccaaaccattctttagtaagagtggagaagggatgaggaaggtgtctaccttcctgtgggggctcactgtgtctgggagggggcaggcacctggaaggcgtgcatgaagtgggtacaatactgggtcagttcgggctttgcttgtagaaatggagacaggagggtccagggagagaaaatcacagggtcatggaagaggacagtggacaggcggcctcagttttgcgtcctgcctctgccccttgggcaagtcatcgaaacccctcagagcaccagctttctcccttctcaaacaggactgggatattcacttccttatggtccttactctagcgttactctgatgcctcagggaaaggacctgggatggtgcctgagacgcgttaggaaagtgctctatagtgacagtgattgttatgagcaaagacttgaaagacagagaacatcagtcttattcacaaaatatcagataatctactgggccaaaggcacaaagagatgaaaataaaaagcaacagagggccctgaatggcaggctgaaaacatgtgccatttattccacagccagaggctgactttgagcaccgatgtgacatttaacccagaggctgactttgagcacagacgtgacatttaacctcatcagagcagtgacttaagactagcgagctgacagtccttgcgcacagacggtaggatgggagagtcagaaagacaagtgaagaagttagtaaaatatcccagataggaaataatgaagttctgaactaagtgatgatagtgattttggaaagtgaaaaggacagatacataagggcgatagcaaagagatgattaacagggcttaggtgagtaaagtgtgaatgaagggggtgcatgacaggaaagaatcaaaggcgactaaagcctgcacattttaaaggctggtgctgtgagcagccgcagaaaggtggcacaggaaatgctttaggatgggatgtcagtgttctctttgagattccttgtgagcaatgggtagaacatccagataaaaatgtctactaggctttgggaactgaagctcagataatctttcaggcctggaatttacgtttgggcatcatctctaaggagtctgaactgtgaaagtggatgaggtcaccgaggaaactagtctagattgaagagagagaagggaatgagcatggttgggagggagaactcctccagagcagctcatggcctcagacctgcctgtgggaactcccaggcctaccacatttcaaccctactaaccaaaaccagtgactgggatctcagccacctttccagatcccaggatttcaggaaggctcagaggttctgagcctgcagcccctcagatgaatctctctccagatgtaattctgatggtgccggagctcctaacagtcgaaggacatggtgtgttgaacgttttcccatattatcttaccacttgttcctcaccactatactaagaagtagttactgtaacttcactgttacacaggaaggcaagcagggctttcaggggacagtgctttgtctaaggatttaaaggaggcaaagttggagcccgaacccaggcgtttggttccagccccacgtgccatctgttaggcacctttctgctccctctgcttgtgtgtcatgcttttgcaccaccacctcattcctgccaatgcccacctggtgaggaggcctattctacgatgcctcctaaatggggcccttctccaaggagctcccaatgcttgttgaagatccagatcccactggtggagattccttttttttttttttttttttttgagatggagtctcactctgttgcccaggctggagtgcagtggtacagtcttggctcactacaacctctgcctcccaggttcaagcaattctcttgcctcagcctcctgagtatctgggattacaagcacatggcaccacacctggcaagtttttgtatttttagtagagacggggttttactatgttggcccggctggtcttcaactcctgacctcatgatccgcctgcctcggcctcccaaagtgctgggattacaggcgtgagccaccgcacccagctttgttggagattctctggcctgttgtaacctgaatctgcctactccttacctccactgcccctgcctggtgcaagccagcagcacctctcctaggcttctgcgggggcatcctgctctccccacttcctcctgccttcctgaagtctattctccggacagcaagcagccagagccatgctttcctcgtttgtaatcctcttgctcaaaactcttcaatggcttatgacaaaatgcaaagcccttagtgtggccccaccatccctctgacatcctctctactgccccctccctcccacttcttccctccgcgccagcctcataagactctagctgctgctcctagacccccaggcaccctcgtgcctcagaatctcttcccctgagctccttcattctggaacattcctactccatctagtcatatgactctctccctcacgagttttgggtttctctacctgaacctcaccttttcagaggcctcccctggccacctgatcgaaaccagcgcctcctcactctttaccctgcttagagtgtctgtcctagttcttatcacctccctcactgacacgtgggcagggcctgaaacggtaggtgctcaataaattgtcgtcaaataaataactgagaacacatggctgagcagactcaaaagagaaggtgcttgtttaaagttaggacgcagatccaggtctgctgactcagccccttcaatgctgagcctgagttgatgcatgggcttctgagttccatcttcatgctcaatggagacccatgggtatttgtgtctctggtgggaaggaagtatgctgctcaccactccctcccctgctctcagagaatcctcaagcacttcaggatactgatcctgtgcaaagagggtcccccaaggaaattgatttttcagaacccacttgccagctcatacctggctccagtcacaccaaaagccagctggagagggcctgtgtgaatattccagtgaacagacaggatatttacctggctttggctacacagagcagcaacctctgcttttgagttgcttgtcttgacccataccatcagcgggtaacaaagtaggttcagaaagactgatatcttctcacccaccctgggcaagcagagacaatcctgtggactctcagagccaagcagcttaggcacagctatcgccagcaccccacaaatattccctaagggctcacatgtaagctggactagtggctagcaggaagcaaggagttttagaaaaatgtcattgcttacagtggaaccatgtcagaccctatcatttaattatgccaaaagcaatgacagaatgaaataaatgccaggctctttaaatctctcatcctgaacactgtgcttctcctatcctctgagtattattgataatgacagttcgttacttgcacatgatttgattgtttgcagtggtctaattcgccataacacaaaaagataggagaggatgttataatgattctgaacttcagatgagaaaaccaaggcagggtataaaatttgagactgcttggctcatgggctagacctgtgctgttcaatgcagcagccactagccacaggttgctactgagcacttgaaatacggttagttgaaaattgaaatgtgctctaaatataaaccacatactggatttagaagacttactatggaaaaagtgtaaaatatctcattgattatttattatgctgaaatgatcttcttttggctatattgagttaacatattaatatactttaatatattattaaaattcatttcatcgttttgttttcttttaaaaatctggctactagtaaatttaaaattatgtagctcggccaggtgtggtggctcatgcctgtaatcccagcactttgggaggccaaggcggcggatcacctgaggtcgggagttcgagaccagcctggccaacatggtgaaaccctgtctctgctgaaaatacaaaattagcctggcatggtggcgcatgcctgtaatcccacctactcaggaggctgaggcaggagaattgcttgaatctgggagacggaggttgctgtgagccgagatcatgccactggactccggtctgggcaacaaaagtgaaacaccatctcaaaaaaaaaaaaaattatgtagttcgcacatgtggttcccattctacttctattggacagtgctgggccatggtggtctggactgttctgtgattcacagtgcattttttctgcattccttgacagcatgggcttctgagttatgtcttcatgctcactggagacccattggcatttgtgtctctggtgggaaggaggtgtgcggtgcacctgaagctaccatgcccacttgcttttcaccccagtagcaaaccctctggcccaggggcaaagggtcaagtgcagagactgaggtctgaggatctcagagacagagtggcttgcccatgttgagggagttttgtgctctctttcttcatatcttcctgttgtggttgactctgttaggctgggttgccttgaaacagcatggcccataggttctgtgtcgcatgtagacttcagcaacttgatccaaactgtggtctgcaaataactctcagctgcatcctgtctcaaccacagggataggggaaaacatcccatgaagaaaagaatatcaggttatagagggaaatgcaagacttgccttgtgagcctggtattcaggaccagagttcagagctaaccttccttgaaattccctggcctggcccccagggtctggatgccctggacacctagggactcacattccacacagagaaggatcagctcctgttccctggaacttgtgcctctctggctgcgaggcccctttctaaactcttgtgttctcaaccttgcagtatgagacatgtcacacataacctgggtggggaggatacacaggatcctggaaaagttagcagcatctactgtgtatggggatgaaaacagctagtggattagggcggtggctttatcataagtgatgctttttcttttcttggaatttgcttttaagttattgcatctccttttcaaaaacaaaaaagtcacatctatgtcctacagacttcctaaaggcaatacagattgtttaatttttgcacagggtgcatactacgcaggagttacacgccgcgggtcctaatgcagccatgtgacttaggcagcccgcgaggcctcactttggccacgtgaacatcaggtatcctttgacagtgagcctgggctcagatgtgcgggtctgatgatatacccaagttcagttgctctgagttgactaggaaggtagagaagatctttgtacagcctaaagaggtaatcttcaggagaagtctttgaaatctcccttcatccaaacacccaagatcttacaccttgttttaaatggcctaacacattgcaaagctttttttggaaaccagtagcaatgttcacagaacacacacaaacagaactcgaggagtcaagagctatgtccagtggtggaaatgaaggacaagggctaccctaccctcggcagctctgctgtggcctctgtcgccctgagatggagatgtgctgagttattacacccttggggccaccgccacctccctgctctattgtggcagccccaggctctcttgtcacctgtcccagtgctatcagctgccagtgggccccagccccatgctagctgtaagtgcaggtcttaatacaaattagcagcagtgcaggcaagctgaatggcaaaacctcgtcccgcactccccctccctcttgttttcatcaagccttcttcacaggcgccagctgcctcattaaagagcagccttttatgctgggcttcacctgtacccaccctgagcggcagccgtggagccccatggccgcacgcagggcttgcgctggctggaggaggcacggtgcttgggagctgcaagaatggagggaggactggcaggcgagcgggcgaggtatggctttccttctttctctccctgagcagtgggaggagggccagctgggcaagtgtggggaaccaggatggtgccagcccttctccctaaggacacccgcctgcaggtcctagtgcagaagcctgggaccgaggacagggccattttccagaggagaaacaccctggcgggcgagcggccaaaccgatcacctgtccagctggagagcaggtgtgtgcacagggccgggggagggagagaggaggagggaagcggaactgggagaacttctatgggtcagtgaatgaggaggttctgctcagggaatgagtggcagcggccaccccagcaagagagccccctcctcctctgcgtccactttcccttcgtctaggtgcccatggctcctctccttacaaggtcacgtgttaggcaggtttggggaaatgtttctttcagcttttcacatttattttcctccaaccctggcacctgggaccagccctgccacctgtgcctaccgtacatggccataaccataaaggctcactccatttcagtgagtcctgaggtgctgacttctctgcacagcaagaggtcagtttttaactcagaaatccccaggggcccggctgatgtggaaaagaatttttccaaatatcgtatccccaccgtccacaaacgggaggagcccggggagtgtgccctcctgtcccaccatcctgccccctgctgtagttctcctttccgagagacccctgcccataccctatgccctcttgctctgggggtcctccaagggaagagcgtgcagtgtggagcccacctctcccacagaggccgcctgccaatgaaaaccttgctcacttggttgcaggccaacttaatccttcaaacttctgcagcacttggactgtttcacaactgacaaggatgcagggaaaggctgccagaccatgtgcgtgagtgtgtgtgtatgcgcgcgtgtgtgtaatgtgtatgcgtgtgtgtgcactgtgtttgcatgtgtgtgcatgtgttgaatgtgtgtgcagatgaagtgtacgtgcatgtgtgtgcatgttctctgtgttgaaatgtgtgcttccatgtgggtgaagtatgtgtgttccatgttggaatgtgtacagtgcgtgtctgtgcatgtgtgttgaagtgtgtccatgcatgggagtaagcatatgtgtgcacgtgttctctgttgaagtatgtgcatgcatgtgggtaaagtattgtgcacatgtgttctgtgttggagtgtgtgtgcacatgtgcatgcatgtgtgtgagtgtgtgcctgcagttagccccagggcgggtgaggggacccagtgcactcgggccagagctcagctcagatgcaggcaccagggtctgactgggactgcttcatctcaggccaggtccttccgcagcagaagccaaagggccaaacgctggtgaaaagtcctgatgtgctactgcctcccctcccctcccctgccatggggacgttaaaccttcagcaatctggaactctgacggctggtttttggttctctgcctggaaaaacagtaggcgaatagtaaaaccttaaattctaacatgtgtgagttatacatcttattttcattttcagcccatgtttccctctgtaagacatcaggaaaaaattaccgtctgacttctaatatctcagtggagcatttatctcccagctatgataagtgatcttcaatatttttttcctttcagattaagaaacaaattcatttaattttctttattgaatgtgctcaggcctccccgccctgcctgggtctcaggaagccctgggctgatctcccttctcctgggttagtgactgccgtccctgcttgtgggatgggtgggtccctatctggtacggccctgctcctcaaggcctcgctgtggtccgttcctgcgcctggcaggggatggaggacagtggccaggcctttggaacgtccggagaggttatgcggcctagagttggaaggctgtaatctgaaccttatctgaactccttggtctgaaggcctggtttggagctcttgagagaactggctgtctcccaggctgccagaaccgatgcttcctgctcagtataatggcggctacagcttctccttggccttcccatcgtctcctttggtcctgctgctgctggagtggctgagcagcgggcactgggtgtgacagggtggcacctcccccaagtatgctggaggtgcgtgatgctgggctggagggcatgcagagtgtgtttgccagccagcttcagggcgccaggtggccatgggtgggacttcacccctccagacagctgcccatcaccagtgctgcaaaataccaggtgctgatcaagttctgtagttctaggctaagttggatgatctgctttctctcttgtgaatgtccatactgcttccacagtgagcttggggccagggatgcaaaatgccacagggccaccacctctccatcaggtggaagttcctggactccattccttctccaagtagcaaccagctcttttgcatgtgtgcttgatagtgaagcttaacacagaagacctgagtcctgtttccaccttgactagctgtgtgactgagccaggcagcccctgtctcgatttcattaaccatgaaaaggagatagtaacccttgctgtgcctatcctgggggcttattgggaaattcaaatacaacagtgcataagaaatgcattaaacttatatatgtgcaatagaaataactcactgagaaagcatttgctgctcacctcctgtaagaatactagggttaaacaaagaaagtgatgactatcctctcaagaactcagcagtcagggggcgcaggccaagctgagaatcagacagtgtgacaagtccttataaccaaggcgggcaccaagtgctgggggactgtggggaaggcgtgtctgggagcatggactaggttgcctggcagtgaggctaaaaatgtaagctgcagtcagacagggagggctgcgatgccacacaaagaagctcagaccttggtctgagggcactgaggcgctgccagcagtttttacgtactgtaattataggattgggctgggatttgaagaaaactctggtggcagcatggaggatagaaagagggcatcatcatcatcatgacaccaagtgtggccgggcaatggctccatgctcatcatcggagccctgggctcatgattcagaggctgaggcaagctgccctgtcagtgctgaccgcctctgggctttgtctcttctcactttagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcaggtaattcgagaaccaggctgcctgggcgccattcacttccccactctctggggggcagggagcatctaaacctttatctgatactctattccctgtggaattgcaaaatggagaaagctgcacgccagccgggagtggtggctcgcgcctgtaatcccagcactttgagaggccaagacgggtgaatcacttgtcaggagttcaagaccagcctagccaacgtggtgaaacctcatctctactaaaaaaaaaaaaaatacaaaaattagccaggtgtggtagtggacgcttatattcccagctactcagggggctgaagcaggagactcgctttaaccgggaaggcggaggttgcagggagccaagatcacaccactgcactccagcctgggtgatggaatgagactctgtctcaaaaaaaaaaaaaaaaaaaaagctgcacattttacctgacttcctagctgccctttaaggcagtatcccagatgtcacctgatgtgtgggtgctagaagccccacccttaaacagaccacatcacagactctacatcaatggcctggtcctcaaggacgggctgctcagagagcagaggcaaggccgcctccacccaaaaggaatcccgtgagctctggatgtgggcatccctgcctgtgaggaggaggtcagctgcagaggccagtccttccctccaggctcgtacttcccggcatctaccaggttccacctttccaaaattacagccagctctttcagttttaaaatagaaagaactatatttaactaatggagtgccttaacatgtgtgccacaagttatgtcattaggtaaaaatagcctctttttcctaggtgttggtgctgttggtcccagaaaataaaatcatcgttcagtccttcagtccattggctggacactccaccccagctagcaccagcaagctcagctgcctgcacaagaagggtgtttacaaactgccacgtgtagaactggtgccaggtagaaggggcaaggatgtccaaatcttaagcaaagtgattacagggcagggattaaacctgatcttaccaaaataactttaccagagaggcaaaactccttccatttgtaaaagcataaatgtagttgcctctgaagtcaaaaggttagacatctctttgaggcagtccgaaggcatctgcttgtaggtctaaaggcagaaatgttaagggctgcctcctgccttggcccgtggtgtttgttttccctgggaagctgcatctcaccatatccctggattacagctgcctccctgtgctctgggccaaattcaagaaggtgtgagcaagagtgaggcagcagacgggtggggcttgtagaaatttctctgtaccctttaggacttagaaatgactcctaaagcaattctaagtttgctcttccacaagcatctgacctaacaaaggaagaggaagaatcacttccatttattgagtgctttctaggtgccaggcaccacgtaaattgctttatctccatggcattacttaaaacacctgtcacaggagaccagctagtaatgtttagcccaggtgtatcgtctccctcctcactgaaagcagacaatgaaactgtattagaactgacaggtgggaatctctttgtacagcccaaagcaaagctgagcctcactgggtcttcactcaaatggtttcaaactcccctgcttcagtcaaacagctcccagcctgggagggaaagcttgcgggactgaagggtttggggatctgagattgtctttgaaccaacctttggcaccatctcattttggtcgtcattttggggaaggaatcttggaaatgggcagaagtggccagactgctatgtcgaccctccaaactttctttgatcagtgttgaaatgctttcaaaaggaatagcaaaacatcaggcttggctgagccaagttacctatagcgctggtggtgaaaataaaacaaattcatgtcaaatgattttcaaagcactttcaggctatggatttacttcattattttagctccggctagatcttttaggtcctcacacattttggcttcctccaggccaggctgtggatatgaggggaagtctcatttgggcaagtccacaaatcaaggcaataaaatattagtggaataaccgattgaatttatgatgggatttaaagacaagtataaatgtgggccctagttaatcactagctccatgttcagatgggaagaaactaggactaaatcatccaggaaatgcatttggaagagtttagcatgatccagagttgaagatttataattcattgtgctgtagagggagagtaataatattgttgcagagcccaaagcaagggaggaaataataaaataaataaaatatatggtgtaaaattgaatttgaggccttggatactaaaagtgaggaactgggagaagtgaagaatgaaataatatgctacataatccaactctcccgaggatatgtttctctagaattctgaaaaggtgcaaaattatttccatttgccaatgatccatgcctaattgcttctggagagtaaaagagcaagaaatgtatctgagagagagagaggaagacatacttgtacaatgacactttagaggagctccgctttctggcttcagagcagtgtaactcacaggtgaggtaaagcaggatggtgagaagaggaaaggggctttgggggaacccacctcttcagcttagtgaagtcctataatggtttctattggaaccccagcccagatacttaccagcgatggggctttgggcaaaggacttaaccttttaagactccattttgcatctgtaaaatggggatattaaaagatttccttggtaagtaaaaatagggctcgcggagcaggtggcacatagcacccaccatctgagccgtcactgctcacagggcattaggttgttggaatgacattcagcagcaggctgtgacctgtgaacccaaactctcctaactcctcccctttgccagctcctccaccttcagcacaacacagcagccactctcgtgcatgggcagggcctgggcactttacaaagcagactactcgggccctgccacccagattctcacacataaaaaccaaggtggaatggagagtccaaggacagttggtggatgcttgtgtaaaagtgctgggaaacttgcctctggctgcccagctgtgaagcgtgagccttgcttcttgccccacatccactcctagtcattcaatcctggttccctgctttgccaggagccttcatagacgctgtagaatgagagggtgagttgcttgaggggtagcacagatattcctgcctaataaatatgttaaatcaaacaggctcattagaagccggaggctaatggccgacttacaataaaatgccgagtctctcctcccccaggaagtcttccttgactctccaaattttcactattcccttccacttatgagtcctcgaaccaccgccacacagtccattgcttagtagtggtgtgcttgcctacctgtttcatgggaatgagtatttcttgaaggcaagcgtcatgtaattttcttctatgataaggatatttaaggtgtttattggacccactaaccattggttgccaagtgaagagatgggcttcagactgtgatgagtgataaaagagttctgcctactgtggaacctgctggaactcatcacttgtgctgaaagtgcaacatccccaccacacacacacacacacacacacacacacacacacacacacacatacacacactgagaaggaggaggaggtatgagtgtcctaccatagagatggcctcagtggttaccttacctgtgttcactcaagagctaaaatgttctccccaacgtcatctctcatctttgggtatttaaatatctaaaatatgttttggggatgccctggtagaaatttctacacagctgtgcttaaaaggagaaaaatctagtttgggtttctgttcaagactaacaccgctgggtttttcaactgcacagatggaattgcagtaaaagtctctctgtttcttttctacagccatctgagggatccgtgttctttcatgaaatcattaatattcttaaaatacagatggttcccgtttccagagacattggtcccggggtctgtgaaattgtgtttattttcattttgatgccaccatttctcaggcaaaggttccaactgctctccaaaactttaaagagtgctctgtcaggatacgtagtgaggcagctaagcacctccctggagtgctaagtggttcaggcagcgccagatgccatggagcctgatgagtgttctaggggaaccatgtggaagggagctctcccagagagaaagagaagggaaagaaagagggacaaggggtgagggaggctgcctaggctctcagggagcctctaccttcctgcagtccttgctaacaacgtcttctcctctgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagtaagtgccgcccaagtacccagggctgggaggaagcttggcatggagccaacccagggagaggaagtcagtgctgcccgttcgtgttgggcagatgccgccggagcagcatcgtggggcctgtagtgttgccaaggtcacgtgggctcctacagaccctgtgaggggcagacccaatcctgaagtgtcaaaggaagtaagacgagaaatggagaaaagtagagagctgtgacctggaggggtctggcagaggctggttacactcttcccatgagaccgcctttccagaaactattccaatttgaaaatagatagagatgggtggtgccctggctggtgttttcctaagtgattatttaaaattcctccaggaaactctagattcaaggcttttggatttaaggtgttgaaaataatttacatattagcttcctcttaatcttgggatactctggcacaccctaaccccatttgacagggctgctatctgcacacttccttgataaggaagagcagccaaaggtgcaggtgtgttaggatccattggaggctttcttctggtacagccaagaaaaggaaaagagctttggaaagggcgagcttaagaaagaaagcaggcagttgtccaagagatttatctagtatgaggtactctagcaccaagcgcccatccgtctgatatgaatttcatttgatatgaaatatacacagagcagaagaatggaattattttagtcctgctggtaacctcagcctgagtgccctgctgggaatccaggccaggtggtatatcaatatcagtgctacccctaagtatggaaggattgtcctggggcctgaaaagatggtgctaggatcacaggaacacaggtttgggctcacactacgtaagagcattctagcagccctgtgcaaagacagggcagccttgagatgctatttgttgtgaatggccaaggcagctgcgagtcttgcaggagtttagctttgggcaggggcttgatgattttaagcccccttcgcaagttcagatccttagacagcaactctgggacctgcttttcctggactggctggctctgggttggtgagctctgtttgctcgccatcgttctgtggacctttaactccccatctttggaatccactgtcccttcagcgacagtgttcctcatggggcaggggcaacacgtgctggctggagaaatgaaaaatcaaaaaactggctttggcagtttccactggtgcctctgtgctctctggtcacctttccgaggcgtctggtaactagtgcgagaaagtagatgatgcagtatttgttagctccggagcaattacctcatgtctgagtcttgctgcaacatgaggtcagcccaagaaacaatttcaaaaaaggggacaattttccacccagtttttcagagctttggataattagcactttctaattcatattttcagcttttaactgtttgtggaattttaaaaaataaggatctttgaacagagtcctgcagtgatctaggcaggccagggtgggtgtgtggaggttagcatgagaaggagagaccagcaaagcaacctgattccagcaggagtttgcaggaaccctaagccctttccttcatttgccaggagtagagaggacaacagtagcatagacagcatgctctgaactgttagttaaagggcccagtgcttcgagactcttcggcggatgcccttgttgggagaatgttcaaggcattctctccatgtggggaaagcccattcatgccatatgaccccggggccctaaccagtccataaacagcccaaggtcccctagtacttcctgccaccgaacaatgggaacacagatgctgaagtgagacaaatgcctgagaaggtggtcactggtcgccagtagagagaccttctattggagaagagcagataacaaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagttgaggatggtggcgaacagtagtacatccacaagatgggaagtagttgttctgccattgaaatgattattgggaaacaccatgagaagtgcttaggatacaatgttgggtggaaaagctcattataaagtggtctgtgcactgatagaaaaaccatgtctgcctgcgaaagcaaaaaattaaaataatcgtgttaaattaaaaaaaaaaaaaccttgccccaacatggtattgaaatatccttttgaggaacctagacttaaaatgatccactgtcagggaaaaggcttttagattcatgctgctttttaattggtgtctaccttggggttccagccttggggaccctctagtgtgaggtggtggctggctgctaagcgcctgcaggaggccatgggctggcgatcgtgtctgctctgtttctgctctggattgctgggaactcccccgtgacaaccagcactttaaacgcttttaaagccttcaaacactttattgtttttccagactgacttccagtggatgttttgtgcttaggtggaaggccagtgcttgcggagagtttgaggcgatgagtcaaggcaaggggagagggtgctgattctttgtgctttatcatcttgtcctttcattggagaggaaggtggggctcagatatttccactttagcaagagatggatggaaaatagctgagatccttcactccggtggaggaagtactgcagggtgaaggaaagttgatagagcagaatcggggacctgagactgtggctggttggaagtcagtagagtccaagttggtggcacttctctgatctaatctttctgggctttatagaaagtctagaaaaaggaaaacttcataggataagaagctttggcatcaaatttacatttcacaaaaggtgcttgactatttattctggtggtttgggaggggagctagacttttacattttaaatgcaaatgtattttccagggtagagaagaaatagcagttccctgtgcccctacagaccctgtctgatggccaggcatgctagggaggtgcttgttcttcacacctgggcgtgtcagctgtgccagaggagctgtgtcacacgccacacaggcgcccacccctcccccccaccaccacaggaaatgcaaggaggactgtgatggctggggtggccacggttcttgggggtaattcccatgagtcctgggaaactccagggtttacacctgtcaatcccagcactttgggaggccaaggcgggtggatcacctgaggccagaagttggagaccagcctggccaacgtggtgaaaccccgtctctactaaacatacaaaaatgagccaggtgtggtggtgggcgcctgtaatcctagctacttgggaggctgaggcaggagagtcgcttgaatgcgggagggggaggctgcagtgagctgagatcgcaccaccgcactctggcctgggcgatagaccgaggctctgtcttcagaggaaaaaaggttgcccccttgtggacaactatctacagtacccattttgaagctgaacccactgaggcccagacagcttcagaaattggttcaaaggcatccagccgattgagagcacctggcatctcagactagggcctctggagtcccagtccctggcctcgcgttgccgacgttcccccggccctggagacagcaagccagcctgcgccacacaggcaaggcagcctcactcccggccttccacgtgggcagcccggccacttcccccacagcattttctgttgtcatttgtaccaagagataaatgctttccaaaaactttcctgtggcctcctggaaggaggccgattaagccaaacctatcaccacgctaactttgtccttctctgggcctgactgtcggccccaccagtatctctcccggacacaccccgtgtggcagaggagccttcgcagcagctgctgcgggaacgagatttgtcccttctcaggccaaggcggggaaggacctcgaagaaacggagggcgccgggctggcagttcaggctcagggccgctggggggagtttgcgcaaggctgggagccccgaggccccgggggaggtggggaggcagaaagaaaaagagccttttttaagttttacaaacaagttcgttttgtatgtcaatctgggtctgacctggaaaaaaaaacactaagaaactgcgtcttcaaacagtggctgctcaaaagaatgaaactgcgcgaccgggagaccacggaaagggtgtctatcttcattcccatttttaatttaaactttaatggaaaacacattttgcattttctggtctttccacctgcagcctcagatggtcgggcagaggttttgggtctgggcaattaagctggtgcaatcttatcacttccaggcctgggtttgactggtgaaggagaacagaatgccagctgaacaaaaggccaggtttccctggacccagtagtcagccaggattgttgtttaaagatcccagagccttgcaccctcccgctcctgcacactcagccagagctgttgatatagcagtgcagcccagagaaaagagagacctggattcaataggctggctgtgagggggcactggtgaattctatggtcacagcgaggcaggagacaaaggctttggcactgggacgcttgcgccccctggcccaggtgtccccgatgaaaagcaggttaggttgagggaatgtgaagcagcagaaaccgtgattgttggggttctaccccacacctgcaaagcctcacactgctcactcccctctcctttcagatccaggtactgtctctagcagcacatggattcaaacatggaatggaaaatgatcttttccccatgcttgcactttgggaaggccattctattctcagcaggagctactttatgctttttagagcaaaaatgccctcaataaatagatatatgtatatgcatacacacccatatacaaatatatacatacaaacacatatacagaaacttacaaataaccaagtaggcaaatcttatacttcagtttgaactgaagtacaacacagagagaagtgcaaaaatcatgaagtgcgctacgtgagacattatcgtgacgtgaatccacccactcccataagcacctcccgggccaaggagtagaatttcagccccctgtaccctctctccaccccacaaccgcttcctccacaaaactaaccaccaccctgcttcccagccccataggtgagttttgcctatttctacgatttagcctggaggcagtgggatctgccagattgaggacaggttttgtgaatagaccacgatggggctcctgccttctgcactctctggctgtgtgatcctgggaaaatgatatgacttcgctgagtgttgctcctttcatctgtaaaaaggaataagggaatgctggctctgtatggcttatgcaaggattaagtgagaaaatagatggaaagcgtctggcacaccgtgcatgttcagggagcactgcgtccccaccaccaccttcatcatggcctgtttaccctgatgtgctggcatcgggaaggtgggggagctcagcagcacaggcctgtggcagggtcaggccagaaagagcctcaaggcaggagaaagcagtccaaagccacagagagggaggccagactccaggaggacctgcctgcatcagaacaagttccttaagaaaacagagcctggggaactaatgaagtagaaatcggagaagaggagggaatctaggtcccttgggagagaggccagatgcccccaaccagcccctccttggggaaggcagcctctccttctaggagtgaaacttgaaccaagaacagtctttagggcaaaatccttttcctaggttgccatgaaatatgcatttcatgcaagctttggagaggtcaaatgaccctttctctcagctttctgggagtttcctgtggaattcatgtgtgcccaaagaagaactttcaccaatggggaaatttaataaatgtggtttatctaaggttcgtgctttcggctacatctgcactaatgactcaggcagtttgctcctcggagaccatcatttttctttatttgctccagcagtgaggtttcagcctgagggagagaacgtcagggacggagaggcaagcattcttggtcctacttctgggatttttttgtattccctccgaacatttggttccatttcttcacttccttccagtcgtgccggattatttcttattgcagcagaacccattcataactttaatcagaggacaggacgaatgttcagtaaacgcatgtataaagagaactattgtatgtaattgtgacatctgtgggagaaaggatgtaaaaatagtaacgatcatagctagcatttatggaacacttatgagccaaggtccattctgagcacattgcatgcattatttgatttaatcttcataatgccattgagtggtgttagcccattttacagatgagaaactgctggctcaaagagatgagggaaatcagtggagggcacaaagctagtcagtgataagaggcaggtctaattttaaagtctcctttgcttaataaacatacagtcgtgctttgcttcatgatggggatagttcatcttcatgtgaataccacaaaatgtacttacacaaacccacatggcatagcctactacacactgaggctgtatgctacagcctgtggctcctagcttactaagctgtatagcatgttattgtactgaatatagtagacaaccgtagcacaatggcaagtatttgtgcatctaacttttaaaagatacagtaaaaatacactattaccgttgtcgtatatgtggtccatctttgcccaaaacatcattttttggtgtgtgactattaacaggaacttgtcccagccttactttgtcattggtattcttgaacatggaataaccaaatgtagctggctcttggatgttatattcatgtgactgtctcatttctaaaatggcatccacatagccacactttggcatacagcgggctcaataccacccccgtcatccccctccttgttttcatctggagctgctgcagagctagaactaacagtcatattctaggcaattggacaattcttataaaattctcttcctctgccgggtgcggtggtaatcccagcactttgggaggccgaggcaggcagatcacctgagaccagcctgaccaacatggagaaaccccgtctctactaaaaatacaaaattagccgagcatggtggcgcatgcctgtaatcccagctactggggaagctgaggcaggagaatcacttgaatctgcgaggcggaggttgcagtgaactgagatcgcgccattgcactccagcctgggcaacaagagcgaaactccgtttcaaaaaaaataaataaataaattctcttcctcatcgtctggcttggatagtgcacacattttctctgaggcacacaaccaaacgcccacagctgggtgaggcggcaactccatttcggcatcccttccatgactggagactaaaaataggggtgtgtctgacagcccattcccacccctggcacccaagccagtccactcggccacagggagcggggaaaagggttgtttagaagaattttcttagcctcgaatacatgtgttgagcttatggtatgttttataaaagcagatcccagccctcgtttcaagggctctttaagatttccttaggagaatctcaaagagaatggcaaaaatgcctaagtttcacaaaatacaaccttgaattcactttaaacaaaggaaaaagtctagttttaggaaagaagggagaatgtgttttacatgtaacaacaaattgctttttcaaagtgctgggtacagaagaggtatgaattgaagtttaatttgaaaagattggatatcagcattctgagattacagaaaattcaacgcgtgactcctcaggttcagtgcgtgctcttagacataggtgaagggaagcaaaagttcctattggaatactaccactcacctccttcccaactcccattgccccctccaccagtaacatacctgtgtaccttaccctcacctgtgaaaggacccatatgtacataaacccagaagataccacagcaggaaggagtgatactggcttctcctccaggccatggcaaagtacaagctgcaggccaaatctggccaaaagtggcccatggacaaagcaaaacaaaaactaagaagactgtgcaacagagattgtagttagcctatgaagccaaaatatttactatctccttttgatagaagaaatctgccaacctctgctctagttcaagaaaaaaaatcaaaatctagacatgtcaagtcactcaccaactgtcacatggtgagttaataacaactggaatagacccgggtttactgattctcaatgctgtgttcctatcatgattatggcacagaccacagcgcttcagaactatgaatatggcagcttagggggcgtggtgtttgtttccccagagagcatttcattccaaagtattctgtctcttcactccataaagctattacaggcctgtatgattgtctccaaccaaatggattccattcgcttttcctttcttcctaggagtcctctgtccctcttcccctctccccatctctttccctttctactccctcctcatgtcatctcctactcttgatctcagaagaacattttggttataacctgtttatgttttgcctctcaggttcactgctggcctataatacaacctcccacaccgaccaatcctcacgattgagtgtcaaagaaggtaagtttgttcttttgtgcacttaaaattttcttctgtaccagacatgacacaggcccatgctgttaaggttgttgcagaaaaccagcttgcttgttccactcaacttttcctagcatacaaagacaagccaaagattttcgccacttgtgctaccagttgcaaaaatacagtaaagaaagttttacagtatcttgtaataatatcacaaagatacaacttgaagttgtcactccatgcaggaaaacatgttacttttagaaaaaaatgaatgctgcttactttcaaagttgaaagttgggagttttctctgatgaaaataatgaaatgaagagttcaaggattccagcatgtctacctttaaaggtttttttcctaagaaattttagcagccggtcatgctggctcacacctgtaatcccagcgctttggggggccgaagtgggtggatcacttggggtcaggagttcgaagcccagcctggccagcatggcaaaaccaccatctcagctaaaaaatacaaaaattagccaggtgtggtggcaggtacctgtaattccagctactcaggaggctgagacatgagaatcgcttggacccaggaggcagaggctgcaatgagccgagttcgcgccactgcactccagcctgggcgacagagcaagactctgtctcaaaaaaaattttagcgatgtcaattcatttttaaagtggtggcttaagggtttggtctggtttggtttggttttgctgagaaagaaaacttcctcggcaaatgatttttgccagtgaagattttagtacacgtcacaatagaattcctcagcgtctttatgaaacatcgtgaggagtggttcagatactgttagatttcaggcattgaaacaagtgaataattcatagtacctggtttaaaggaggaaaagatgtgaacaaataattattaggaaccagagagagactggaaaaaatatttgcgcggcatagcaaaaattccacagaggaggggacttttgaataggagcttgaagaataataagagtgtggcaggcactctgtcctccttggctcgctgtctgtccccagtttttctttaactcaccctccccaaaatatataagaaaggcagaagttctcaggatcagttacatatagcacagcactgcaaaacctttcagagaaacaaaggctcttctaagggaaggaccatttggcttaaaatccgcatggggtgtgaaggaaacagagagccaaaggcactagctggctgtcttgcccaaggttacaactttgatcacacagcactttgtgtttcctgttaacaatttataatttaataatgaccagaacatttagtggaagaattatacaacataatgaatccgcttttaaacatttgtgtttttcatttgtttccttctctcctatcccaccctgagccagtcctgtttctgccactgtttttcctttccaaatcagatttcttgagttttgtcatgaacgctgaatttctatggattcattctacattgtgagtcagatttcactttttgacctattttaatatgctgttgcaaatgtctgtaagagagaaaatacattttagtggcaaacgcattagattgaaggtcagggcacctttggcttcctgtgagaaaaccacttcaggccctgaacctcagtttcctgcagaacgaaagagaagaactctgtcagcaagaggccagccctgactctggagatcttggcctctaaggagatgacaggagcactcacattgcgagggctcaagagccactgtcctttgatatgttctacatactgagttttatttcatttgtggatagggatccactttttggaaggaaggaaaaaagaaggggaaaaatgactagagggagagagagagagggaaggaagggaagggaaggaagatagggagggagaaaagcaaggctataaggaaggaagggagggaaggaggaagggagggatgggaggaaccctaacctctgaactgctgagttcggatttttgtaagtttctccaacacttcaggctacaacctgctaccaacatcagaattagccagtgaggctctgaagcagagctaatgaaatattttctgatattgggcttcagatatagggtttagtttagaaactggtttagccaagttgaaatgtgttgctaaccatctcctcctcctcctcctcctcctcctgctgtcttattgttcagccgtgtcctctacctgccatacacatttccttcccttggcccttttgtgtttagggaggacgtttgtaacactgctggctcattcaggcttattgcaggagcagctccctcttgctgggtagcaacccctcttctgaaatgaattaactgtagtatccaggcaaacacacgctgccaggacctcattcaggtggtgccggcatttatctcccaacatcgggcctggcctctagagacgattaagcctgtgctttgcaggtgcatcttttgtccccagtaaagctctccacttgagctgtcttgctcctctatgccttccccttgtgaggtggtctgaatctgtctgaacgacccatcaagccacaaaacaaagtacattagcaagacaaagctaagcaagccctccctctatcctccctgcctcctccccacctctcactggctctcctgctctgctctaatcactatctattagctattagaagacatcaggcaaccttggctccatcttctttgaataagacacacacagccccaaacaaacccagagttcatcaagagcaccagagctgtgtgtgtgtgtgtgtgtgtctgtgtgtgagtgcacactggtgcagtccacaaagggcaggtgctggcatcaagcacaaagcaaggaagttgaggagatgctgtctattaatgtcttcaaagcacttatcaaattagaatggctttttgctttaaaattgtataatcacccttccagcttgtctcttgaaaatggctgcaatctctaggggttatttgtgcccaggaagtaagagtagattttaaaaattaatttagaacaatctttaagcccctttaaattaaatattctatggacatggattggatccagctagagcagttatgctctacctttagtttatcaaggctaaggcacttaaaaaaataaactaggataaaagctattgttatccatttacaatagcagccacaactgtcatctgtaaagggttttggaatatatcagacacctccacatgctttgctttggagcctagcactgggtctttgaagtagatattattatctctattttgcagacaaagaaagtggggttcagcactattaagtgactcactgaagggtacacagctactagatggcagagcaaggactcaaaccaggttagaggattagactagaaccccctcactttctgacaaatacagcctttctcttccagctgccattctgcaaaagcaatacctagcctaaatgtaacttgggcaaagatgtgaatgttttgcattacttgatttctgtccatgcagttttcccactgtcagctccatctccatccctaaacttttctctctttccaaagatgaaccaataaacaacttatgcttggcaccagcccttagttctgacagcacagagaatcaccaggagatctttcaaaatactgactctaggacaaacattgcatgattgcactcataggaggtaactgtcaactttgtagagccagaaggtacatggtggttaccaggagcggcaaggagtggaaatagggtgttagtgtttaatgggtaagagtttccatttgggaagatgaaaaggttctggagctggatggtggtaatcgttgcatagcattgtgaatgtacttaatgccactaaattgtacacttaaaatggttaaaatggtaagttttatgttacatattttactaaaattttgtaaatgcaaaaattaaaataaaaaaatactgatgcccaagtgccaaaaaatgatgcattaattcagaacctccaagggtgactcctgggcattggaaatgttttagagctctccgggttattcatataagccaagctgcagccaagctagagaagcctgctttatagaacagagacaaactagagagaaatgaggcccatgttagagctactccagattttcttggagacacactgggcggttgtctggacccagattgtcctagaaaaggaatagcaggccctactggtatattgataaaggtataggtaagtgaagagactgtacgatcttgattagttttttgtcattgtcattgatgactgattttattgatgcatgatgttactgatttagacaactgtacgttcgtacatctcagaaatttctttctgacgtgtcctcattcagtcctctaaaaagtagatatggtgttggtaacgtgattttataggaaggatactggggttgcagaagttaagtggccttttcaagtgtgtaagagtcctggagccagggctactgactttccacaccttgttctctcccgtcctccaggctgcagatgtgcgtgtgtctgccctggtcccaggtcagagcttccctttgtttttctgggcaaaccctgccggaggccttcccagcacactcagctggcccagcagtgtgcaacaatcagcacatctcttcctcagagcttctttgcatgcctaagccctcatttccttagttcctcatgctgaatctgtttaaatacctctgactttccaaaagacagaggatattgagttccttgtttattaactcctggaactcatcaaccggccaagggcctgtggagcactgagcttctagccccagcctggagcctttcaggactgccattgaacacggaaactgaaaaccacagccccactgcaagcggaatggccatctccagccattgccttggctgatggataaaaagtctgtcggcttgcatgctaagtatggaaaagagaggggagaaactacctttctgtgtcccttagagtgaaatgcctggctggtgctgaagcccatgttaacgagaggctggcttctctccaggagagtcctaggtggcaggagccatgcacatggtaacaacagcattttggcagcctggtagggtttgccaagcacgttcctatccattatcccgtttgtgccctctggtgccatcaccatgagatgagaaggctggtagtattattatcccccttctatagataatgaaaacaaggcacagagagatttcagggttccttagaaggcacccaggtcatgaagcagaacaagactcaagtccgggcctttggtgtgttctgtccttcctctaggctgcttctggaatcattatctcagcatacttgattcaagcatctgacaacatcttaaggattctttaatactctcaatttaccgaaggtgggcactggtctcctatttcagcattatagcatactgattaaaaacttgggctctggactcagactgtgacctggacaaggtgcttacatttttctgcctcagttttctcatgtataaatgaggataattgtagtgccccttcagggataatgtaaaactcataaatcagcacagtttctgacacaccaataagtgctcaataaaagttataataaggatagtaaattgttattctaatttattatagtacaaattctaatagtaattaacattattattgaaagctaattacaattttttttttttttttttgagatggagtctcgctctgtcgctcaggctggagtgcggtggcgtgatctcggctcactgcaagctccacctcccgggttcacgccattctcctgcctcagcctcctgagtagctgggactacaggtgcccgccaccacgcccagctaatttttttttgtattttttagtagagacggggtttcaccatgttagccaggatggtctcgacctcctgacctcatgatctgcccgccttggcctcctaattacagtatcccgctaattacagtatttttgagggtttaccagatgttaacaccgtaccaagggtcgtgaaggatactatacatagatagccaagctgctttaaaacttattcgggggccgggcatggtggttcatgcctgtaatccctgcactttgggaggccaaggtgggcagaccacctgaggtcagaagttcgagaccagcttggccaacatggtgaaaccccgtctctactaaaaataaaaaattagtcaggtgtggtggcatgtgcctgtagtcccagctacccgggaggctgaagcaggagaattgcttgaacccgggaggcggaggttgcagtgagcgaagatcacaccactgcactccagcctgggtgacagagtgagactctgtctcaaaaaacaaagcaaaaaaacaactatttagggagacacacctaggaaatatgaaggaaatataaaactgcatgtaatcgaaaaacaacaatgcatgctacacacaagaaattttctgagtgtaatgaagagatggaaaatcattaatgctcaagctgaacatctcctccaaatcccttatagaacaggagagatctgaggccagagaaggtgtggacccagccatggtcacacagggagtgaagacaaatatatacaattattcctatgtaggcagatgttatagatacatgataccttagtcaggaattgacctaaattctgtgattcatgctctcctccattcattcatttctttcttatggagaatcttctctgcatagaataccaggctgagccctaaaaccatggtgaacacagcacactacctaccctcaagcaggttctagtcaaacagagagacagacagctaagtaagtaaggaactactgtgctttagagtgagggcaatgcacgtatattaccacgtctttcaattttcccctgcatttagctcctgtgtggatgtcctttatgattttagaggtcatagtaaaagatggaggcctctagcaagctgcagcatggcagggctggaaatagatgttgaagcaaagggaaggaggaaggcaccaaggaaaccagcgtgtttgttggggtgggtgtgtgagctttcaagttgggttttggagacaggagcccaggtgagcccttgcaggaataactgaggcctgggtgtttgatgtgggtttcaggaagacaccctggggtagaacctgtgcaccatggcttcctggtacctggaaaaccgggtgcagttggatgtttcattgtgagacaggaagctcagcgaaggagcggagagccagggacttgtgtcaaaatcatttggccggggagggcggagtaggtgggcatggagctgaaataagactgaccatgaattcatgattgttaaagcagggtgatggggcctcagggttcattagactttcctctctacttgtatatatcttagaaattctccgtaactcaaaaaatgcctcaagatatctttgccttatttctccgggcgaagagtttcctgaggagggcatctttgtccctcgcgatatgcactgcctgtgtcaggctgatgcgctcccgggtgcagtacttgggaaggcgggcatttggcagccttgtgtgtgtgtctgtgcaggagggcgtgagctggtgctcagtgtggaggtgggctgtgtgtgttgccttgtagagtgcagcgtatgggggctaggtctggaacatgtgtacccaaaggaaaaggcctgtaatactgtgaggtaatctcctgttatttttagggagtaaataacatctctcatgcagcaggttgtgtgaccccacaggccccatctacgtcagctcacacacacttcaaattggagggtatcgcggcctcacaggagagcctgtgaagaacattgtcattatatgttcttcctttatgatgaaatgtgcctaagccattcttagcaaaagcagggatgattgctggatgtgtgtgtgtgtgcatgcattcgtgtgtgtgtgtgtgtgtgtgtgtgtgtgtgtgcacgcgcgctgtttctgtggtccaaaggcaagatttatgattatgggatagacagtagcttgctctctctattttattttttaaaaactgttttcctttgaaattcctgagttaatgttctgtctgctttctatctgaccctcttcggagagttgcattttttttttttttttcacgagagagagattaagagagagagagacagagagagagagagagagaacgagggtgacagagagaaacagagatcgggggaggagggagagcgagagaactggaaacaaagactcgttgtctctaagctggagcaggcaggaaaccccaatccctcgggaacttagccagcccgccctgtcctggagtcagactccagctctctgaattcaatttgacagcttgtctgggacactttctaagtaaccattatccttcctttctctaagtaaaaggactgttatttcttttcgtgggtgtgctgtgcgaactgctattgcacacgtgtggctcacacagtgactaggacacactttcctcaaattattggaaacagcccgtttcctaagacaagtgtaaatttgttccaggataataaggcaaaagactgagtatcagtccactgccttattagaggtgggcctattccattagaggaggaattttgtgtatgtaggttttacttctttgaggattcttttgaaatagacacaaacaacaatatctcccaatgatcattctccccagtttctgtgttaattggtggattaatttaatgaaacgcatcaccatacatcccactgtggagggaactcagatgtcctcaaagctaccagaggttgtgcaggccacgggcacaactaggggtgaccacctagagttcaaaggaggctgtcttctgcctgggaacagggccatcctggggtttcttttaattactcagacccagttgagtcaccaccataacctgagggactgtgaggtgatcacctgcccttcaatgtgttcctattggaagaccatcccgattcagctctgtgggaccgctagagacaagttccagaactgtctggatccccctggagcgtagaggtgtgatagttttgctcagtaatacagctttgcccatttaggttctgacccaaagacctgtccttcaaacatgacttggttcctgtctactctatcttcaaccacactttggaataatgtttccccattcttcctttgccgggtatacctttcatccgtctcagtccccacccccagtccatattctaggaaaccacactcaccctttagggccgtggtcagatcagacagcatcacctcattacggtcttgtgcacccttccccaggatgctttgcttatacccactgttttaccaatacagcattcaatagattctagcccagcagtcttctgtcttgtgagacgggaagcgtcttgaaggtagggactattggatggatggatgaaaataataggcaaagtaccttaaactgttccccagcagtctggtgtagaactaaccctttgagatgtttctacaaggtggatgttttggctctatccactgcagctgctggtgtggcattgcctttcctccctaccctgccctaaatttccattgcatgggaccccagggtggttccttggaagctgtgatcagtcccatccctgagcagggaagcaaaactgataaagagcagatttcaatcacaagatgatggcaccagagccccttcttggcccaaccaccgcaggatcctgctgccaactggactccacaggcccttcaggtctctgcccatcaggaggaggctgaggacacgccaagccgaggaaaggtgacgctgcagggagaatgtaccttctgctcaattccaccttcctttcttcacttatgccccagacagccacaataagagctaacatttgttaagcacctactatgtgccaagaaatttcctattcatttcacatttatccttcataaaaccttgttaagttggcactatgattattcccattttacctgaatcacaggtatgatgttaagcctgaatcacaaagctagtatgaaacagaaacagaagagagcctgttcctgtagtcccctccccacctaggcaatggcaagggctccaaaatgaccctttcctacttcatctaccacccccatcatgcatttcccccaagtagctgatgttgtctagttgctaagatatattcatctattgactcctgctaccatctaaaaaatcaggagcctgacccagtgcaatcaatcttatttgcatttcaagaagcaatctagcaatttagaattttagaaattccactataaagaggttgtttgccaggtgggatggggcggtggtaatggagctgcaaagtatataaaagaaacatgctttgtccacgcttatcagtcaaattctttctttctatccatccctggagagagagagggagaggaagcttcttccatgccacatggagacaaacgggcttcagacatcttctagtgaaagaccaacgtataggaagcatcatttgtggtggtttcacagattttttttattgttacgctttataatttatataattatacacatatccttttgtgtttaatactacatttaagaggataaaggaaaacaagagatttagaaaacaaagtattatattgagtaacactctattgatgagaatttcaataaactgaatttaagaaaccatccaggcacagtggctcacacctgtaatcccagcactttggaaacccaaggtgagaggatcacttgagcccaggagttcaagatcagccctggcaacacaactagaccccatatgtacaaaaaataaacaaaagtagccaggtgtagtggtgtgttcctatagtcccagctactccagaggctcaggtgggagtattgctcgagcccgggagatcgaggctgccatgagccgggattgcaccactgcactccagcctgggcaacagaacaagaccttgttctcaaaaacaaagcaaaataagagtgggggtggataaattcaataaatttaataaatttattatttgagggaaataaagtttccctcaaataatttcatgggtctatcagtttcatgggtaatcctctgcctctgtaagcttcataaacccatggttcccaaggagaagaaggaagagatgtcaaaatcaacttaaagcatcttaaagacacgtccaggatgctccagctgccccaccctgccccgtgtccctccataaattcacctgtgcccttggtagatgaaggaatgaggagaaggttggagatgaacacttgtgttcttagaataatctccttccattgctctggaatgccccacccctgccctgccccagtattgagagccagggcttcatcccaatgcttaactggagaagaaaggcaccttcctgccactacagagttcgcctcttctcacccctgtgccagaaggctccaggccaggcactgctcctgaccactcagaagttcccactttgccctttctgccttccctgggctgtctttggtctttctgcttatcagagctgcccttaaatgcaccctgaataaatcaagaccctcataggtgcccatgtgctctgctacattaatgatggtgacaatgaatgcatgagccctgctacattttagtaaaggacggtgacattaggtaaacctccaagtggggcagggaactggtgccaggctgtgggactgttgctgggggtctccagagcaccctccccattcgttcccattggactcagcccaacaatgactcctcccgcactgccaagaaggggctttcatgaccctgagtgcttggcagggtagagctccactacagttctcagtggcagttcacatccactggttgggccgtttgggttttgcatgtcttctaatttatctgcagactctgggatgttactattttaggcctgccatctctaccaagtttccccttgacactacacgctcatcccactccagacgacagagcgaggactgcagatgcagttggccttgcttgatgcagcttcattgctattgcttggttcacaatagaagttaaaagtgatccccgttggccatttagaggagaagggtcccaaaatactttgggaaaaaaaaggacaggcctataatgctctgccaggggccacctcagcacagagtgttccaaatgtgttggttctgcctaatatactgatttagaaattccaccacatggaggttatttgaggcgattggtagctggaaggtatttaaaagaaacttgtttcaccaaattctcatcaaccaaattctttctttcatctatctggagagagagagagacggagaagcttcttttgtgccagacagagatctatgagcttagggcatcttctagtgaaaggccaatgtataggaaacatcatttgttattttaatataaaaacctttctaatccctttttatagattgaataactctctctcttcagaagcccttatctaagataataaagagcatatttctcatgaaatatccttgttggagaaaagaaagtccttgaggaggaaatatggaggctagaaacactacccaggttgtgagtgggctttttctttcttgtctcagggatctgtaagatcgagaagtttaacatgggtcaggtgtggtggctcacgcctgtaatctcaacattttgggaggtcgaggtggaaagatcacttaaactcaggagttcaagatcagcctaggcaacatggggagagtcaatctctacatcaaataaaaaaattagccaggcatggtggcacgggcctgtggtcccaactatttgggaggcttaggcacaagaattgcttgagcctgggaggtcaaagctgcagtgagccaacattgcgccacttcactccagcctgagcgacagagtgaggccctgtttcaaaataaaaatattaaacagaggcttaacatgcctctttgataaagtttaaattcttgtatttggcatattctaaagaaaagatggtaaaattaagtgggacaattactttatctgtcaaaatccaacacactcttcaaaacccgattcaagtcctatctgcctcaagatatgtttttcttcctccttaagactatagtctcctctcggagcctcacctcattcacaggctatttatggacctaattacagattaccttgtggtctttaattgtgagttttctcctggctcttttcttccagccctgtatatattcagtaaataccattgaatatttactcaatcctgctccaataaaggaagaaccagaagaaattagctttggttgacacaagaaaaattaacttcttatgtcccatgaactaaactctgaaaaagagtatcagctagagttctgtaggatgcgttagaatatagaaagcaattttttttttttttttttttgagacagagtcttgccctctcgcccaggctggagttcagtgacgctcactgcaagctccgcctcccgggttcacaccattctcctgcctcagcctcccgagtagctgggactacaggcacccaccaccacgcccaactaattttttgtatttttagtagagacatggtttcaccatgttagtcaggatggtcttgatctcctcacctcgtgatctgcctgcctctgcctcccaaagtgctgggattacaggcgtgagccactgcgcccagccctagaaagcattttcatatgcatggtgtcatttattctcaaaagatccctgtgaggatccagtgtgctatttgcttttccaaactcttaaatttaggaataatcacaccactctctcccgcccctgccaagtatctaccttttacagagaggttcaataagaggttcagagaggttaagtcatttgcctcagaccacacagctcataactgacagagatgagaggcaaagcaaggagttctgaccccccagcccagagttctttcctttgcaatgagccatttccctgtttggaatggattcacgagaaattatggaatttcttcccatgaagatctttaagagcccttagtaacaccaccaacagtcctatgcttgataaattttaggtatcactcttccaaagagatgaaaatcattcttggtatcattttgaaaaatctttgagcttaagaagtcttcggccttttgggcctgtctgcaaaataattatcagccctgcccaatacactagaggaggttagagagaggcagttttttgctatgagtcataatttcaatttctattaaaattcttacatggccacatatgctacctctcaggctttgggcctctgggcctgtgctaatttgcatgtctggtttagataatgtctgaggtccttccagtctaaaaaggagcctctgatgctgtgatataataagtgagatcacattccacctaccaagacttgatggttctttttcttttaactactgtgctctgtctgatgtgtggatgcacagctcagggacggaagtgtttcctgctcacctgccaggccacaaaagaaggagtgctcttggccgggcgtggtggctcacgcctgtaatcccagcactttgggaggctgaggtgagtggatcacctgaggtcaggagttcaagacaagcctggccaacatggtgaaaccccgtctctactaaaaatataaaaatcagccaggcatggtggcaggcgcctataataccagctactcaggaggctgaggcagaagaattgcttgaatccgggagacggaagttgcagtgagccgagattgcgccattgcactccagcctgggggacaagagcaagacttcgtctcaaaacaaaacaaacaaacaaacaaaaagaagtagtgctccttcagcatgaactcacctgtccacttctgctacactgaacccagagacttgtcctttcctgcaaagcatttcagacataggtcaaaaggcaaatcatgggaattgttgggattttacgtttcttgatttgaatggccgttctaattcaacgtgaatccaagaccacagacttgacaatcacctgattcaaaatatgtgaaaagtacttgagtctttaaaatatggggttcatctcaccttttactattcctctcccaaacatcaaagagatgctgtcaagtttcttagctaactttgctatcctacaacataaagcaactctcatgcataaaaaactaattaaaaggaattggctttccagagggactttgagaccaatgtcagccaatctgtcacttttcaaaataaaattatggaactatgtagagctctattttcataatgttagatcaagtctttgctcaaattctatattttcagagaagacctcccatccctgcactgcctacttccctcctctggttttctcttcttcatagcattcatcgccttctaatatacaatgtaatttactacttgtcttgaatgtcagctccacagaggaaggacgtttgtctagcgattgttgtgttctcagcatgtaaagtgtctggcaaggtagtagacattcagtaaaacattgttgaatgaataaatgtgtggtgggacataaggcatcaattaaatccaataagttggtgatggcgaggggcaagaatgaatttttgagagaaacaaaggtgcttaagatacaacccctcttcctaaagatgatcacctagcgagggacacaagcgtacaaagaattacactcaaaggctaagcaggacacgggcagtagacacaagacaattcaccagtgagccttgacctgcagaactttgaaagcaaaggacacagaagctgaatgttacgcagacccaagagtgtatcccctatggccaaggagaagaagggcaacctcgctgtgaacattgcaacctatgagggtcggagcagggcagagggcgttgcgtataaactgcctctcatttatcctcaagcctgattacctaagtgaactgttatgttttcttctttctacctggaatcctcttaaaccagaggcagatttgacctaagaagtatgcaatttagttgcgtctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagagcctgtgggagaaatgaaatagaagaaggtcccaggttcagcagggagcctcacgtggccatggcaaggctgtgcccagagaatgtgccacttcactctccacgcttttcatatttaaaagtcagctatttcttccaagccttttcctcgtaggtctttttttccctttgcccatctaatatcttcaacagtacctccattatgctccacacagcagggtcagctccgaggcagaggggctgttggattccaggacaagatccttgagcaaaggaaacctgatccaggatgttttttccctgtgagttccaagtttggggaaagcgttccctggatattttcctccttccaaggtctcagtggatgccaagctcctctgttgctctttgggatgtaagacgccgctgaagtgaaggtttaatagcccctctagaatggtgggatgtagtgaggacttggtcctgagcttcaaggccaggtggccagtgactctggcacctgacagtgggggaggaaggaggatgctgggtaatgcctgggcctaacagccaggcagaccacctgtagccatcagccctctctgtcttctgggatggggtttctcaaaccagggtccaggataataatccacctcttcttttaaaagaaagccacgatttattttattatattattattattattattattttttttttttttttgctttggagacaggatctcactttgtcacccaggctggagtacaatagtgtaatcatagctcactgcagccttaaactcctggcctcaagtgttcctcccaccttggcctcccaaagtgctgggattacagccctgagccaccacacccagcctgagagccaagctttatttaaatttgggaatcactgttccaggagcacaggaataaaactgtccttcatcctttatagccctcaggcttctcttccttttcaaggccttcctcaatgggcttggtaatctcatctcaccaagataagcatggtagaggggcaagcaggatggaatagactccatgtatatggtgtgtatttttaaaatcaccatttatcacatgcttatttaatcctcatagcaaccgtagaaagcacctgttattaatgcttttcagagaagcagaactggaggttcaaagcagctgagcaacatgaccaaggtcactccacaaggccaatggcggagctgggatttgaatcccgggttaactgattcgaagtcctatctcctaactgccaaaataatccccaggcccaccagagagaaaggataccttcgtgatgacatcctaagccctgcatctactttgcctcagggtggggctgagagcgcggactcgagcaaagactgcagcagatgagaagctggtcctgagctgtgggttgggaaggttcgggcagtgcagcagttctcacaggtggagagcaggatgaaggaacgcttagaggagagcagcttctgcaggttggtggctgggagaggctgctcctccccaaagactggacctattagaagcacaggacctctgatggagatggggttttagaggatttcctagtccagccctctaccagtacacgtcataacctgtcggacagcccaacaacaaagaccgccgctcacctgcagtttcttccctgtcggagtctgggagtgaatcttcctcctcgtgggcttggctctcttgggaagttgagggctttgggtctcaggtctgccattgatttgagcatttctcctgtgcatcctcactctttcaagaaaggaggtctggatctggctaccaaatccccctgctctgctgggagcatgagcagccttgcccattgctcggctgaaaggtctgcattcagaagccaggctttccaaggataaacagggttaggtgctgccagccttcttagcagcaaccagaaattcaatgagaagtttcagggaaaattcatctttttccacccagtcattgagagcaaggttttatgacacagaggatgaagagagaggcttttgtgggctgatgtcgctgtgttgctggcctccggtcaggtcacaaggtggagcgctgcatgccggcagggacgtttgggctttcagacagcagaggcatcagagcagaagcaaatatcttcccaaagatgtttggccatatttctaggaccaggttaaaagcttcacacagaagctaagttaacattggtatgtctatgagagggtcatgtccagaaacagctttcgccttccaacagagactttgcggaaaaaaatctccatgctcatatttctctacctcaggaggctctcctggaatctaagaggccatttagtgtcaaattcagccccactaagcatcacataatggtgatactgttaaggacatcatatatgtgaggctgaattatccacaatggctggcaatgtcttcattctccagactgaggctccggcctctttgctttggcaagagttgatctcaggactgcctgaaaccagaaactccaggcaaagctctttgggtcactcttctgaaaaggaatcacaataataagatctgttatcttggtactctgtaaagccaaggtgtcagccttcacgacagtgaaaagttagtttgtcagaaccagggtgtgattgtctgctgattaagccatctgccaccacagaaacagaccaagatcatcaactggtacactggtgccgacggccacatttttacacactgggcctttggctgccacctcaagtttgtcagttctcaggaggcagactccaggcaccacattcgagagggcctccatgcacgctcaggcttcttctcatagcaggcacaccctgcctgagccccactccatgcgctgacggagagtcggggcaggagctctcatgcagccaggtgttgggctctgcaagggggtttgtgtggggatgtgagccactgggtcagctccctggttcaggcttctgcattcaggttatagacatatctctgtgtgtatgttggggactagagatgaccacactgctaaattcttcttgagtgacttttagtaggaaaaaaatatgaaccctcacttcaacaatgacattgttaaaaacacataaaatgcacaccacttcaccgagcagcattcaggccttgacttccctgtgggaacaagcttttagcctatgcctcatacataaataggtggattgtggtccactcagaggggacacaggagtgatgtagtctgtacccctcaacaccccagatggaaatcttttgcctggaggcttaatttcgtgaagaagtcagggtaggagcactgggttctcttcagctagtgatatcatgaacaataagaagaattgtgtgtatgtagcaagtaggagaaaatattggccaagtttattcattcaacaaatacttagagtctactaactctgtgtggggccctgttctaagtgcttggatgtatcagagaacacaacagagatccctactcttatggacctgatgttcaggagggagggggatatgaaccataaacgacaaatacaaattaattactgattaaattatgtgataagtgaaaatggaagagcagaggaaggaggatgagggagttgcggggaggagggaattaatgtggatttggaaggctgcccaacatgtttctgggtctgaatatttttggtctgtgacacaaatcgtattcttgattgctaacatccactgaggccacctctgtgctgggcactatgctgggtgtttacttgggtatctcatttactctgcaaggctggcctggttcttcatacccctagggcagaatgcaagactttagttcttggccttctgcatcttcatgctttttctttggagcagaaattgctctgaaaatgctgggtttaacttaaatcttacattgaccagacgtctcctcgagccccagagcctacggagtgcttttgttaaaccccagagccaatgtgctcaggctgtcctttgtgcagccaggtaccagtgggaagattttccatgcaaatacttgggaataaaaaagaaatgagagggaggcctgtggtctttgctactctgactccacaggctgctgggatggacgttggatgaagacaccagcttagggcatggcctgttgctatttatgactctattacttcacagtgagagcacagttcaggctgactgctgggtggcctctgtgtttctgtcacttcctttttcacctatgtgaggactgtagcattgattgggacttccaaagtcctgttagccaagcttctgccatcagatgggcctgtgggcacattgccccataaaactctgcctccttcctaaggccctggggcaccacagaaagatgggcctgccaagccactgctctgataaggcatgcctttaaccaggctccatcactcagagctacaggaaaatcccatggtcatccgccctctgttggtgacagggaattccatcatgcattcagatttttgcatgcctgctctgtccctggaactagaataagagaatagggagaaaagccgataagaagtcaacgataactatagccatggccataatttgggctccaaaagaaataattctgagtggttaccagatagctttcagagagggttgaagccttcagtagactaatgattgagcagaaaaaaatgtttagaaaacttgagacagattttatccatgcagtaagtcagaagtcaagtcagaagttcagatgacatgtacgattcctggaatttagtgattttttgtttgaatgtgttacttctcttctactttctgttctgctcccactagaattatctccttcccccaggccctcagatccaccccacataccacaagctcattcttcaccacaccctgttttctagcatggctgcaagcgcaaaacctcccttagttcccacctgcaacgccaaggtcccagagtttgctgagctaccatcagcaagaccttgaacatgcctcggccctctctcctctccctccacattgctctacttcagtggtacagctcctcccatggctgtctctagacctcaccttgacatctcaccacccacctctgccttgttcctacctgatgcactctcccctctccaaagagtcacctggccctagttccactcacctctctgtcaacctccaggaaccctttatgtgtcctccatgccttaggcacatgacccgtgtttcctcacaatcacagttaccctctcatactcacatgcaaggacgaggaacttgtttcctattacttcacacccactccctggccatgcacacaatacagtgcagaagttggtcccaaatctattaccagaggcctaagcagcagcctcctcctgctcaaagaaaaatgttctgccgctgccaacattgcacttcctctgcaagacatctcagaaaatgcccatcagagccttccacctcattccaagcttgcaagcaagctggtctttcatttgtcttgtttgtttttaagcaagaagaatccctttagaggaggaattaggaaagaaaaaaaagtcaaacagaaacagaaggagtggaggtttgtctctctcttttgtcccctgccttgcccttcctccctatcccatccccctcactttctgtgttgcttttcatgccagttgctaaagactgtaattttaaaactgaacgggcttttccagagccttgaggaatgtgcatctgcacgtggatttttccacaaaaaaagtgtccctgtcttttggatcttcttagccagaaacaatgaggccaggcaatcagagtccatccgtcttcccaactcttattctaatttgtttgagaggctcagaaggggctgaagggcatggttgtgtttcaccccgtcagactctgttgtttgatgaggtttgtgctccatttgttcggatggtttttatggtttctttgttgttcatggaataactttgaaggtcataattctgtatcctcaagctcctctgctattcctgctcaatgtctcaatgggactcataccaagagaaagggaaggaagaagtttccagctagttagttaagcaatttctcaacacatttatggaagcatgtggaatctttcaagaaaggggttacgatcacaaaagttcgatttgaggagtattctccaagacaactgagaagcaagcccttagtcatgcccaggtggggagcaggtctccaacctctcatttcctgatccagcccctttcccagccacatttctggcctcttccctttctctgtggtcatcagcccagccctctccactatcaatagaaaagcccgagagccctcagagagcctggaatgtgctcccaccgctgtgatgtcatcccacatcatccatgtgctgaaatcagggactggagtcggcccccaggaatgtcatggccatgggctttgagacactcttcttatgggcctttcacccaatccagaccttgcctgctcttcagagctgcttgaaggattttgctacagaactatggacatttaagaaatgtctaaccttgtgtcagtttatatttgtagaacgcttcataaggtgcttttccatatgttatctcatctgatcatttccacaaccccataaggtagataaaacataaatttttatttccgtattaaaattgaagcccagaggagacttttgattcatcccaggtttcacaacaaagagtgtcaggaagagaacttgaaccaatcctctgacttcacattcagggttcttcccattactttggctcccagataagactacaatcttctgaaagtcagagtgttaatattccaaccccagggggtgagtacacttccagaatttagggatgctttaaaagccattgctgaattgaattttatttctcctgatcactacagataatgctcatgcaacttttctgagaagcaggcgatgctaatgtacccctatttgttattgttcattagacccttcttatgactcagtcagaagaggagcttggggcaataacatgaattctggcctcaacaaaagtaagtaaatgttttatagttctttggaggaaagcatgtttctgaggacaggattggagaacaggatcatgagacacaggagagcagcaagcatttgtttccctgctttttgagtagacatcaaaattatttgccaatttagggcctttccatgataccagtccttgaaagatgatatgggattttcgtttagatttttgagttttgttttattgcgctcggttttagaacatgggaaatttgaaggttttcttgagacaaggttctgtaccaatgaatggtcactgtcactgggttttgcttttgttatttaaatcaagataatgactcgctataattttgctcccgtaactgttgaggctaagtcgtaccaatttccccattccccttgatactgggtagatttcctcatatcatcatctcaccacttggtggagaaattgatgtctcagaaccctgccatctcctcaacaggttatcttctgtccctgatgaggagatgccggggggtctgggacatcaggttctccaccaagtggtgagatgatgacatgtcgaagtctacccaatatcccccagtaagagaataaggggcaagaatgactcatgaactcctgtaccagaaatcaaacttgccatgcctaggaagcaaaatatgaagcacatgaacaggtggtaaagggaattctttcaagaaagaggttggggttacaaattaatgcccaaacaataaccaagaccccttccaattatgtgtattaattatttacttactctgcacatgacatttggcaatataagattcacaaagatgaatcagacatgcactggtctcataagcgggagagagaaatcaagcacacacagaactcctttcttctggttggtatcaaggaaggctttgtggacctggtagcacttgagttagctctggaaggagaggcaggatttggacctgtggcgatatgggctggggaagacatgagcttggcatgtctgacagtcagtgaggacctcaggttcctggagcttaggatgtgtgatgcagaagaagtctggaaaggtaagaaacagaattgtaaatgatgctatgaagatatgccttagttctttaggcaatgaagagtcactaaggttttgaacactggcgtgtatggtgggttgtggggagacagaagagtaatgaggacaccagtcagactaagccagaaaccatgcaagaagcaatacagatctgtgatgcagaagtgatcatgggaatggaaggggtgtgtgagagataccaaggaggaaactcacaagacagggacaccaggaagcagctgatctttgctcagatgtcactttctcagtaaggacttctctaactttccgatttgaaaatgaaatccacagcctcagtaccatcagtgatgctatactgttagtttactttttaaaaatttgaaaatgaaaaggtgacatttaagcaaagacaaaattttaagaatttaaaaatgtgtttattattgtctctcccattggaatgcgagttctaccaggaactgcttgttcattcctgaatctccagcctggagaacagggccagcacatagtagattctaggtaaatgtttctaaaataagatgaataaatgagtcagtggagagtgggcgaaggaatgagtgagaaagcacatctgtcaagacgtcttgctcccctcggggagctgggtcctactcactgcatttctttccctcttgccacaggtcctccccttggaggggcacaaacgatcagtaagaatacagagcaacggccccagccaggtacctgcccaggatatgtaatctctcctttgcttcctgcacagttgttgatttcacatggtcaactgatggagggtttaaacaatataccacatatgttttctcttatttctctcaaagagggtctatctttgaccctaatagtcctgtgaatgaagtaacaggtactgacatcaagtagagacttgttaaatatcaaaggtgaaagaacttgaagatgaactattccaatgctttattttgttcaataaagaaactgaggcccggggaggtgaagtgacttgctaaaaaccatacagctggttaatgaaagaaatagggctacaatcccagatcccccaaattcctgtccaagccttttatgcttcaccaaaccttactttcagaaatatccccatcctgtgatgagttggcttaacaattaaggcagaggaactttgaaagccatggacctggagactccgtattggagaggaacttggagatttctgggtctatcctaccctcacctctaccttacttgtgcttgtagtaaaacagggcgttgactttctagctgggctcagttccactatctgacccaaagtctgcctcctggaatttccactcaagcttttccttctggagaagccttcctcctgcttcctccgaaatcctttgcatatctgaagacagctgctgtgcccaagccccagctcctctctctatcttcttatgtgatgcagctgagatgaagttctgaacaagtcatttgctttggggtaggcaaacattgttccccatctccacagaaggcagagcaagagaaaatcaactgacatttcacctggaaggttaagaaaaaatttgctgactgtggatcataagtcagatgtagagagttttaaagactgtccaataacaacaaaattatgcattagtcatcacctgccaaaaataattatcatattaatgatgtggatgagaaaagatggtctcaatgggcttaaggacttttgaaggtaatttatggttctaagtagaaacccaaaaatcatagtgatatttttaaaactgcaattatagttgaaaaatagcaaaattttacaaaatacatgacaattttgccaagtcgagacccagctctctaccatgatttcctcaactaacaaaaaaggagataaacctctcacctaaaccagtattgcaaagactttttcatggctaaataaacacatacgttttgaggaaagtgagattttaagaatagtcattttatagctaaaatgtacactctggtttgtgctgacatttctggcttgtgtgacatttcaaatcacagagtgttatactagaagaaaactgaggaatccagtagcccaacccactcatttgtcagatgagaaaactgattcccagaaattgtccaacaagttatttgtttatcacatagctgctgctaaaacccaggctgcttggtttctaggcatgtgtttttcatgctacattcaaaaaaaaaacagattaataatgttgttagtattaggtagagttattaaagaccagtaaccatgagacctgctttaagcccatggagtcagctgtccgttgtatcattgaatattatccagttcctttccaaatgttttctttgttttgctttgggtaatgacaacataatctgcacattttagatgccaaaataagaaaaagtaatcctgttcctattctttgttctttctgtaattattgagatgaagaccacaaatgtcatcaagatctttgagatctgcaaataaaagcagtaaagttttctgaaatcagtctttcctgtgatcttgaaataaaagtataaacccttatggttttcttatggttggtacggttgtcatattttttaaaaacactgaagcaaatttccttttttatttccttagatccgtatcagatcctgggcccgaccagcagtcgcctagccaaccctggtgagtttaccttggcctgcaagccttttttgccagaatgtttcgtagctttgtgaaatcacagagacttctgtcctaagtccagacacctgagtggggagtaacatgcacctctttccttgaaatgttcaatgtctgtttctggagcatgtgaacaacaggtcagggcttgttatgaggtgtcaaggttggttagctgaggatacttctaggaataaacacatcagcactgcacatgtgcacttaggtgtagatgagtaataagtggcacaggtaggtaggcgtttcaatcagagaaaatgggcaagaaagagaagaagacaactccactcagctctcagttgtctcccacatgccaggcacaagttcataaatattccaaagggttttatttgtgattttagaaagtgttgccaagttatctggccttataaaagagatgtgtcctggaaaagttgcagatatagtcaatttgaccttgtactttaaagatttagtatcaaaaataactctcaagagggtccttctaaaccaagtccatcgagattgggagctagcaggcccttgtcgcagtgtggcccactcaccttcccatcccagggactctgcctacccattccttagtgcctggtcattactgccagaggagaaagcagccacccagcatattctgggtatttttctctctgcacaagttctctgtagaacttagagctgcaagccaagctctgggcctgccaagggccaatccaggtcctgtccatccaaaagctaaagctcatggcgcagcttctcccaatgactcccacagtcatgccttgcccctgactttttattgctgacagggaattccctgggggacatgaccactaattagagatcagtcagtgattcaggcctttctagatgaagagattcaaaagccttgccaaagggattgaggggggatatggctcacccaagatcacacagctagttctgggcagagtttgcacctcacttcccacattccatttaccaggccttggggcaaagcatcttaggatctaacctcgcttattatacccatctccaaggcaagcagaaaggcaaatcaacaatgacataagaagggcttgtcaagtcgatcccaatgtcgaaggaaacaaaaggtttctttaaaaggatgagaagctccctgcatttagggaactgggttctgccttctctgggctgaggtgttctgttctctcccgtttgcctcacggcgtgcaggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttactcatcagtggccttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagtggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaatttttttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaataaataattaaaaattaagaataaataaacgagttgacctcggtcacaaaagcagttttactatcgaatcaatcgctgttattttttttaatgtaatttgtacatcttttttcaatctgtacatttgggctgtctgtatgtttttatagctggtttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcagtgctgaggacagttttcttatttaccgcccccgttaggtcaaagggttttccctggggaactttcctatttacttcttgcactatcaagaatttttcgaatgtacctactgcagtacagcagaaggtaaaaaatcagtgtggtttttcattgttgttgatgatgtttgtagtgtttttgtgtgtgttatttaaatcttcctccagcctaaaagggttttataaaacagcagctaaggccatggataaacctgtatgtaaggactggagcaaagcgagctggtctatccagacttgtctgtgagatttaactctgcagcctcccctgggcacttcagacccagacggccaccttctgccactccagcaaagaataagcgccctgcttccttcaggtctcagaccaggactttatggctcatgcagatttttaaggtcatttttcttcccaaggaagaaacttgcctccagttccttcactgttaggtagcttattttcattttctctattttacaatgaaaagagtgagacctgggaagtccttgatttgcaaggaattagactcacagcattggtaaccctagaaccttcttagggtaacactaagtaccttctagacaacatgtctacctaaatgaaatgggatgtgtttcggaacatttgtctccagtttttttttaatcttgcaccctgccatttaaaaagatgtgtaaagcacatattctcaacatatgcacattgatttataaatcatatatacaaactgttacattattcttcatattagaaaacaaatacaaaatagaacattttaaatggtgatataaaaataaattgaaactgaaattctactcttttcctcctattttctctatattgaatatcctctgctattaactctcaaaacaaagatgttggtctttagtgaaaaaagtgtatgcatgtactggatttctagtgacttccaagaaaggagaaaattaaaacttggtattagtggcccaagcatagaaagaggaatgatgaaggccaggtatgtttaagaacaaactagctgaattctttggcagatctccatcttagccacgcaatttccccatcaattttgaaatctgcaaagtattcattagggaaaatggaggcatatatttctgagtgctgtaagaagatgctcagcccattagttcattcttttaaaggttttctttatgtgtcctactcaaacactggctcaggctcatcttctctacacagtcatagagctttagccaaatctcgccccctgaatatgttccacagtgatttgtcctatgcctcagaagctggcccactggctgacaggactggggcaccattttctcctcataagcatttgtacagagggggcactggcatttattcccctgcaatgcccagattgaacgtttgctagctggctccagggcatgaagcgg

SEQ ID NO: 16431 - DNA, 16741 bp, Human
  misc_feature (1)...(16741): n = A,T,C or G
aggtaatattgtaatgatcctcagaaaaaggccctcattttagccttcatttcatttccatagacactagcatggtatcctatatggttgatgctcaattaatatattcattaaattgatagataaaaaagcttcttttcttctagtttgaagtagtaacatttctacaaatatgtgaaaatctataagaacagttagcctatttgattctttttctccactttcaaatgtttaataaaatgttatttgttttccagcttcttaagcacttcttatctaatgagattttaatatattatgaaaatttatttgtaaaaacaaatgctttctaataaactaacttttataagcttagtcgatgaatcaaacttttttggataatttttcacttaatctcaaaattaaatattatgatacatggaagcaacttaaaataaattattgctttgcattcctgattgagcaccaatctaatcttgaactcactggaaacaatctatttgaaagggtatatttggctgtattttgtttggataaaggcatatagtaaatttccctcaaatgatcacatacatgttgtaggcttttctgatttttctctaaggcactggctactctagattataggattttactcatatgttaggatacccatttcgtactcaccctaaagctgtatacatgctccttctctttgtcttactatgttcctgacctgagcagcattttctttctgactcttagtcactcaaattaacctgcatttccaatcatttatttaaagaagtccaataaatccaaagatcatggcctatattgctctacccatttacttctgcaggggaccaaagatggcactttgatttcacggtactgaatgtgtgatgttctgaaaggaataatagggtagaggcccctaggactattttcctgatggttggaccaagattacttctattattcaaacttaaaaattgagaaacttgaaattggcctactgcagccctagttttcttgggcactccctgaggtgtaggaaccaaacagctcagcttttaagaaaatatctgagaatggaaagggtggaggtcataattagacagggacggtggtcaagaacattgagttttgagttattggcctaggttcaaatcctggtatcatttataaactatatgaccgtatacaagtatttaacttctcagtgtatcagattattcatatgtaaaatggaaaacaagctttctgacagcacctatgtggctgttgtaaggattaaatgagataatgccttttaaacctagaatgcagtaatccctgtttgtgctagccattacagttgttccgttccaatgtaattcttctacctctgtctgaatctgtagggaatttatgcaggactccatatttgtcgagaggtcatgccagtgtgtttaaattccaaccatggggctcaatcctgcggttgtgccgtagcacctccaagtcatcaagcttggttttggtccaatatcgtgaacttcaggtagacacaagacatctctctgtagatattctagagaaaatgcagtttataatttaccagcagtagtaaacattctagaatcagtactaagtttctctttatggaagtaaacatgccatcttgatacacttattattcgaagaagcaaaagtagatacgttcttacagaaggcaaaaaaaaaaatttttgctaagtgaagtaaaaaatgtactactctctgcttcttcccacagtatccataaatatgctgaggccgtttattttgccagatgggttttgagaccctgctgaaacaagagatgctctcatttatatttccctcaaattctaccacaaaccacactcgggagggaaaagaaaaagtcgccacgtaagcatgtttaccttcaagtgactaggaagtggaaacctatccataagtgatgactcaccattgcaggcctataaaagtaaaggtaatctctgcggaaagacaacagtccccaggcatcaccattcaagatgcatccaggggtcctggctgccttcctcttcttgagctggactcattgtcgggccctgccccttcccagtggtggtgatgaagatgatttgtctgaggaagacctccagtttgcagaggtagagtatcttgccaatcctgatgatgcggttggtacatctcagaaatgtccttctcttttaaacgcagttcattttggtgtcttttctagcgctacctgagatcatactaccatcctacaaatctcgcgggaatcctgaaggagaatgcagcaagctccatgactgagaggctccgagaaatgcagtctttcttcggcttagaggtgactggcaaacttgacgataacaccttagatgtcatgaaaaagccaagatgcggggttcctgatgtgggtgaatacaatgttttccctcgaactcttaaatggtccaaaatgaatttaacctacaggtaaatcataggctatctttctttcatatttgttagccttttcttgtagtattaaatgtctaatattaagtaggccttattatttaattggcagttaaattccagaatagctttaatatggttgccgagaatacctcataacatctattattgttacattaactcagcattattttttagtgggcatctcaaagtatttcttttagagatgaaatcaaaagagaaataaaagtaggttaaagaaaatttgcaaacatagtacattaggtgtatttattacaacagtgctcaagatgaagagttccactctttctagaaactttacagagctatttcatttatttgggctttatcaatgtaatctaaacttttagcatgcaaaataaattatattaaacattggaatattttaaatttaagatgccacatggtcagatatttggagatactcaaatgtggctgaatttttgactttttattcttgtatggcatcataattaatacattatttgaaacaataaacctctagtagaactttcaaagaaattattgcattttgaattgaaaagcaatataccaagaaaatgtattctaaaatagctgtcactttccaaaaagttcattgaaactttctctgttaaatagaattgtgaattacacccctgatatgactcattctgaagtcgaaaaggcattcaaaaaagccttcaaagtttggtccgatgtaactcctctgaattttaccagacttcacgatggcattgctgacatcatgatctcttttggaattaagggtaatgatgcacatttattttacaaacatttttatattctaattcttggttccattttaaaattatttatttcagtcattcattactttttaaagcattcaacactaatttaccaaacacctgtgctaagtactcctggatgtgataagactcctaacccttgcttttgtgtgtagagcatggcgacttctacccatttgatgggccctctggcctgctggctcatgcttttcctcctgggccaaattatggaggagatgcccattttgatgatgatgaaacctggacaagtagttccaaaggtaatgtttcttataaagatatcatttatgtgttattagattagacagtgaacacactggtatgaagttaaaacacataaaagttaaatatatttggtatttgactatattttcttaaataaagtttatcttagatgtattagtgtctctacaagtgacatttctacaaattgatatcaacattaaaaaatgaacaaaatctacttaatctgtcactgtggcttgagggatactaatgaactttgaagtaggaccaaaatgtttatgtctgtcagccaacatgttattactgcaaattaccttttggcatgttgaggaagtacagtttattagaaatatctaactaaaaactaccagggctggatctatgggtcatacatgaattagatgtgaattgaaatagttttttgcttggtagaaatatgttcaatcaaatttctgtttcccattatatgagttgcttgattcagtcttgtctatatattgtaaacactattcttaaaaacctagacagactcttactccaaacagcatgaaacagacaagatgatggttgtatttacaagagcaaaatgaaactgaatgttgaatgagatcagttagtagttaaatcttcaagtctcaaaataattgggaatgttaacttaggaagaaaagccatagattgttctaactaggacttagttatgacaagtagatgttgtcttcatagacagctgagttttatttttcatttaaataaaaaagattatttctccaaagaataaaactgggccttacatgatcagtgtctcaaatctaatacctccaatctgtctatggagagaaaagtgaaaatttacatatttatgttctgggtatttcacaggtaagaatggtttcaggaagaagaaataatatccagcattgttaaggtagaatcacagtaagcctcaaatttaggttcctttataaattctgggtttgaaatatttaattgaagtgaataaaaacatccacaaacaagtctggattcatttttcagtggaaggccaagaggggtatccattactagtcattcaatgaagaattagttaacactcagattatgtgacctctaattgctctcatggtctgcaaggtttgctaggatggttcattttcttcatgcacaggctacaatagcagagggtatttaaggtcaaatggaatccactggctctagttttcaggtaatctaagcacaggtaacaacaatcctattgccttgcacgtcttatttttcttttagttttttattttcttttttccagtttgaaatacctgcattaggaggctcaaaattggcagacagaatgcttagagggaacaatgtaaatacagtgacatagtagtcttctagagtagagaaaagatggctaatcatgtctagagtttctgtttctccagaacccagagtctagagacattctggaaaaaatcatttggttggaatttgctcccaagagtaaacacagagaacctatttagtgcatcctccatccttggtaccatccctttggatgctgcctcctgattggaggatgttctgggcagcaccctagctaggtaccaccctatgtgatttccccactcctcgtttaaggtaatctctgtccacttccctcacctgacctgagaatactaagcgcaaatcaggagttctaatgtattcacagtaaatccttattaattactaattacatgagagtaatctgttgacattctaattgtgtaggcagctataatcaaaagaacactaaattatttataaggattaaatcaatactttgaatcttccttcaagcaactgaatattgattttaaaaagtaggagactgaagaaagagaaaagaaagtatatagccaagaaagaaacataccagatagataaaatgatattcctttcattacctggtcactggaattcctttttttctcattgtttctttgttttcttacaggctacaacttgtttcttgttgctgcgcatgagttcggccactccttaggtcttgaccactccaaggaccctggagcactcatgtttcctatctacacctacaccggcaaaagccactttatgcttcctgatgacgatgtacaagggatccagtctctctatggtaactcggttatagaaatagaatatgatcagttataaaagcagaagaaacccatgcatttattttctaaattgcagtcatgctgcataataatgttttggtacagtgaagcgcatgcatgacaaaggtttcataatactgtaatacagtatttttaatgtacctttcttatatttagatacacttaatactcaccattgtgttacatgtgcctgcagtactcagaacagtaatatgctggacaggtttctagcctaggagacatgggctgttccatatagcctatatctgtagtaggttatatatctaggtttgtgtaagtacacgctacaatattcacccaatgacaaaatctcctaacaacacatttttcagaatgtatccctgttgttaagcaacacatgactctactaattgaattcaccactgccaatgctgctttcttggttttgttgttaaaacctaggaaaacatacccattttttctttccaaatctaactacccactcaaatagaaaagatttcattctccaaatttttgcagactataactcctcgtatttgtactttatacattgcaatgtgcatttgatatcctccaaacacctctgcaataagaaagaaaaatattttgttccccatttaaccaatgaagaaacaaagccctgtagagtttaagtagcatacctatagtaacaaggttggtggtgaaagtgagatcctaaggcttttagaaattccaagtactctttcaaccagtccaatctggcacagtagaaacctctcaagtggcctgtggtagtttttaatcaacatctacagtaaccattgtaaaaaaaaaattcttccttttcacttccccccccaagttttcaataatatttacaaaattattaaacttcaacccaagtatttatttatagatgacctgttatagagttaaagccacagtacacagtcatcagtgtaaacacttctagagcacatagctcagaaaacttgctcatagcatccaacccattcttttaccctctagatttcaatctatcacagtagctagcatagccatgggcatgaacttgaagatggcaaagggaatttgcaaatttattttgcaattattatttctacattgttatgactcagggactgatgaaagaactaataaaaactagacagaaagaaaaacagtgtaggattattattattatatactgcacccccatcctgtctgcactcatgggagacggttggaaatttaccaacatgtcgcaagtcacataagtgctgaaggcctggtttgtcacagctgagatacagctgcaccatggcaaactggtgaagcaacattagctgatgttgacagctggtaaaatagtcaagaggaggaggcaagatgagggcttttgcaggaaaaatacgccatcaaaaatggctttaaggggaatctagttttcaagagcaatctgtcaatagattgtgcaaggtgtagggaaaatttctcaaattctgttgcttttttccctcctttttatcatcaacctcaagaaacctaagtttatacttctaaagaatctcgagaggtcttgaaggatggaagtggaggggaggaaggaagtaagattacacggtacttgcaccatgatgtaggagccccaggacctacagcttttcctggagaaaccctctcccactgtccatcagcagatcagcctgttgtactgtgactcaggttatcagtaatgtcacactcataacttctctcttgcctttcacgactacaggtccaggagatgaagaccccaaccctaaacatccaaaaacgccagacaaatgtgacccttccttatcccttgatgccattaccagtctccgaggagaaacaatgatctttaaagacaggtactcttgagattctttcataaagtctgtatgcgacaaacatctgtgaagctgcttctgcatattgccaaaacatcctgtcagacttccaaaggcgaagttagcagtaaaaatgggcaggcagtttatttacatatttcagatcaaataaatgactgatggataaatgttttacttttcaacgtataaccttgacattgtgtagcttccttttacatctctagttacagtctttcttataaatataaccaagaaaatctagaaatcccatttgttttaaaaacagacaagcattgaaagtaactgctgtattaataaatggttactcgttaggcccacacggattcgttttggtatggaaagactttgattctagatacatgttggaatttgagggatgaaatgaaatgaacccagaaatgcaatataaaattttaatttctacactgttccagtatgcttgtttattcattcattcattgatccctcatctgtgatccaatagcatgtttatcccctctgttataactctaattacattgtactcgtggggcggggggtgtttctcatgtatgttttcccaggccatgagaccatggaagacatagttcatataactcatatcttctctctggaggccaacacaatgcctggcacatttgcttgcccctggcaagatacccaaaattgagcaagactgtttcaacctgcaaagaactcagagacctcacacaggctctgtgagatttcaaagttgaataccttacgctagttaggatagcacaacttgtcactggcgcttaaagggtaatggaattttttttcccttcacaggtgggaggtattggttgtatctaacttgtctgtgttgatgtggagagaggtgactagcaggatagaaatattgcatttaaaaatgtgacagaaaactccattttacttttgtgttagattcttctggcgcctgcatcctcagcaggttgatgcggagctgtttttaacgaaatcattttggccagaacttcccaaccgtattgatgctgcatatgagcacccttctcatgacctcatcttcatcttcagaggtaagctttccacagaggagtcctcacacaagaccaggggaggcagtgctgaatttgatgccactagagattcagtaaaatgatcactactgaaaatatacctaaattaaagaccaagtattaaaaaaatggaagccagaaagtacctgaaaccattctaccatgaatctccaaattgaacatataaaaggtctacattattagtcttgtcatatccactctttctttcatatgaatcatgtcagttttttctcttagttctgcttaaaaattgtttattgagaaaacattataccaatatattctgaaaaagtggaaaaaatattatgaatcattcttccttctgaaaactcagtttatttcatttgctcattttcattatgtaatacaaatttttacatatttattttcatagtatagatacatttttatattctactgctttccttgacataaaattatgaccaatttccaaattgctactttatctttatgaccataatttaaaatgattacataacttcctgctgacactgtttgtattgttcaactatttataatattaatgttataataaagctactttttagagaataaaataactttcaaactggtgtaacgtttgagttttcagtctaatttactcttcctactgtgttgtttgttcatgtacaaattttaatgtattttttccacctagctttaaacttaatattcagagctaataaattgccaagttaactgtgatatttgattagctatattcataattgggaagttaagatcctaaattttatttttttgtttcaagaatgcttatatttttatgtttcataaacatgatgactgtaaatactaaatattttattaatatttctcaatgtaaaagtgggcctgtctttaagcacatgtctatatatgtaagtcctaatagattcccttggataatagaactgttatttcactcattccaggtagaaaattttgggctcttaatggttatgacattctggaaggttatcccaaaaaaatatctgaactgggtcttccaaaagaagttaagaagataagtgcagctgttcactttgaggatacaggcaagactctcctgttctcaggaaaccaggtctggaggtatggcagcagtaggtactgacccatctgtgtcatagccgcaaagtgcctcaaacatctgtcactactatacattattcctacacactattgtaaatgtcatactagtcattcattttcattccatgtcagctctttcaggcagaccctcagacatgtatttaaaagtctcaagctctcttgaacacacacacacacacacacacacacacacacacacacacacaatactcaaacattcctcttctcaaacattcttttcttagccatttgttgtgcctctcaaccatctttggcaccccctctttctttctttttttttgagactgagtcttgctctgttatccaggcttgagtgtagtggcatgatcttggctcactgtaacctctgcctcctgtattgaagcaattctcatgtcttgtgtctcagtctcccaagaagctgggattacaggcatgtgccactacacccaactaatttttgtatttttagtagagacggggttttgccacactggtcaggctcctggcttccagcaatccacctgcctcagcctcccaaaatggtggaattacagtcgtgagccaccacacccaattggcaccttctctttctaatctttctcctgtattctctttcttgtcactttctcctaatttacatgtagctccatcttccgtggccaaagaggataccagcatgagtacaggaaaagattggtttagagaaggccctcctatctgcagagttagctgatccactggagaggttgaccaggaagctgacaggcccatagtttataaagtgaaactttctgaagggcgagtgaagctggaatgtttaaaacacatgtaaagatttaggcagcattgacatcaacaacatttaagagtccagattcaagtctatatttgggaatgggaatatctcatcagtaccctacattctaaatgtttaaagtggaaactttcctccatctctacatacacacagtctcacacacacacatgcatacccgcacacacgcacatacctgtatatatcatctttgccttttgacttatttctgacaatgacatttacaacattctagaaatcactgccagcttctaccaggtaccgcatttcattccctacctccataagaagtatattgttcagtcaggattaattgcttactgcatctcagatatgctgttttttatatccccttaagcttctcttaggcaatttttttttgccagaagatccttccctgcatctctccctcttgaaattctatccattgtttaaagttcattcgaaatatcttttcatctacaaagcctcttttgatttccccattcaggggttattgcccggcttcctgtactcccatgacatttcatgattactctctcatgcttgacttctattgcctggcgttgcagttatgtgtatacacatgccttagctttattggtagtttagtggttcttatcttttacttgttggaacatacctccaagatattcaaaaagctctcatcagtaacagtagtggcaccttatgggagcctgttttcctaggttaattttaggatatgtttgcctggttagggtgtggctgtgggcaggggagaaggagcttgaaatatgcagttatggagggggaaagctatgcttcccttcctacctttagtattaccatatgcccctacaactttttagtacagaaattaaaccttaaatatttttgtagccattactgtacactaagtaagtgcaagtaagtgcaagttgtcttacacatagtgagagatcaacagctaattgttctatgcacaaacatgcatttatttcatgcttaagaacatgttcctaatgacatacttttataacagatatatcatttgtgaaatggaaatgagcttgtaactctctttaaaaagatggcctttgggcaagtcaacaaatactcgtcaagcatccactgtacactcagtattctcattcctaattttaaaaagctaccagatgctttaaatggactgaaaattttaaaattcttgtcaattttgaaagatgccattgtatctattgtattatttctaaggtactttctaagaaatataactgacttaggagttttttttctttaaatagatatgatgatactaaccatattatggataaagactatccgagactaatagaagaagacttcccaggaattggtgataaagtagatgctgtctatgagaaaaatggtaagtagttacattgcactgactttaaagaggagcttctgtagcccctcaaaactcttttctgtacaaagcatttttatataggacctagatgtgttaataaatgtatggcagttaaggaattaattgttcctgtgtgactacctacaaagacagcaaaccaaaaaaaacatggttagaataaataagaattttacttaatgattgctaattctataaatacgagatgctaaaccttcaacattaccttaatctatgcttaaagatgccaaaatgcaaggatattgccagaattcaaactggctgtggagtgggaagtaatttatatataaagactcataactaccttaactatatagtgactttttactttaattatgttctcaaccttttttttttttttgacagagtctcactctgtcacccaggctggagttcattgtcgcaatctgagctcgctgcaacctccgcctcctgggttcaagagattctcctgcctcagcctctggagtagctgggattacaggtgcctgccaccatgcctggctgatttttgcatttttagtagagatggagtttcgccatgttggctagtgctggtcttgaactcctggcctcaagcgattcacccgcctcggcctcccaaagtgctcagattacaggcctgacctcaccgacctcctttaactatgaaaagagatattattgataacttataacaaataggctgggtgcggtggctcatgcctgcaatctgagcactttgggaagctgaggtgggcggatcacttgaggtcaggagttcaagaccagcctgaccaacatggcgaaaccccatctctactaaaaatccaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagactctgtctcatatacgcacacaaaaatcgataatccaagtagcaaaactgtgtaggaggattcacaccttaaaagaacaactaaaaaataaaaataaaaaaataaaaaatttaaaaaggaacaactattaaagaactaatagagtttaaaaagaaaaagtttgaaattcctacaaatgggatctaagagattgaaccattaatattaactggattaaaaccttattattttcaaactctgaaattgtctttatgctttttcttataggttatatctattttttcaacggacccatacagtttgaatacagcatctggagtaaccgtattgttcgcgtcatgccagcaaattccattttgtggtgttaagtgtctttttaaaaattgttatttaaatcctgaagagcatttggggtaatacttccagaagtgcggggtaggggaagaagagctatcaggagaaagcttggttctgtgaacaagcttcagtaagttatctttgaatatgtagtatctatatgactatgcgtggctggaaccacattgaagaatgttagagtaatgaaatggaggatctctaaagagcatctgattcttgttgctgtacaaaagcaatggttgatgatacttcccacaccacaaatgggacacatggtctgtcaatgagagcataatttaaaaatatatttataaggaaattttacaagggcataaagtaaatacatgcatataatgaataaatcattcttactaaaaagtataaaatagtatgaaaatggaaatttgggagagccatacataaaagaaataaaccaaaggaaaatgtctgtaataatagactgtaacttccaaataaataattttcattttgcactgaggatattcagatgtatgtgcccttcttcacacagacactaacgaaatatcaaagtcattaaagacaggagacaaaagagcagtggtaagaatagtagatgtggcctttgaattctgtttaattttcacttttggcaatgactcaaagtctgctctcatataagacaaatattcctttgcatattataaaggataaagaaggatgatgtctttttattaaaatatttcaggttcttcagaagtcacacattacaaagttaaaattgttatcaaaatagtctaaggccatggcatccctttttcataaattatttgattatttaagactaaaagttgcattttaaccctattttacctagctaattatttaattgtccagtttgtcttggatatataggctattttctaaagacttgtatagcatgaaataaaatatatcttataaagtggaagtatgtatattaaaaaagagacatccaaatttttttttaaagcagtctactagattgtgatcccttgagatatggaaggatgcctttttttctctgcatttaaaaaaatcccccagcacttcccacagtgcctattgatacttggggagggtgcttggcacttattgaatatatgatcggccatcaagggaagaactattgtgctcagagacactgttgataaaaactcaggcaaagaaaatgaaatgcatatttgcaaagtgtattaggaagtgtttatgttgtttataataaaaatatattttcaacagacaattgctatatggtacattgtctttaggtataatttcaatctttcctcacccaaagagggttcattgccaatatttttatttttggagacagagtctctctcagttgcccaggcttgaatgcagtggtgtgattccagctcactgcaacctccacttcccgagttcaggcaattctcctgcctcagcctcccaagtagctgggattacaggtgagcgccaccatgcccggctagtttttgtatttttaatagagatggggtttcaccatattggccaggtagtcttgaattcctgatctcaggtgatctgcctgcctcagcttcccaaagtcctgggattacaggtgtgggccactgcactggacccttctttttttttctttttaagaaaagatgtttaggccaggttcagtggctcatgtttgcactcccagcactttgggagaccaattgtttgggcccaggatttcaagatcagcctgggcaccatggtgaaacacagtctctacaaaaacaaaacaaaacaaaacaaaaaaaaaacaaattagctgggggtggtggtatgtgcctgtagtctcagctactagggaggctaaggtgggaggactacacgaggcagggagaggtcaaggctgcagtgaaatgtgatcacaccactgcactccagcctgggtgacagagcaagacctagtcgaagaagaaggagaaggagaagaagccaggtcccagctactcagtaggctgaggcaagaggatcacctgagcccaggaggttgaggctgcagttagctatgcttacaccactgcactccatcctgggtgatagagtgagaccccgtctcaaaaaataaacaaacaaaaatagaaaagatgtttcacttgatttcagaaacattttccctatgtttaaccattttctttcatgatacttctctctcatggatagacagacagacagacagatatacataaagatatatagatataaagatatacataaaggtatatagaaaatatatatagtcaagattgtttcctgacttccacctttactccagtctcaattcaaaattccaaatccaattggtgttaccttgatgagtgtccttccacagtaaccaaagcatcgaattcaaattatagcaaatgtctatttggagtttaccactggtgataggggtagcattaaagagagctgattatgaactgagcagatggtcctaatagaatcttctatgaaataggttacaggtaaaatacagatagccagtttgtatagatattcacgaatggggttgagaagaccaaatgaatgttttatgagaagtaatattatattcacaaattaaagtgagagtgcatttacctagagctaatgtactaggcaaatgcactgccttaaaattgaattgtagctagtaatggcctcttcatcagataataagggtaaaaggtttgaaaaactcctcaaagtgaaccaatagcatacttgtatttggaataggagaaactgacaagatcttatattggtgtaacaaattttgctcttggaattatcctgggagaacttttgtattaaagcaaaaatattgtcctggatttccatatcctcatgtcagaataaaaacacgaaaacatatataacagaaagatagccaccataaaagctaccaagtttaactcacttcccgtttagaaaaaaaagtgcagctctctgcacgcacagttttctcggagccaacaggagtggattaagccctggtcacagaaaataccttgatttacggattcatcacgacgctgtgagatttacaatacttccactaggtggcaccagcaacaccctttttaaaaaggttgaactggtcagagaattcaattaagtcacaaaaccagtgctttgttctttaacataaggttgaggaacttagccacatcgctgattgtttaactcctgactttacattactgactttcaagtaagatttaatagctatggaatt

SEQ ID NO: 16432 - DNA, 4938 bp, Human
tacccatgttctggtctgcaaaatagtttttttccttttcaggcacccaggctagagtacagtgttgcagtcacagctcactgaagcctccacatcccaggctcaagcaatcttcccacttgagcctcccgagtggctggactacaggcacacaccaccacacccagctagtttgtttgatgttttgtagaggtggggtctcaccatattgcccaggcttgtcttgagctcctgggctcaagcgatcctccagccttggcttcccaaagtgctgggattacaggcctaagccacctcatccagcctgcaaaatagttaattgagctagaacattagcctttttaaaaataattatgaatgttcacacatttgtatgaaaaacttcaggaacttttattatatgctccacaagaaggaaaaaaaaattgttctaaaaaaaagtttaaagaattttgttaatttcttttttcttttttttttttttttttttgagacagagcctcgctctgtcacccaggctggagtgcagcggcgtgatctcggctcactgcaagctccgcctcccgggttcacgccattctcctgcctcagtctcctgagtagctgggactacaggcgcccgccaccacgcccggctaattttttgtatttttagtagagatggggtttcatcatgttagccaggatggtctcaatctcccgacctcgtgagccgcccacctcggcctcgcaaagtgctgggattacaggcgtgaaccaccgcgcccggccagaattttgttaatttcatactaacttgtttatttcagtttaggtatacaactgtctctatctcacctcatgggtctgcttcccactataggacatcttcttaattgccaccacctcattggtgtgagcatttgtagcctgtgttaagagggtagaagaaaaagaaaaagaattagtgatgtttcagccaatttaacttaaatatttgactagagactatttatttatatatttatttattgacagtctcattctgtcgctcaggctggagtgcagctcactgcaacctctacctcttgggttcaagcgattctcctgtttcagcctcccaagcagcagggattacaggcacgcaccaccatgccacgctaatgttttttgtatttttagtagaaatggggttccaccatgttgaccaggctggtcttaaactcctgacttcaaatgatccgcccgcctcggcctcccaaagtgctgagattacaggtgttttattttatttttggagaaagaatcgagctgtgttgctcatgctggagtgcactggggcacgatcttggctcactgtagcctctgcctcccgggttcaagctattctcctgcttcagcctctcaagtaactgcggattataggcacccaccaccacacctggctaatttttatatttttagtagagatggggtttcaccattttggccaggctggtctcaaactcctgacctcacgtgatctgcccgcctcagcctcccaaagtgctgggattacagacgttagccaccgtgcctggcctcatattatatttaaaataatatctccatactgcagtatcacagttcaaagatgcttcactttttgataggctaaatagacatctccactcccattttaatgtatagtttctctatattcttttctggatacatgtaaagattgtaatataaaaaatgattagggtttaatatatcaaaccaaacaaaaaatgtcatattcccaaatgacccattctggcttcaccttgtaaactgtccatcaatggagaaccagttaaataaataaatatgatatgaccatataataaaataaccacttaaggaatgaggtaatctatgtgcaatgcaatatgaaaagatgttaaaaatgttttggtcaaaaacaagctataaagtagaatccaatttttgcaaaatagtaataatgtgagtatacgtgtagaaaaaattataaaagaattgcttcttttccgagaaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcgtttgttgctatcggggactacaatggccacgtcggtctgggtgttaagtgctccaaggaggtggccacagccatccgtggggccatcatcctggccaagctctccattgtccccgtgcgctgaggctactgggggaacaagatcggcaagccccacaccgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggatccagctgtggctacaacatagggtttttatacaagaaaaataaagtgaattaagcgtgaaaaaaaaattataaaagaatttataccagaatatatatcagtgataatccctggagcagtgctatctgatagaactttctttgatgatgggacagttctatttctagattgtccaaaagagtaacatgtgaaatgtggctagtgtgactgagaaaataaattttaaattttaatagttaacgtgcctacttgctattgtattgaacagtacagcagaaagtaagattaatcctaagggggactttggttttcaggattacttatattttataataagactgtattacatatatacatgcctacatttatgtatgtatatatgtgtattttttatctatagaggttgccttgtctcataattatgtctacttgtcttctccatactccaaatgtaacagttcattgaaagtacatatgaaaaccattaataattcaagtaatagtcttttcctctcaacttactcaagatatacatatatatatatacacacacacacacatacatacgtacatacttttttctttttttaagacaggatcttgctctgtcatccaggctggagtgcagtggtacaatctcagctcactgcaacctctgcctcccaggctcaagtgatcttcccaccacagcctcttgagtagctgggattacaggcggccaccaccacgcctggctaatttttatatatgtagtagagacagggtttcaccatattggccaggctggtctcgaactcctggcctcaagtaatccgcccgcatcagcctcccaaagtactggaattataggcgtgagctactgctcccagcctcaacttatttaaaatatttaaaactattagttttcttaaaattttcataaaaataaatacaagacattaaaagattacctctgcatcagtgccatacccctaatgtaagtaagctattttgcttctgtcacattattatcattgtggaccaataaagctatcgcagtggttctgaagtaaaagattggaattcattcactgataaagtcaggttaacaattttagagaaaaattcataatcattttcttaaatacaactaatttaaaatgaacctcttcagatacaatggtttctttatgatttttaaaaacggttaattcaaacaataaacaataatgtagtatgtacaaataatttgaccacagattcttatggaatgtcaaaatgaaaaaaaaaaaaacccacaataacgtactacaggagttttttttaaaaaagcattaaggtaaaagtacctattatatattaatgagttatccactagacataattttccagtctgcagaactccacaaaagcatattttagatattttattgatttagaaagtacagaatgacttttgttaaaaacaaaaatctctaacactgttctggcttttaaactttaacactaaactgtgcttatatggcaatcataaataaaagctgatgtaaattcagtattacaataaaggttaaagggactatatctgaaaagtagatatttgaggcatcaatatatatagtgcagcttaaggagcctgagaaagatttaggaaatattcaggcaatgagaaattttaacttcttgtgaggttttaaaaaataattaaccattactaaaaaatagaaaagcccacagaaataaaatcagatagtattattatttaattgcttattaaggttatttataattaatgctatatttggacctaaaaacatgaaaaataaccaccctaaaataaaaatatatttcttacatttataggataatcactgattagaacttaatgcttccactcacttacacatcctaatgtataggcagagacttgaaatttgaaaaacatttccatgttgattattctatagatgtgaactttttagtgcaaatgttaattttgctatagatgtgaatttttatactggctaaaagtcaaaacatgctagatagaaacttaaaaaaaaatcaatgtt

SEQ ID NO: 16433 - DNA, 96202 bp, Human
  misc_feature (1)...(96202): n = A,T,C or G
ttatacaatttaaatatatgcagcttattatatgacaactatatcttgataaagtggtttttttccccaaactatagaaaaaatacttccacatttaaatcctcttctccaaaaacagtcttcaggaatatttgaagttagccccatcacacctgaatttaatcagtgaattttgttcattcaaagattcatacatttgggaagttcctgtgccaaaaatgctaatcacccagcatcaaaatttatggaataatggtgatttaggacatgctggacatctttattgttgttttcccacttcaagattttcaatcttttggaaacaacctccccagacattctgacaagggaattattataaccaaccaaaatcaagccaaatatagtttgtcagatttaaaatgaggccaagtgccaattttacagcagcgaccggaaaatcaaattatatggcatctgacatttaaaatcacactcctaagaaggctgtcatttgatgtcttgggtttgggttacagtacttaactttataatactgggtaaccttgtgcctcagttttcccaactatgaaattgggataacagtacctattttgtgagactgttgaaggattacagttaacacaggtaaaaggcttacaagactacctggcaatgctgtcctgattttacaaattctatacactgtgtggcattagccatcaggaaaatataaataaatcagtgagataccacttcacacacttggggggctataacaaaaaagacagataaaaaatgttgtcaaagatgtgaagaaactaggacccttattcactgctggtggaaatgtaagaagtacaatcatttgaaccatagtctggcagttactccaaagaccacacctagagttgccatatgaaccagcaattccactcctatgcatatatccaggagaaaggaaaatatacgctgcacaaaaacttgtacatgaatgttcattagcaggatttttcatggtagccaaaaggtgtaaacaacccaaatgtccaacaactgatagagatggataaataaaatgtggtttatccatacaatgaaatattatttgtcaataaaaaggagtgaaggagtgaagtactgattcatgtggaacatggatgaaccttgatccaaaatagccaaatcacaggtacaaaaagcatattagtggctgctgggagatttaggcggaaatgtggaataactgctagtgggtattgagattttagagtcatactcatgttacaaaattaatagtgctgatggttgcacaactctgagtacatgaaaaatcaatgaactgatactttgagtgagctgtatgatactggaattacacctcaataaagcatggtaactgttttaagataggctggaaagagaaagcctgaaaacaacaataatgatattaataaattagtttacttctctagtctcatatacttctgtgcccacacttgctcctgttctattcataatggtccccttgcagttgccatattatatcctgccatttgatgcccggtgaacattctatacctgcttcccagaattctctttacctttcctctatctgcctaacttccacatatctaaaattaatcagagtaaactatttactagaacaaccaactccaaatcctagtaacctaacatgataaaggtttgtttctcactcatatagcccctccccagatgatcgaggggtccaggctccttacctctagtggctcccccaccttctggagtcttctgcattctttatacatggttgagataaactatgagtcattagcacagctagaccttgaggtcctacaagaaaatttgcaaatcattcactctgttttgaacaaggtatatttaagatgatgttaaaatacccaatggtcttgggtcaaatacagtttatgactgtgtatctaaaatatatattgcaatattcttccctttttctactgacttcatgaatttagcggggatccattttataagctcaaagataattacttttcagactaagaatatttagggtaaaaagtactgttcaacatctctactgaggatgttatgatgtagcacactgtataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggtgagggcccgggacggggcacgcccagcgcgtccgggagtagcggttccgttggcggcggcggccgccaaccctcagccccagccccagcgcaccgctgcgctccccggggcggccggagagggtgggcagcgggacacagcacaggggcagttgcctcccttcttcttccctcctctcctcactcttggggacacgaaggtgggcgcagaatatactatttttggggcgtgcctccctgaaagctgtttttttgtttgttttttaactttccgaatcttccagattccgaagcagaaccaaccccgatttaaaacgtgcagcgtcacactaggtccgctgtagcccagtggggcagaaagtgcgcggcgagttgggggctttatgaaatgcttctttcttagaagaaggacgtttaccaggagtgcttgtcttggagaggagttaaggcaccgttcccccgggaggggtgggacttgagaggtggccggccagaaccgaaagcagcaccatcttagggatttgaacacttcagtggctcagttttcttaagaatctcaagattaaaattaagttcacgtgggaaatgtttaaactgtggatttaaacgcctgtcactgcattgcaccgttttcttattattgcttgctattcactacaattttttttatatacaggtttaaaaaacactactttgcatactgaagtaatggaatgtaaaaaaagaatgctctgtttggaatcttatgttgtgaataggcaaaacagtgtcagtgtattggacaatactttaaaatgacaaacatatacttgcttaagtaagcaatgattacagggttgtgttttaaaaactcaaaaccaaaacattgcaaagtaccatcgaacttttaaagccaaaccatatttgttttgacccagcatacagacaggaaggacataacatttcatttgtcaaagactaaattgtttctatataaagagttttgtagaaagatttccttttaaccgactttaactttctaggacataatattatacactaattattgttcttttatattggtgctactgatgaatggctaatcatttgcaagtatggtgaatccagttacggatagtctattaccaagtttagtttgcatgtctttcaagtgtatatatacagttctgtttttaaaatctcctttcaccctgttaatactggtttaagaaacctttagtattagatagtggtgcacttaaaaataaatggagtactttgttttgcatttcaaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaaggtaggctcctttcccctgatcctttattattggtttaattgtaaatggagaccatctaatattgtatagatttcaattattccttgtttcttataagaaatggtgatatttccatataatttaaaatatatgatgacattttaacaatatgtttttatttatgatactcaaaatggaatgtggttgggtactataattgcatactctttgactaacactttcagtattagacataagtcataaaaatcttgaggacagtgctactattgttccttaactgcttagctttgaggaaacagctttgttctaatagtacttttatatatctattatgtaggtatatgtgtatgcagtactttaaaattttgattaaaagaaaaatggtagttgacacatatgtacatgtatgcgtatacatatttgtacatacacgaacatatatcacaacatgtatatgatgcagttttctacatgatactgtcttttgactacatgaatatttatgtaatatttacaaagaagtaattctaaacaaatttttgaattctctttttgttcagtatatttttgtaagtgtataagaggacaggattaaacagtttaaaataaaaaacctggacatcacagtaacataatttctaaagaagtattttgctttaagtaaaactttcatgtttttaaactcattgaacttacatgcttaatgatttcagatttacttgcatagtgtttcagattttaactttcaaagaaaatatttttgaatttctttctacctaaagtctaagcagccaaacatctttacatttgaagataaaaatacattgaaagatttcatattttaataccagcaataaatgtattctataactatgtaaaatgaagcttaggattccctctggagtgctgagatcacacctagacaaggaaccaaggatctgaatgttggctttttgtttcctgttctgaggatttttgtttgtttgtttgtttcaacagccctctccttacaagcagaaaagcaggtagtaggaaatttcactttaagggagctttcaaaggagttcttcataacaaatatttgctttgtatatttttagaacatgattttttctcacaaaagatgaatgtattttactgatgttgaacatattcagctttagggggtttgattgcattttaaactaattgaggcagtgttaaaagtggtacttgagaaaatagggcaactgatagtggctcttacccattgacattatttatttacagttacagttggaagttctttgtgtggaaaagtcagttttccaatgggtaattggagttaccatttttatctgactttggttctggtttcttaaacattgccttctgcattaatatgatttcctctcttcttaaagtctcctaaggatagtataattttataagtgaatgactcccttagaatcctcttaagcccaatttgtcctaccccagctccttcttttgaaagataagcaaatctcaaagacataaatatgagtttccaaaggtcacaaaactagttagtagctgattgttagtaaacataggttaaatatttttacattgcagcgcttgtaaatcagagatgatatgcaaaagtagatatataaactgtttgattcacagaagttatttcataaagtgcatatatagaacaaagagcaccctaactaaaatacaaatgctttctcgtcattttgttagaatagcatccaaaactgtagacgaagtctttccaaatgtactcttagaaagcatttgttggactccggctgttggcatggtcctatagtcttgagtactagaagtgaagcacctttatttagcaataattacaaagagttacttaagattgatgcagataaatcattcatgaaactagaacaagattatgaactacattagtaagttccttcattcagcaatttatgccaaagatacactttccctgacttcacttttctctgccttgagataaaatgaggataacagtggctatttcttagggttgctataaagattaaatgagctgatacttgtaaagtatgtaaaagaaggcctgacatattatcagtttccattgacatttctactttcaaggaacttgtaatatagttagggaggtaacatatgcacataaaacatctaaataaagattctcagtaaatgcccaagtaagcaattctgtaatgtatatgagatctgtgtggtttgtgagtttttgtatttggacagagcgaggtggttatgggttgaaatatgtatattcttgaatgatgaagaagtctacatggaagatatgaacatttgattagtaaaggacaaataagctttctaggcattgaggagagctttaagtgtatacagtcaaagaagagtgaagaaattaagattacactgactaagcattgaatgttcacattaggaaattgagagagttaaagtttgagaaactagattgctagtgtttgggtgaatttggagaatcggtaatttaaggcaagagaatatagagaatgttctaggagttttcaggaatgagaaagataagtagaaggacttatatcaggttcaaaatcttcaataaagcaatgctgcgtgatgagctggttcaaggtggcgctgtgtgtggatgccaatatggccagaagtttaaagtaaacaggcaacaatatggatactaatgttgccaaggatgagaatgaaaatgatggcattataaaatgctttctctgtgccagtgactatttcagtgctttgcaggtcttaacttatttagttgttataatgttggtattattattattactcccactttacaaatgaggaaactaagacctgtagatgttaagctgtcttaatacgcttaggaaatggtaaagtcaggattcaaatccaggtggtatgaatccagaatcccggcccttgaccactgtgcttcctttctcataataggaaatgcagtcaaagaaaaacaatagagggttagaagaaaagatgtgagccaagtgatgaaacatctaggaaggtaaaagtgaatcctaaaggagaatgcaagagcaggggtaatgagaagtgtgtgatataaaaggatggatcatattaacttcacatttagggcagcaataagaagacataagcaggagccaacagccagtttcttcacctccctcccatgttaggagagggaggtgataaagcctataaagtcattctggatgactgggtttccctggatatgagacagaagagagaagagataaagaaataagataccactcaggaaatgggagaaaggagttgggaaaaatgatttcttttaagctaattgaactgtttaggatatagtattggccaaaaaccagttggttggatagcccattgcattcctttaccaagacttgtaggtttggagtgaaccatgaaaggaccaggaattgacttaatgccttccaaagagaggaagtaatcatgacctgccagtcctacaaatgcagactactaacctggtatgatgaaggaaaggactatttctcaatggcttatctttgccagtacacagtaaccagcccagtgctaggaatatactaggcatccagtagataactgctacatgatccagtcatcataactgataacgccacacttttattttttggatgctttactcagtgacagcatttgttgtgaatacatttggtgtaatatcattaaacacatgttataatacaattgaaatgtattacttagaagacactaagctaagtaggtattgaaggattttcaattgtattgcaatattatgctcacttttttttttttttttttgagacggagtctcgctgttgcccatgctggagtgcagtggtgtgatctcggctcactgcaagctccgcctcccgggttcatgccattctcctgccttagcctcccgagtagctgggactacgggtgccccccaccacgcctggctaattttttgtattttttagtagagatggggtttcaccatggtctcaatctcctaacctcatgatccgcctgcctcggcctcccaaagtgctgggattacaggcgtgagccaccacacctggcctgtcctcattcttttattcatatattaattgttcatgaagtaattaccttaattacattagttcatgtatttattgagtacctgccatgcgccaggcactatgttaggtactggtgaaaccacagtaaaacgagagaccttgctggctgttgactaaagtttatagtgtggtggtggagagagacattttacctatttgtgtacacatgactaattgcacatgtggtaagtgattcgtttatgcaatgtttggacaactagagaattgacccctctgtcagataatggggaaagtttttcagacctagacatcacaataaatagactgcagaggaaactagacagaaatgaaatacttttatgaataaagtgtttctttcaaaagttgggtatacttggtgtcataggctagtaatgaaaactggtttggtagcatagttctccttgatacagcatcagaaagagaaagattgaacatccaatttttcatcagcaacttctgtgatttatttgttctatatttagagctctgtaatgctttctccatcttttgtagtgcacagatcatccagcaatctcttctactataatctatttgaatttgaataatatttgggctctgagaagatattttgccaataatcttatttatattcatttaatctccaatagagtctgctctatagcagctttcacattaccctaaaaataaatatgtagtaattcactagattttatttcaaaactctatatccaatttcttttcaagctgaggtctctcagtttactatttagcatggataatgatagactggttttaagcaccactttacattagggttcattgaaatctctactgtactgaaaaagaaatggttaaaaagatagcatttggtgtcatctgttcatatttggttatttagagctcccagatttttaatactctttcagaacatgtactttaataccactacaagagccagaggagaagcagtggtattagccatgcgtgctagtgctaataactgctcctgttctggccactgaatcattgtactttaattactcaagtaacacaaaaatccatctcctttaaaaaatgaaaatgttatcaataaggcttaagtcctcttgatcaatacctctaatctgttcccttgcctaccatctttctatacctctacctcagtttttcccatgtgtatgtgtgtgtggaatatgttctctggggtatgttaatatataaatggtattatatatcataatttatgcatcatgttattttgatacaaaaatgacttgaagctctattgttcatatatgtagttccaacttgtttttttaaccactgcttaatatttcataatatgaaaaatcattatatttaggaattactaattacactattacttgagtaaaccctttttgtacatttctcctttggtacatgtcttgcttctctttccagaatatattgaagtattttgatacagttctaaatgaactagatgattagctttctacctgctgctaagatgatttgattcactaatttattcacttcagatacatgtattgatcctacatttaaaagttgcttgtgctgggactgaagatgaaaatgtatgcagaccctgtctttgacatgcacaaaaccaagaagaagaaaacaaaacagaacaaacctgtggtacaactagtgaacatgagaataccttgatacaagttatgccagagccgtggccaacacaccgtagtattcagttagacacatggagaagaatggcagtttattctgctaacatatcttgatgttgtgcaagaggcttattcatttaatagtcacttaagtcgccttcactataacccaggcactgttttaactgcttcactggattagctcaattaatccttgtaagagtcctttgaggtggaggttctgttagtatctatattttacagatgggtgtaaagagaggtttctactattcaggaggtctgactctaacttctgtatcttaaattcctgcttctgtgctgttttcctagactgttttgtatttgagcaaatattaattactttatactttttcagataaatacatggtctcttataggagactggttttcaaattgtgctccttaactcagtcaagttccttcttctattcagaacagctctgtatttctttatttggtttatatttccacttgagatttttattgggacaaaggattctcagccaacctttttttaaaaagcactcctttataacaggaaacccttagatctcaatcaagtatttattcgagtgactcctaagaagttttttggctctatttgctggtatctttttggcatttgtgcaaagacgagatgaccatttgtgatcaagatttaaagtccaactgctcactcttctaacagcatggccacattattagccgaaaatcacatctgagttatagagcttttgcttttgtcagaaaaaaaacaaagtaactccagggaatcttttatcagtcacttctttaaaggattgattgaaataattgacacttaagacagacactcaaaaataggcacactaatcatttacacaagggatttccaacccctaggatgtggactggtaccacagccagtccatggtccggtgcgggcccatggcctgttaggaagtgggccacaaagcaggaggtgagcagtggccaagcgagaattacagactgagctccgcctccctgtcacatcagcagcagccttagattctcataagagtgagaaccctattgtgaattctgcatgcaagggatctaggttgcgcacttcttatgagaatctaatacctgatgatctgtggtagaacaatttcatccagaaaccatcccacaccatccatggaaaaattgtattccacaaaactggtccctgataccaaaaaggttgaggactgctggtttacatcttggtttttaaactccattgtcatttaagaacatcagaaagtcacatactctgtatatcttccctatctacctaatttgaggagaggccgatgaacacaatatccttcttgtggctagatggccctcatataattaactatataatgcatacttcatataatctatcatcaagacatttttttctcctctgatgagatattatgctttttaataagtgatatgtaaatagcctattgggttttcctttttattttaactcctgcaaaacaagtacattttaatgctcaattttaaaaaattaacaggttttgagctttatttttaactgctactacagcgtcttgtgttgtgtactttatatgacattttaaggaatcataacttttttcttaaagcatagtatttactagtaatcattatttctttaggaaaaaaatgcaaatacttttcatgctatttactcttctataaccaagtgatttatttatgagatagaatacacatgtagtgagtatggaccgtgagctcaaaacagtgctgtagcatttgtacgaaatataaaaattaaagggtaaaaataatggttatcatttattgagtgtttactaaattcaggtactcttctaatgtctctttgtttactaactcatttaactcttgcaacaaacctatgagacaggttctatttttctcattttacagataagatttgttcagttagtcaacagtagagcagaactccactcctggagtcaatgcccttaacttccactggatattcctttgcaggaaaagatacagtctttgatttcaaggagcctgcagtgtgtgtgtggaagtgagtgattaacagacaacactgcaaatttagtgtttgattaaattgtgtgttgcagacttagggtgctataagtgaactagagaggaaagtaccaagagttgtcattactgattgcctatatataatagaaaccatgctaaatgctttatatttaatatttctattcttcacaacaatcctaaaaagtagaatttaccatttccacttcatatgtaagcaaagactcagaagttagttaacttaccccaattaatagtagtactggcagagatgtgtctgcagtagttagaaaaggtagtttattgagctagtaagatttattcaaagcctttaaaaacagagacagtaattaagaaacgtttatttttgatagtttttttaatataataatattgtgactcctggcgtattatacacaagaaaaatttcaggtgggtcaacaacttaattttttttttatttgaagaaaagaaacctaaaagtatggaaagatgatggaggtatgtatttatagtcttgggatggaaaactttctaaatttgatataaaatccagaattcaaaaacaaatttgctccatttgctatgtaatctcaaatttcttatataaggcaaaaaattcataaagtcaaagacaacaacaaattaggaaactgtaacatatatgtaaatcaaaaggaaattattacccatatacaaaatattcttacaaatcaagaaaaagacaaacaggaagaaaaatgaacaaaaaatattaagacagttcacaaagtacagcccacagaagtatgaagaaggctcaactcactaataagcattactgattaaaataataatgggaatttcagcaatttgagtactggaataataatgaataacaaataatgaccattggagaatctgaagatagtttggtattgtcaattaaaatatgcgttactttggcccaacaattctacttctagaaactcatccttacagaactctagaatacctgtaggtggatgtttattgcagtattacattatttataatactgagaaactgaatacagcccaaatgtctgttaaaaagagattagcaaattgtggtatacccttgcaatgaaaagagtgagttagctgtctatactacagatgtcaagaagtctctaaaatatttgattttatgaaaaagcaaggaacaatatcattctgggtaaaaaattgtacccatttgatcttgctaggtatagagagctatctaaaagaaaataactaagtgcttactgtcaggatgagagacttccaatttctgatgacatgttttggtctttttttttttttttttttttttgaggtggaatctagctctgtcacccagcctggagtgcagtggtttgacctcagctcactgcaacctgtgcctccctggttcaagtgattctcctgcctcagcctcccgaatagctgggattacaggtgcccaccaccatgcccagctaatttttttatttttagtagagacagggtttcaccgtgttgaccagattggtctcgaactcctgacctcaggtgatcctcccgccttggcctcccaaagtgttgggattacaggcatgagccactgcacccagcttcattctttaagcaagtatttactgaaggggctgcaattacacaccaacttggtgcctgactttcctccacactggccccgcctagtctcagctagcctctgctgccctaatggtgtccagtgaccatatgtgccacttttcaccttcaggtaccctagaatgttgaaagagactaacaaagaatgaaacttgaagaatattgaagcaaaagcttgaggttactctgtatcatgaattaaggaatccttcctgactagatggagccaagaatggacacaggcccacaattcctcacacacaatctcaatattcaaaaagcactgcaaacaaaaattttgttgtagtcacttgtcaacaatacctaacctgacgtgaatttgtttggcagcaaaatctgatctgaaatcacatgaggaaatcttgtagtctatgtaaatattcgtacattttgctgcataaatataatgttttattaagtgttgctctattttatctttctaaaatacaaacaattttgaattttgaaacacaattggcccaatacatttcagctaagagattttggacatgtactcagaaatgatttatagactatgttgagagtggtgcctgctggctttttgcaatgtagcagccctgaaaatttttataaacaattcttatcatttattcttatcttttttttttgagagggagtccccgctctgtagcccaggctgaagtgcagtggcacaatctcagctcactgcactctgcctcctgggttcaagcgattctcctgcctcagcctcccgagtagctgggattacaggcatgtaccaccacacacactaatttttgtagttttagtagagatggggtttcaccatgttggccaggttgctcttgaactcctgacctgaagtgatcctcccaccttggcatcccaaagtgctgggattacaggcgtgagcaacagcgcccagcctattcttatcatttttaataaattcttagtaccatgctgggttctacagggagctataaaagataaataagccatattacctaacttcatatagttttcgttcaatcatggagtttatcccatattcaagtataatataggtaatatataaatcaaatgtgtttttgatttcaaggggaaaaagatcatatttagctagggagaccaaaatgtgtttttatggaaaggatagcatgctagatgggctgctgagaatgcatgaaatttttgatagcaagaattgtaatggcttttgtaaacaaaaactacagactgagcagaaggacaatttggctaaagcatggaacatggtcagaatcccttacgattatatataaattatttgtgttttttctaggataattcttttcatgaggttttgaaagagatcagtgaccccttattcccacccccaaaaaagttagcttaccactgctttaaaggaatggtgaggattattataaaacagaaggtcaagaaaatgtggaatgcacaatggggtgtttacaattaattgagtaaagagtgagaagcccctaaatattttttgggcagtgtagtggcatattttaatatttaagaaaattagtatatcagcagtatattggaaagattaatgtcagaaaggtaagggacaaggaaaacagtctggggatggtgcactaaggacctgagccagggttgtggagagaggaatgggttcaatgggtagattggaaccaattgagaagggtgatgaaagcgacacagagaattgtgggggtgggggacgtcaccttcagaaataggaagtacatgatcattttactcagtaaaggagtgatgttgaaagtagtatttaggaaggattatcctaaaagcaccatgcagaatatatttgtacagagattagatagcttgaagtcagagagaacagctaggaaactggtaacacagattctgagaagtagtttaatttcaaattgtttgtattatattctacataatgtcctcagcaggatattgaaataatataatttttgtgcacaaaataacttatgagaattgagatgttctggtttgtcacttcatttagtcgtctgcttatttattaatttataccaaaaataatgccgttttgtgcctggatttgtgttaaatattgagactcaaaaatggatgagccaagttcataacttaggagaaaggcacataaacacgttgcagaaatgcagtctggtaatatctatgagaggtgtgagctgagaattgtggaagtataggacaggaagatctaaccctggtgtttaaatgcggggtatggaaggagaaagtctgaatcctgactaagtattagactaaaaatattaaatcttaaaaattattgtaatttcaaagtttgtggcaacttttttgtaattaacagtggagaccacaatggtttatcttctttaagcagagcacttcagtgagtgtttctttgtgcaaaggcccatccagaggccactttggatgggggggcggatgaaagtatgaagaactgaacctctctatgtactattttaatagaaattagggaattgtaggctagcagctggggcaaggagtaggaaatagaaagggcctaacaactgagtaggaagcaagggctcaaggagagtagatgcctgtgagaatttccctattgcaggcaacaatccataaatccctaggctggtagtgcctgatagcaaacttggaattgtttactatctcatgttttaattacctccagctacctcccaacccttaagtaaatttttgctgtttacattttcctttataaaaggatatgcatttcagattgctgacctttcctatgatgacaagtgtctcagtagtatgatacttagaagatatataggccgggtgcaatggctcacgcctgtaatcccagcactctggaaggccgaggtgggcagatcacgaggtcaggagatcgtgaccatcctggctaacacggtgaaagaaaccccgtctctactaaaaatacaaaaaaaaaaaatagccaggcatggtggtgggtgcctgtagtcccagctactcaggaggctgaggcaggagaatggcatgaacctaggaggtggagcttacagtgagtggagatcacaccactgcactccagcctgggtgacagagcaagactctgggaaaaaaaaaaagaagatatttagcagaaggtacagttaatctgccccttcaagttaaagataatgttcatgatagaaaaaaggaggtaacttctgtttgaaagacactgttgttttgtagatagcattttgaaaacaagtctttggggatgattccactgttatttgattttgttgtgaaggtattataagagatcaaaattttatagtttcatacataaacattttgaaataagattttctaacttgctaaaaaatcttccaaaaaaattcagttaggttctgaacacatttcataatagtggcatttattgaacacatatgtcaggaacttggctaaatgtgttatattaaacacaaagattttaaatcacttgcacagataaatagtaaataaaatggtagagctgagattggaacccacagaaccttctctcttatttgttaatattacctcttattcattatctagtgtctctttgtcctaagtatttgtaatgaaaattgattgacatcagggagagtagatacttgctagctgaatttctggggtaaaagaagcttttcataactggtatgtggaattgaaagtgaatattatgactagataatctgccctgcagacagtcccctcattctccatggcttctgggatggctgtcttccaccttctcttctcagcctgccagcactcccctgtcctcactttcagctaacagccttgcttcctaattttcggaaaaaaactttctgaaattgctaccaccatctgtatggacagaagtggcctctgaactataatcccatttttctggggttaccagagctctgcagttctcaagtccagccctctctccttgaccactagatccagattactcctgctgactcaaggacaggctctaccaatcctcccgcaacatttaaatcatttttccccttctctactggataattcctgtcagcctacaacatgctcttccttttctcatcttaaaatataaacaaactacttttgttgatttcacttactcttcagccaccaatcatttttcttcttttacagcaaaactcttctaacacattttcttctcccattcactcttaaacctaacccaatcagttgttgacctctgtcactccaccaaaacttctcttgtcaaggttaccatgttactaaatcttatgggcaattgtcagtcccatgttacttgactcattggtagcatttgacaattgatcactccaccttcctgcaaatactttattcgcttggttttcaagacacgaccctctcttgattttcctcactagctccccttcaaactgttcttctcctttagcttttaatatgagagggtccagtgctgagtattctgagtatttggtcctcttcccttctgtttatatacttacttccttggttatctaatccagtctccaaactgtggataaaccacccaaaatccaatcacttccaaatttctatctccagcccagacctttcccctgaactccagactgaatatctcaaaccaacacatcccaaagttggctcctgatctacttagggttttctctggtaagccagtgttcttttggtcctcaagctatctgcctcagaatcacctgggtactggtttgagatgatttctgcacctcgccccaggtaagccaagtcaaaatatctaagaaagggacccagaaatggcatttcagctagctgtttggttgtttcttaaagttctgcttggctcagaggggagccagatacaaagctgagaggtgaaatggttggctttgtttttgagaacattaactctagaagcaatggggaatagaggcagaaggtcatgccagggagatcagacctaagattatttaaaatactctttgatcgagatctgggggccttcagtcttatgctgagaaaacactacttttcattccctaaagcagtgaacctgaaatatagaaggcaggcaggctgtggcccctaccaagaatgctcctttctctaggaagaattctaaaaaatgtgagaggctagggagggaggttggagacttccactttttgtgtccttactatataccaggcactatagtagacacattatatgtatttgttataggcataccttagagatatcgcaggttctgttctagacaactacaataaagcaaatattgcaataaagcaagtcacacaaattttttgctttctggtatctaaaaaagttatgtttacactatactgcagtctgttaagtgtgcagtagctttatgtctaaataaacaatgtacataccctgattgaaaatactttattgctaaaattgctaatgatcacatgagccttaagggagttgtaatgtttttgctggtagagggtcttgccttgatgtgaatggtcattgacttatcgaggtagtgattgctggaggttggggtgtctgtggcaatttctttaaataagacaacagtgaagtttaccatatccatagactgttcctttcacaaaagattactctgtagtatgcaatgctgtgttttacccacagtagagcttctttgaaaattggagtcacttttctcaaaacctgctgctgcactatcacctaagtttatataatatcctaaatcctaaatcttttgttgtcatttcaacaatgctcacagcgtcttcaccaggagcagattgaatctcaagaaaccgctttctttgctcatccatgagacaagacccctcatgtgttcaaattttatgagattttagcaattcagtcacatctttgaactccacttctaattccagttcttttgctattcctaccacatatgcagttacttcctccatgaagtcttgaatccctcaaagtcatctataagggtttgaatcaacttcttccaaactgctgttaatgctgatgctttgactttctccgattaaccacaaatgttcttaatgacatctaaaatgatgaacgctttctaaaagattttcaatgtactttgcccagattcatcagaggaatcacaatctatggcagctgtagcctaataaaatgagtttcttaagtcataaggcttgaaagtcagaattactcagtgatccatgggctgcagaatagatgttgtgttagcaggcatgaatacattaaccttcttgtacatttccatcagagctcatgggaatttttttttctaagcagtaggtctcaacagtgggcttaaagtagttagtggaccatgctgtaaatagatgtgctgtcactcaggctttgttgttccatttctagaacacaggcagagtagatttagcataattcttaagggccttaggaacttcagaatgataaatgaggattggctttaacttcaaatgcccagcttcattagcccctaacaagagagtcagcctttcctttgaagctttgaagccaggcattgacttctcctatctagctctgaaagttctaaatggcatctttttccaagagaagactgttttatctacattgaaaatctgttgtttagtgtagctaccttcatccatgggcttagctagatcttttggataacttgctgcagcttctacatcagcacttgctgcttcaccttgtacttttgtgttatgggaatggcttctttcctttaacctcataatccagcttctgttttcaaacttttcttttacagctttcatccctctctcacccttgatagaattgaagagaattatggccttgctctggattaggtttggctgaagggaatgttgtggctggcgtgatcctctatccagaccattaagcgtttctccatatcagctataaggctttttttgttttgtttttttgctttcttatcattcatgtgttcactggagtagcactttttaacttccttcaagaacatttcctttgcatttacaacttggctaactggtgcaagaggcctagcttttggcctgtcttggcttttgacattcctccctcacgaagcttaatctttctagcttttaatttaaggtgacacatatgcaacccttcctttcacttgaacatttagaggccattgtagggttgttaattggcctgatttcaatattgttgtgacacagggaataggaaatcatgaagaaagagacaaggacagaatgccaattggtggagcagtctgaacacacacatttatcagttaagtttattgtcttacatgggcaaggtttgtggcacccaaaaacaattacagtaataacatcaaagatctctgatcatagatcaccatagcagagatgataatgaaaaagtttgaaatattttgagaattactaaaacgtgacagagacaggaggtgaacatgtgctgttggaaaaatgatgcccatagtcttgctggatgcagggctgccacaaaccctgaatttgtaaaacatacaatatttgtgaagtacaattaagcaaagcgcaataagatacgatatgcttgtatctcccttaattttcagctaagagctgtttgagaagttactgccatctccttttttcagatataagaattaaaacaaggaaggaagttaactttcctaaagatacctagccagttagtaatggagctggtaaccaaacccagttctggcagactccaaaaattaaaccgctttcactaaagcacaccactgggcactgtgtttgaagcacgagatgatattagcaactgattgaagatttattgaaaagacttaaaactcttattgtagtcaagtcgtttaaaaatattttttacttttaaaatttattattatttagagacaggctggagtgcagtggcatgatcatagctcactgcagccttgaactcctgggctgaagtgatactcccacctcaacctccagatatttttttaatagacaaggctttgctttgttgcaggctggtctggaactcctggcctcaagcaatcctcccaaagtgctggagtttcaggcataaaccaccttgcctaggctcatttttttttttttttttttagacggagtctcattctgtctcccaggagtgtaatggcacaatctctgctcactgcaacctctgcctcccaggttcaagtgactctcctgcctcagcctccagagtagctgggattacaggtgcccaccaccaagcccacctaatttttttatttttagtagagacagggtttcactgtgttggctaggctggtctcaaactcctgaccttaagtgatctgcctgcctcagcctcccaaagtgctgggattacaggcgtgagccactgcacctggccagttcaaatcttatatattttggtgcctagacttaaataacatttaggaaaatgttaattaattatccatatagttctacctttttctttctttttttttttttttacaaagccagtttcaagtaagactggggagattctagaaagttataacagaatcttaagtcacttgatatgcctaaacagaatttgaagaaataatgaagttgaacacattgataaatttaggatttctgtaatcaggaagaaaaaactaaacttcatagatatgagggaaggaattaaccatttgcatgtatgtaactgttataatcctacatcagagtagcacaaggacatgaacaactttgttgacaaatagttttgtaattttttaatgttttttatgtagctgtcttaaactcctttctcaatagtatgtgaggtcaaatgattgtggtttctttttaaaattttgcatgtaatgtgtagttccttacattctctaaatgcttactgtttagctaactatgttattatggatgtcaattataactaagtacttcatacaatttcacgttttataagttagaagatatgtgaataattagggcatttggaagagttccagagagatttttttatttagaaagagaggagcagaacagcttcaggaaagatagatgaaaagctgattcattcaatttaagatagttgaagggaagaaaaaagaacacattatttagaatgatgacatgaagaacttaatttcctttttttacttatactttaagttctggggtacatgtgcagaacgtgcagttttgttacatagatatacacgtgccatggtggtttgctgcacccgtcaacccgtcacctacattaggtatttctcctaatgctatctctcccctagccccccatcccctgacaggcccaggtatgtaatgttcccctccctaagtccatgtgttctcattgctcaactcccacttatcagtgagacaatgcggtgtttggttttctgttcttgtgttagcttgctgatgatggtttccagcttcatccatgtccctgcgaagaacatgaactcattcttttttatggctgcatagtattccatggtgtatacgtgccacatttgcttaatccagtctgtcattgatggacatttggcttggttccaagtctttgctattgtgaatagtgcttcagtaaacatatgtgtgcctgtgtctttatagtagaatgatttataatcctctgggtttatacccagtaatgggattgctgggtcaaatggtaattctagttctagatccttgaggaattgctgcactgtcttccacaatggttgaactaatttacactcccaccaacagtgtaaaagctttcctatttctccacatcctctccagcatctgttgtttcctgactttttaatggttgccattccaactgccatgagatggtatcttattgtgattttgatttgcatttctctaatgactagtgatgatgagcattttttcatgtctgtcggctgcataaatgtctttttttgagaagtgtctgctcatatcctttgcccaatttatgaggttgttttttccttgtaaatttaagttccttctagattctggatattagtcctttgtcagatggatagattgcaaaaattttcttccattctgtaggttgcctgttccctctgatgatagtttcttttgctgtgcagaagttctttagtttaattagatcccatttgtcaattttggcttttgttgccattgcttttggtgttttagacatgaagtctctgcctacacctatctcctgaatagtgttgcctaggttttcttctaggatttttatggtttgcagtcttacatttaagtctttaatccatcttgagttaatttttgtataaggtgttaggaaggggtccagtttcagttttctgcttatggctagccagttttcccaacaccatttattaaacagggaatcctttccccattgcttgtttgagtcaagtttgtcaaagatcagatggttgtatatgtgtggtgttatttctgaggtctcttttctgtccattggtctatatatccgttttggtaccagtgccatgctgttttggttactgcagccttgtagtatagtttgaagtcaggtagtgtgatgcctccagctttgttctttttgcttaggattgtcttggctatgtgggctcttttttggttccatatgaagtttaaagtagctttttccaattctgtgaagaaagtcagtggtagcttgatggggataacattgaatgtataaattactttgggcagtatggccattttcacgacattgattcttcctacccatgagcatggaatgtttttccatttgtttgtgtcctctctgattttcttgagcagtggtttgtagttctccttgaaaaggtccctaaaacttcatttctaaaaaaaaaaaaaaaaaaggaatatgctaccaaataggattctttaaatcaattgtctcctccttcagaaaacatccagaacctgacctcttatcaccacctccactgaccactttggtttaagccactcttattccccttcggatgtattgcagtggtctcctgacagtctcatttctatccttaccttcctagattccagaggttgagagtctgccctcgacttagaagccattgtgatactgttaaaatataagtcagatcatgttagccgtctgctccagtgtctccagtggtaccatatcttttagagaaaaatcaaatttcttacagtggccttcaaggccctacagcatctgcactctgctgcactctgattgtactatctactactcttctccctggcttagccagctctagccttactcacatcctcaaacaatccctgtcatctcttagcatcttagcaatttcttctttcctctctaattcctttccccaacactccccacttctccaacccattccagcttccagcttccagcttccatgagtatcctgaaacataacaaactttggttactgccagtgtctcacttaacacattcccccactacagtgttgtcaagttgtttcatttaacaccagtaacatttaatatcagtaatagccagattctatcttaggaaaaatatgcctaaaatttatttgctgaaaaaaaaagaaaagaaaaatttggataataatctgctttgagttattacaaacacagcagtatctgagaagcaagactgagtgtcataaggaaacaaccagattaaataaaagcatagctggatgagataagaaaatactgcagtgtgatccaaaatgcagtaacagagttaaaatccatattggtcgtcataaagagcaggaaataacaccaattatgtagagttcacatttaaggagttacttcggaatgaagagaaattggtaaactggtgaaaattacacactatgatttattgtttttattatgtaccagtcattgtggtaacatttcatctaatttagctcacttaatccatataacagccttataaaatgtttatctctatattatatgtgggaaaaactaagattttgattaaacaattttatcatgctgcagaaagtgacagaactgaatttgaatgaaagtctatttgactctaaagcatatggccttatcactatgctgttggacaacagatacgatgaatagagagcacatatgcaacccataaatatccagtgattctgaagaagaaactaaaaaacaaggcagcaaaagtattaattgattatagaaaatgactcttccttatgtatcttttttacgagatcatttctacattgtgtcaccagcacctagaacaatgttggcacatagtagatattcaagaaatatttgtttattgaactgtcataattactgttaagcatttattctgtgtctgttatggtgctatagattttatatacattattttaccctcaaagcaacttttaaactgttattttatagatgaggataatgtagtgccaagaagttaaatgatctgctcaaggttatatagctaataataggtggtagaacacgtataacagaagtaagtttagcagttaaataaaaattttactttttagatcaaaaggactcactgcatcccaggtaaatgtaattttaaaaagctaaaactttgcaatattggtaattttttaaaatttttcatgagaaggaaaaacaccctatatgcatttaagtaggattaataaaactggttaactactaagacataaaaattgggttgacattagatttcctctttgagtactaaatgctgagattggcaaaaattccatcaggttgagttgctattcttgggtgaagataacatatattcttatatatgtgagaggtcaggaatatgcccagtctttaccgaagtacttgtttgtctgatggttggactaatttgggattcctgtagtgtcctgtagttcagggtgaagtttagtaacatgcgggggtaagagacaggaggtgctattctctgccctgctgctcaccagtgtgctgtatccctcctcaggatcacccttaaggtctcagatgctcacacctggtgttcagtgcccagtggtctgttctctagccagtatattctgtgtcgtcttagattccagtccaaagactatttagatctgctccatccttgggaatttccacgcactttattatttcttctagggcaggggtccccaacctagaacaagcctacgatttgtgggtcataccatactgactttcaccatttcactccttgaactattgaacatacattatcatttctcctgccattttactcacctgctgctcacctcctgctgtgaatcaggccacacagcaggaggtgagcagcaggtgagtgagcattactgcctgagctgcacctcccatcagaccagtggtggcattagattctcatagcagcgcaaaccctattgcaaactgcgcgtgccagggatctaggttgtgctccttatgagaatctaactaatgcctgataatctgaagtggaacaatttcatcctgaaatcaccgcttcccccaaccccccccacccctcactgcccccagtccgtggaaaattcgtctttcatgaaacctgtccctggtgcaaaaaagattagggactgctgttctagagaaattaaatgtttttatgtctactttgttacaaggttacatgaaataaaccagttaaatgcttagtatattggtctctaatatactcaataagattttccttctctccttcaccccacacctttttccttcacttttatcaaaaatccttggatcttcatgaagatattttaaaacctactgatttgttattgtccagctgtctttcacactctgctagatagtcactcttcattccactttacatgaccatcccctgacttactaacgtgaaaaactggtctgaacctttgtctcattctgcatgcatcttcagaatatgctggattccagaaaacatacaaaaaactttaaggaatagtacagcgaatatctgtaatcaacaatttgaaggtaagttgcagacatcatgacatttcacctcttaaggctccaaaattcatgtcctaaggacaagaacatcttccattacaaccacaatattatcaccccaaaattttaacattgataaaacaattctaatattcagctagtattaaaatttcttcagtttttcccaaaatgttttgtatagaatgtttttttattcaggatccagtcaggaattgtgtattttacttggttagcaactctgtttagttttctttaatctaaaaagatctcccacctttttttgtctttcaggacattggcatttttttgggagtctaggccagccgttttgtagaaagttccataatctggctttgtctgatttttcccccacataattatatgccagttaaacgttttgacaagaatcctacacaggccaacggttctcagacactgatctcatgacccccttatgtgcttaaaaattgctacaagcccaaagagcttctgtatacgtgaattctctctctcagtatttactgtgttagaaattaaaactcataatgttttaaaactttttattagctcatttaaaaaacagcaaacccattagatactaatttttcaaaccaaaaaatttaatgacaagaatgacattgttttacatttttataagtcattttaatgtctatcttaatagaagacagctggattctcatatctggatctacagtcaatctgttccaatatgttgttttggtggaagcatgggaaggaaatgtggcctcacacagatatgtagttggaaaatggaggagtattttaattgtcttttcagacttgacaagtggtggccatttcattaggaattgcaaaaggatgattctctatttctattatcccttctgattttatcagctataaatatttttaatagttctctctctcttccaagaggcaatctggtaatcttaaaatacacttaataatggaaagcctaacagatacttattatttacttttaattttcagttttcaaagttgttaagtttgtgccctagtaatctccagtggtttccagtgagttcctcttgtttctttcattctttctcttcttacatatcattatgtactcatgttttttaaaatatatattcaatgtgttttaattacttgaaccagttctttttgatgttcaagtggttttaattttggttggtgtgaattatcagtggtcaatgaaacacaattttattagccctcagtaaaagcaaatcatctgtcacagcaaagcatcccaggctcaacttgcacatttcctgccctagtcctggatcagtcatttccccaaggagctctggttcgttttagatgaaaattatattacatgtgaaaatctgaattcctgctggagttgtctttacttttgggcattttcagtgaagagacctagaaaatacctctttttgaaaaagtaaggggatcatgagtttataccatgatttctcaacctcacactattgacctattgggccacataattgttgcagggggggatgtcctgtgcattatgggatgttattagcctttttggcctctctgcaataatacctaccctctagttgcataaaccaaaattgtctccagatattgtgaaatgtcctggtgaggaagggagcaaaattgcctctagttgagaattactggtttatgtttgtatttctagcaaaatcaaaataattactagttgttttatctgtatgtattgtgtgtgtgtgtgtgtgtgtgtgtgtgtggattcaaaatactagtatcagcattattacctctaacaacaaaacctgctttgtagactagttcttccatctcctgcataaaatcttaggccagtcccaaagattttaatcagaagaacaatctcattccactaaccgtattagtctgttctcatgctgctgtgaagaaatacctaagactgggtaatttataaaagaaagaggtttaattgactcacagttccacatggctgggaaggcctcaggaaacttacaatcatggcccaaggggaagtaaacatgtccttctttacaaggcagcaggagagagaatgagtgccagtaggggaaatgctagactcttataaaaccatcagatctcatgagaattcactgattgatcacactgctcatgatgatcacgagaagagcatggggggaaaccacccccatgattcaattacctcccactgagttcctcccacaacatggggggattatgggattacaattcaagatgaggtttgggtggtgacacaaagccaaaccatatcagtaatcaaaatgcccagggaagcattatgccaaatttacaaatcctcttctaagtttagatttcttctttgccccaattcagcactcactgctttgagcttgaagcctaaagggaagaacaaataagatctgcttcttctctgtttatgctgcctacactcacccaatgacagctgattttgacccttccagggccaacgtgtgggaagagaagttagagagcacagttttacacaacaagtaggaattttagtgtcactggggttatctgtgtttggtgggtgattacaggctgctcttcctctagtgggatactttggtgagattcatggagatactttactgagagcctctaactgtaatcctgtaatgctgtaatgcagtagacacctctcttctctctggacatgaccgtgaccctctgcttctggacttccgctgactgaccctacacagattctgttggatcacaatactctctaggttgtcctcttagctggagccagtttttaaaagaaagaaacttttattgataaatattttcagaaaagcactcaaagatgtagagcttatcagtaggtaaatgaaacgatgttattatcacccagaccaaaaaatttaaagatcattaggttcccagaagctccattttgccccttccaatcattccccaaaagtaaccgccatcccaatttctaacatgatagattggtttgaactattttagaactttatattaatggaatcagatagtatttttctatgtctgcttattttacacaacattatacttatgtagttcatccacattttgcatggagctagacatttattctcattgctgtataataatgcattgaataaataaaaccatttgtttacacattatgctgtaggtgatcatttgggttgttttcagattgaggctattatgaacactgctgctataaatattcttgtacaaatcttttattttttgcatgtggacacacctgtccctacagataagcttttcatttgcctctccaaggaccctggcaatttcactggtcctgtaccagtctttgttccttggcccaggttcctataccatgtgatagtgaaaattcacctcccattaaaggccaatattttattttgtttatgttgtttttggcataaatgatttttgtcctcaccctgaattttggacagattcctggctgcctggcattttctgtgtagtgttttctagccctgttttcattgctaaggcagtcttttaaggttctacatttttatgcatatagttcagccctgccactctcttccattgggactgaagtaatatatcccatcctctcatgggctttaaaccccatttcttatcttttaggcatttcttatatctgtatctgaaacttttttggatcactgcagagtccagttaagtttgttcctccagctttcatttcttttttcttttctggcttatagagatttacctacctttttttccagactgaaattaagcaacatgcttctattatattttatccagtatttctgtgtttgtggtagaaagattgccctcatatggaccagctcatgttgcttcaagcccgtgacttgtgggtcataccatactgactttcactatttcattccttaaactactgaacatatattatttcctgccatttgactatgtattttccccttcttttcaaaaatgccatgaaaaattgtgaactctctcagacctaagtgaactatgttcacttgtgctcatattgagaagcaacacaaacaatataggtctcttattttacaggtaagtccctttcttgtttctaataaagatattttatttcctaataaagatattttatttcctttaaagtggaattttgtcatctaaaatttttgtaagtcactaggcaaataaaatgatctaatcacattttgatagtgcttttattttcacagagtattttttattaagagtaacacttggggctgggcacggtggctcacgcctgtaatctcagcacttcaggaggccgaggcaggaggatcacaaggtcaggagatcgagaccatcctggctaacacggtgaaaccccatctctactaaaaatacaaaaaattagccagacgtggtggtgggcgcctgtagttccagctactcgggaggctgaggcaggggaatggcatgaatccaagaggcagagcttgcagtgagctgagatggctccaccgcactccagcctgagcgacggagcgagactccgctcaaaaaaaaaaaaaaaaagagtaacacttggaaataatcttgttagacttcacatttaattatggtctattactataaaaaggtgagaaattactgaataaaaagcattctgtaagaaaaaaagttaaaaggtggtaaaaaatcagaagcaagtgactatttactatatatgacaataagtgacatatgtcttatactgttgagtataactatatttacaaatataagcgaaacaataggtataattgtatatacacctatctaaaaaatatttatcaagctgtattttacacaagagttaaaagtatcaaactgagtagttcctactcttatagaacctagtagctatagacacaaagtatacaataggaatacattgaatgtgcagttggtacacagaagaaatgtctaaagcctttatgagagcagtcaggtaagaccagatgaggggagcagttaagccaaggcttgaaagacgagtgagattttgttaagttgataaattggaaggaagggaggaaagtcatagaggcatgagagagtttgggggtaatccaaggatgttagtactctggagcataaagaacatgggaaagagtatgtgattagaaagaaaagacataacagtttgaactcaccccctgctttccccaccctaaaatagatcagttttgcaaggagaaagaagcatagtgctctattaagctccccaggtttcaacaggggcagatgatgcatatattaagggagagagctagatagtggctcctagtggggtgaactcccctatttatcattatgccatgtaacctgtttgtggtggcttatagcttataagtgttcctaaatgtcttataactcctggtggtgataatgtaggtaaacagcaaagatggcagcaaatggaatgctctgagtggtttaatatagtgacgtgttttacacttgttgtagaatcacaatgttatgttggactgaggagaagaaataatacgcaatttgagccatcaacctacggtttatgagtgagtgagtggatctagacagggatgtgtttctcaaaaccagaatataaactgtgggctgttgtctgaagaaaatggtagcaactgatgttatgttagattttcatctttttctagatttccaggaaaatgttgtgacagggctaatgcacttgtgcctgacctttcttcacctgcatatacagccaggtacctgaagtagcgagtggctcccactgcattcattgcattcttggtggctctgagtcctggccatgcattatggttcagaggcaatgcctgggccccatgccaaattcccttagtcggctctagttggaactggctggctacaacatttctttaagccaaaacattgcttgagaagataaacctttaactgtactccccatattttgtttgcatgataatgcatctactttgcagttttgatggctcatcacttaatgttaaagatgatgaaaagttagagtgaattgagcttccagatttctttaagccattccagcctgtcacaggcagtctacaatgatatgagtcgtgccaacccctcaaggtcgtgacttcatgccagtgcccttaattattaaaaattatccttccaactcaaactttaaatattggacatctaagtcattttttcttccaaacttataagaattgcattctgtttggtaactataatttccttatttatactcatgtttaaatttatacttatgtttaaatttatttggtacttatcatcagtctcttcataccagacttcctacctcatacattgtctgctataacgtatctgttgttgactggattacatcttttggaagagcatactggggtcttatttcccaatttcatgcaagtttgagaatatctttaagttgcctttaaaactgaataacttgactagatatagacttcttggaccacatctagaaaaaatctaactatatttgagatttagatgtgtgataatcataattataatagacatttgttaagtacttgctatgtgccagactattctaagctcttacatgagcttgtgtattccttagatccaatccaaggtactaatgttatcttcattttaattgccaaatgtcatctagctactaagtgatgagattgacattcacacttaaacagtaactttctatactacctctcaagataattaacctaaaatgttttaactgtgtgaccttgagcatgttatttaacttctagatgcctcagttaactctgtataaaatgagaatattaatacctccaaaggttgctttgatgatgaaatgagttaatatatgtcaatagctcataacaatgcctggcacatagtaagtgcttaataattgtctgttgttcttttattatttttatttgtggatagtaagttgcagatctgagctttgaacaagcagtctggcctctgtaactttgctcttcggtactacaatgtagtgtcagcaattaagatggcattttaatttagtgggggaaaacatggattagtcagtaaatagtgttgggatatagtagatactcaatacttgttgaatgaatgagagttttataaaagtataaatacattaacttaaatattaacaaatagatattaaataccatttagatttgtatagacagtttggaaatactttagtctgttccactgcaataaaaaaataccttagactgggtagtttataaatacagaaatattttctgatggttctaaaggctgagaagtccaagatcaaggtggcacagattccatgtctggtaaaagcttgctgtcttcttccaagatggcgccccttgctgcatcctcacatggcagaaaggataaaaaggaccaaattcactccctcaagcccttttaaaagggtactgattccatccatggaggcagagaccccacctcttaatattgtcacattggggattaagtttcaatatgaattttgaaggggacacaaacattcaaaccatagcaagaaggaagcaaaaatgagaatagatgcatgattatcaaattgtaggttattttctgttttgaatttccttacgttcttatataatttctctaataatacaattcatgatataatttgtacagataaccacttagttgtattttgtatatattgagtttgaggtacctagaaatatgactggaaggtcagagctcatattgagattttgggaccatcagaagataatgagacagactacccacaaagtgtgtgcagtggcacaccacatataaggaataagcaaagtaagaggagttgacaaagggaatttaaaaggaagtgctggaaagacaggtcaagagtcagaaaagagaggccccaaaatatgaatcaatgggacaggtggggaaagaaattacctgaagcaaatgattcaggtcaggaaagcattcacagcatttaggaatgaaaaaatatttgatgatgttaagccattttataagaatagtgaatatacaagtcaaattaccacataggaataaaggaagttaggtagaaacagcaaatgtagatgatgttttcgacaactttgaggaccaaaaaaaggggaatgtattcagggagaatctagagtgagctagggttcctttttttggtgctggaacttttttggatggaaaaataatgagagagcaggacatcactggactggagagactaaagactttaggagagaaaggaggaaattgatggagcaagacttgaaagcagataggaaggaattgtttgaaggacaaaagcaaaaaccattggtaaggaggactctttgagacactgaataaggagatgatatcgtaggccattttagaaatgtaagtgagacagatcagcagcatgccagcttctggtgtttagatcagacctttttcctgcgtatttatgaccaaggagcagacagtaggacagcctctcttcaaacaattacatctgcgtgctctatttctcgaagtctgttttctgtatagagaaaaccttggtgggcgtggtggctcatgcctgtaatcccagcactttgggaggccaaggcgggcagatcacctgaggttgggagttcgagaccagcctgaccaacatgcagaaaccctgtctctactaaaaatacaaaattacccaggcgtggtggtgcatgcctgtaattccagctactcagaggctgaggcaggaaagttccttgaacccaggaggtggacgttgtggtgagccgagactgtgcctttgctttccaggctgggcaacaagagcgaaactccgtctgaaagaaaaagaatagaaaatcttgctattttctgttctctcttcttgtgagatatcagtatagggtagaaatagatgatcaactgatagactgacttacacacaccttgctctcacagtcactcctatagcctaaatatataacttgtggtaaaaaaaaaaaaaattagagtcaaatcagaaagtagtatgcagtacactctgctaacctcctgtaggactggcactatgtgcacaaaagtcagcaaagatatgaggcttcacagttaccctttattaggtgaaggcttaattcctgggactctaaacaagagatgaacactatgtgagtgtacatgaacataagtttatagaggcatgcatctttaagaaaatatttgtgcttttccagaaatgcatgaggtcaggaaccttcttgatatcagctgtcacatatataggccttttggcatttttgccctttgccgtttaggctaatcctttcccctgcttgattaagtacatgttttaggtacctctgagttcctttactaccaactttggccagaagactctgattttaatcttaactaatgtaaaatactacaggaaaatcccatgatcttttaaaattatgtgtcatgcttcagaagtataagtaggctgaagtaggctgatgatattaaaagactcacagtctgttttaaagaaatttattgggaaaaaaagagagtgtcaaaaatagtaaattaacgtttacatgtttaagctgaatttttttatttttgttaaatctaaataaattagattgttccgtgccttattaacatatttgtggtttaaaaatcattattgaatattaaattcatgtgccagacctttttaaaggcatccatagtttcctctacacaaagtgaccccagggtgatgtgcgatgtgtattgtctatacttctataaagtttctcctctttattgagtacttctatctgttttaagttcttcctttatcattatttctgttcaaggtattttctaatgtgtagtcaaaataaggcaggtattaaattcagtacaataagtgatcttttttacatgctcttccattgattccttaaagagagaaccagctctgggatttttccaatagaactaagcatttagatttttttttaaaaggtcttttccagaggcctcttcaattctttagtctgtatctgttttcttgaaggcatcaatgtcagaaagaaaggttttactagagtttgaccacctggtacaactaatgcttatcagaaacgtgtagctaatcttgaaatgacatctaaaggcaatctgatactgacaccattaagaagataaacagaaatctcttgcaaaagatttttaaaggagccctaggattgattcttcagctatgctcacctaatttaggctcctaaaggcacaggtaaagtactgagcagttttatagcttcaccaacattcagctgtgccaggcaggaagctggctgagtcatgcacttgctgatgtgtatctagtctctatttcagttgtcactgcatagaatttccagtgaatcttagatattgtaaataattttgactcattttgtttttttagggcagcacaactacttatgtgctggaagaaatgactgcatcgttgataaaatccgcagaaaaaactgcccagcatgtcgccttagaaagtgctgtcaggctggcatggtccttggaggtaattctgatgttttcatcaataatatactgtgtaatctttatactataaaactgtgtgtcagaaaattgcaatttcttattcatctttgtttttgttttttctgtcttgattattggcagtgactctgcacatgtgagtgtctgaatgaagcaaccaataccattccattaactttacagttttctagcacattgaggtctgttaagagaagaaaactcaattcatctatattgcctataagtagaggtaatgggcaatgtactgacctgtcattaagtaacatgtgtgggagtctaggctttgctgcccatctcctgtgtgaccacagctcttcctgggcatcagtctacttatctgtaaaacgagagcattaacattcctttcagctcaaaaaattgactctgcaaattggtcaggtacattgcttactagcttctccaagtgattgattaaagcaagattactgtaactggggtaggaatccatttgatgaagagttatattaataattcccttttcccatatttttattagaatctctaaaactttcagtaatatagcacacatttaaaaaattaatgtcagatagtgacagatagtttgaatgaaaacatagcagagtgagggagatcaagcgagccacagttatgcaagacacccgtactcccttgaattttttcacttagccacatcctgcacaacactgtctgggaatcgtagcttttacatctagatataactttttaaaaacataataaaaatattacataattgttaaagctaaaaatgttttttcagtgcactaactataaacagcttgtgttccatggacgttgtgtgtattttcctttgggaaatgctatatttagaccaatgcttgtcaagtttaaagcgtatacaactgtcacctcatttgtttttgcaaatgtgctggaccaaaattaatcacccaggtaacatactgggcactttacagtaattcatgtaattagatcacttatagaattttataatttcttgattaaagatttgttttcctaagttaagggcagtgattaggttgacagtagtgcctggcttaaggaggtgctcagtaactttctattaaatgaataaaaccacaacctcagcagattaaaattgtttttgagtcccacacctcaattaccacctctttgtatttctgtttcaactcagaagtcttaaggaacctcctaaattttagaaaatacaactttttcacaaaatcacacatctagtcaatgtcggagccagaagaaagacctgaaggtattctgaccctggcgcagccattgttttctccttggcatgcttgccttagaaagtagcagagcatctaatgctgacacttagattccattaagatctttaatcttgagtgttttcccaatgactttaaaagactcttcaattttatcaaagaatgaaaatggcggagttctggatagaaccttcagaatactcctggggatcagcaatataacctagagaaatttatgttatcttttaatattctagggctttatttatttatttttgagacagagtctcactctgtcgcccaggctggagtgcaatggtgcaatcttggctcactgcaacctctgcctcccaggttccagcgattctcctgccacaacctcccaagtagctggtatcataggcacccgccattacgcccagctaatttttgtattttagtagagatggggtttcaccatgttggccaggctggttttgaactcctgacctcaggtgatctgcccacctcggccttctaaagtgctgggattacaggcgtgagccactgcacccggcctttagcatattattcaagcatctgtaatcctttatcttctctaaccaaactgcttgttactttagcctgttattcctatgcttcccaagccatattctacgggcttcacagctattgctgcattttcataccttttatattacttatttgtttaactctactccctccatctctccctcctttccgtccctccctccctcccttccttcttctttccttcctccctcttctccctcaatcgctttctaatttgcaccccatccctttctttcagtaactgtatatcgagccctttctagttaccagatactattctaagttctgcgcatatagcagcaaagaaaatggacaaaattcctgccctcatagatcttacactgtgggaggacgagcaacaaatgtacatgtcaaataatgataagtgctgtggaaagatattaagcagagttagtggggattatcaggaagcagactcactactaaactcattagtctaatatttttgttttgcttagcctcttcctaagcaataatatctctgaaataatggatttgatatgccagttataatttttctaaaagacattaatatacattcttaactatttaaatatatattcgatgtaccacctaaaaactgcttgtataccataaatgattatgtgttaaactctgggaaagagtgtattagaccatttttttccagctatcgcagctctatttattttttcagcttttattttagcttcagtgggtacatgtgcaggtttgttacctgggtatattgtgtgacactaatgtttgaggtacaaatgatcccatcacctaggtactgaggtactgagcatagtactcaatagtttttcaaccctttcttcttcttccttcctcctctagtagtcctcagtttccattgttatgctcatgaatacccaatgtctagctcccacttataagtgagaacatgcagtatttggttttttgttcctgtgttaatttgcttagggtcttggcctacagctacatccatgctgctgcaaaggatgtgacttcgttcttttcatggctgcataatattccatggtgtatatatgccacattttctttgtccaatccactattaatgggtgcctcagttaattccatgtctttgcttttgtgagtagtgctgtgatgaacatgtgagtgcatgtgtctttctagtagaacaatttattttcttttggctatatatccagtaatgggattgctggtctaatggtagttctgttttaagttctttgagggccgggagcggtggctcatgcctgtaatcccagcactttgggaggccaacgcaggtggatcatgagttcaggagatggagaccatcctggctaacacagtgaaaccccgtctctactaaaaacacaaaaaaattagccaggcatggtggcaggcgcctgtagtcccacctacttgggaggctgaggcaggagaatggcatgaacctgggaggcggagcttgcagtgagctgagttcgcgccactgcactccagcctgggcgacagagcgagactgtctcaaaagaaaaaaaaatgtcttttgagaagtgttcaaaccaatttctaccgtggcagaactaatttacattcccaccaacagtatataagtattcccttttttccacagcctcaccagcatctattaggttttgagttttttgagttttcttttttgagacagagtctcactctgtcacccagactggagtgctgtggcacaattatggctcactgcagcctcaatctcctgggctcaagtgatcttcctacctcagcatcctgagtagctgagactacaggcacgcaccaccacacctggcaaactttttatttattttttttttgtaacgataaggtctcactttgttacccagtcaggtctcaaacttctgggctcaagtgatcctcccaaagtgctggaattacaggtgtgagccaccatgcctggcatgagtttttaataatagtcattctgattggtgtaagatggtatgtcattgtcgctttgatttgcatatcttaatgattagtgatatggagcattttaaatgtttgttggctgcttgtatgtctccttttgagaaatgtctgttcaagtcttttgcccatttttttggtgagattttttttttttgcttgttcaactgtttaagttccttatagattctggatattagacatttgttggaggcatagtttgtgaacatgttctcctattctgttggttgtctgttaactccattggtagtttattttgctgtgcagaaactctttagttgaattaggtctcacttgttaatttttgtttttgtttcaattgcttttgagaacttagttagaaattatttcccaaggctgatatccagaatcatatttcctagattttcttttaggattcctatggtttgaggtgttatatttaaatctttaatctaccttgaggtaatttttgtatatggtgaaatgtaggggtccaatttcattattctgcatgtgactaggtaggtatcccagcaccatttattgaataaggaatcctttctgcattgcttatttttgtcaacattgtcaaagatcagatggctgtaggtgtgcacctttatttctgggttctatattctgttccattggtctatgtgtctgctctcgtgccagtatcatgctgttttggttactgtagccttacagtatagtttggaattgggtaatgtgatgcctctgacttttctttttgtttaggactgctgtagttatttgggctcttttgattttatataaattttagaatagctttttctagttctggaaaaaatgtcgttggtagtttgataggaataacattgaatctgtaaattgctttggacagtatggccattttaacaatactgattcttctaatccatgaacatggaatgtttttacatgtgttagtgtcatctgtgatttcttttagcaatgttatgtagttatccatgtagaaatctttcatctgcttagttatatgtatacctaggtattttgtgtgtgtgtgtggctattttaaatgggattactttcttgatttggctctcaccttgaatgctatagttgtatagaaatggtactaatttttacatgttcattttgtgtcctgaaactttactgaagtcatttatcagttttaggagccttttggtggagtctttagggttttctagttataaaatcatgtaatatgcaagagagatagtttgacttctttttttcatgtttgaatgccttttatttccttctcttgcctgactgctctggctagcacttccagtgttaacaggagtggtgagagtgagcatccttaactttttccagatctcaaggaaaattcttccagcttttgcccattcagtctgatattggttgtgagtttgtcattttggtctcttattgtttttaggtatatttctttgttgcctagtttcttgagggtttttatcatgaagtggtattgcattttatcgaaagctgtttctgtgtctattgagatgatcatatggttttatttttaattcttctcatgtggtaaatcatatttattgatttgcatatattgagctaaccttccataccaggagtgaagccaacttgatcgtggtaaattaactttgatgtttgatttggtttgctagtgttttgttgagaatttttgtgtctgtgtttatcagagatattgtcctatagttttcctttctcatggtatctcttacaggttttggtatcagggtgatactggcttcagaaaacgagttagggaggagtctttccttctcgattttttgaaatagtttcagtagaattggtaccagctctactttgtgcatctggtagaatttagctgtgaatctctctggccagggctttctttttggttggtaagttttttattactaattccatttggaacccaatattggtctgttcagtgctttagttttttcctgatttaaacttgggacattgtgtgttttcaggaatttattcatttcctctagatattgtagtttgtgtgtgtagaggtgttcacaatagttatctaaggatctttcatatttctgtgggatcagttgtgatgtcacctttgtcatttctgtttgtgtttatttggatcttctctctttttttctttgttaatgtagctagcagtctatcaatcttatttatcctttaaaaaaataacttttggttttgttgattctttgtatagatttttgggtctcaatttcatttggttctgctctttagttcgtccttttcttctgctagctttagggatagtttgttcttgtttttttttttttttttttttttttannnnnnnnnnnnnnnnnnnnaattgttttttttttttgtttttttttttttttttttttttagttcctctaggtgtgatgttaggtcattaatttgagatctttctaactttttgaggtaggcatttagagctgtaaactctcctcttaatattgtttttgctacattccagagattttggtatgttgtgtctgttttcatttattttaattttttttatttctgccttgattttattgtttactcaaagttatccagagcaaactttttaatttccatgtaattgtgtggtttgtacagatcttcttgatgttggtttctctttgtattccactgtgacctgacagtatgactggcatgattttgactttttaaaatgtactgagtcttggtttatggccaaggatgtggtgaatcttggagtatatgttctgtgtacagatgagaagaatttacgttctgtggttgatgggtggattattctgtagatgtttattagatccaattggacaagcattgagtttaagtccagaatttctttgttagtcttctgccttgatgatctaatgctatcagtcccccactattgttgtgtggctttctaggtccttagaagtccttgttttatgaatctgggtgtgccagtgttgagggcgtatgtatttaggatagttaaatcttcttattgaactctttatcgttatgcccttatttttccttttttactgttgttaaagtctgttttatctaatctaagaatagcaacccctgctcttttttgttttctgtttgcatgctacatctttctccaaccctttactttgagcctatggttgtcattacatgtgagatgggtttcttgaatacagaagatggatgagtctggttttcctagctggtttgccactctgtgacttttttttttttttagatggagtcttactctgatgcccaggctggagtgcagtggcgcaatctcagctcactgcaacctccacctcccaggttcaagcaattctcctgtctcagcctccggagtagctgggattatatgcacctgccaccacggctggctaatttttgtatttttagtagagatggggttttaccttgttggtcaggctggtcttgaactcctggtctcaggtgatccacccgcctcagcctcccaaagttctgggattacaggtgtgagccactgtgcctggacccactctgtgacttttaaatgggacattgtattagtccattcttgtgctgctataaagtactacctgagactgggtaatttatgaagaaatgacatttaaatgactcatagttctacaagcttaacaggaagcatagctaggcaacgtcaggaaacttacaatcaaggcagaaggtgaaggggaagcaagaatatcttaccatggcagagtaggagaggtgggtcaggggagtgccacacacttttaaatcattatatcttgggagaacccactcactatcatgacaacagcatgggggaaatttgcctccatgatccaataacctcctaccaggttcctccctcaacattgggaattacaattcaacgtgagatttggatggggatacagagccaaaccatatcattctgcccctggcccctcccaaagcttatgtccttctcagttttcaaaacacaatcatgccttcccaacagtcccccaaagtcttaactcattccagcattaacccaaaagtccaagaccaaagtctcgtctgagacaaggcaagtcccttccacctatgatcttgtaatatcaaaaacaagttagttacttccaagatacaataggggtatgggcattgggtaaatactcccattttaaatgggagtaactggccaaaacaaaggagatacaggccccaagcaagttcaaaacccagcagggcagtcattaaatattaaagctccaaaataatctcttttgtctccatgcctcacatccagagcatactgatgcaagggatgggctcccaaggccttcagcagctccaccctgtggctctacaggatacagcccccacagctgcttttacaggctggcattgaatgcctgcaggtattccaggcacacaatgcaagctgttgatggatctacgattctgaggtctggttgatggtggtcctcttctcacagctccactaggcagtgccccagtgggaactctgtgcaggggctccaaccccacatttccctttcacactgtcctagtagaggttctccatgaggtctctgcgcttgaagcagacttctgcctggacatccaggcatttccatacatcctctgaaatctaggtggaggtttccaaacctcaactcttgccttcttcatacccgcaggcccaataccatgtggaagccaccagggctttgggtttgcatcctctgaagccctggcccaagctgtaccttggccccttttagcaacagctggagctggagcagctggaatgcagggcaccatgtcccaaggctgcacagagtagctaggccctgggcctggccctcaaaaccattaatccctcttaggcttctgtgcctgtgatgggaggggctgctgtgaaggtctctgaaatgccctggagacattttccccattgtcttgactgttaacatttgactcctctttactaatgcaaatttctgcagcaggcttgaattgctccccaggaaatgtttttttgtctctctcttttctaccacatggccaggctacaaatattccaatatattttttgctttgcttcacttttaaatgtaagttccaggttcagataatctcttttttcatgcatatgagcatacatgtttagaaacagccaggtcacatacatctggaatgctttgttgcttagaaattttttccaccagataccccaaatcatctctctcaagttcaaagcttcacagatctctaggacaggggcaaaatgccaccagtctttttgctaaagcatagcaagagtgacctttactccagttcccaataagttcctcactccatctgagaccacctaagcctagactcattgtccatgtcactatcagcattttggtcacaaccattcaacaagtctccaggaagttccaaacattcccatatctttctgtcttctgagccctgcaaactgttccaacctctgcccattactcagttccaaagtcactcccacattttcaggtatcttcttaactgtgctccactctcccagtaccaattttctgtattagctcattctcatactgttataaagaactacctgagactgggtaatttatgaagaaaagaactttaactgactcacagttctgcaggcttaacaggaagcatagctaggaggtctcaggaaacttacaatcatggtggaaggcaaatgggaagcaagcacgtcttaccagggcagagcagcagagagagagagagagagtgagaggggaagtgccaccacttttaaaccatcatatctcctgagagctcactcattatcacaacaacagtatgggggaaatgtgcccccatgatccaatcacctcccatcaggtccctccccaaacattaagaattaaaattcaacgtgagatttgggtgaggacacagaaccaaaccatatcaggcatttagaccatttacgttcaaggttaatttttatatgtgaggttttgatcccttgtttagttgttagctgtttgctttgttgtttctattgtgtttttgctttgtagggtgtgcaggctatgtgcttaagtgtgtttatgtggaagcaggtatggttcttttgcttccatgtttagaactcccatgtaaggatctcttgtaaggatggtctagtggtaacaaattcctttagcacttgattgcctggaaaagattttatttgtcctgcacttatgaagcatagtttggcaggatgtgaaattcttggttgaaatttcttttaagaacgctgaaaacaggcccccaatctctcctagcttgcaaacctctgctgagaaatctgttattatcctgatagagttccctttttatgtgatctgcacttttctctggctgcctttaagattttttctgtaatattgcctttgaacattctggtgactatataccttggtgatttttttttttttgagatggagccttactgtgtcacacaggctggagtgcagtggtgagatcttggctcactgcaacctccgccctccaagttccatggattctcctgcctcaacctcccgagtagctgggattacaggtgcctgccaccgtgtctggctaattttttgtatttttagtagagtcagggtttcaccgtcttggccaggctggtcttgaactcctcacctcatgatccacctgcctcagcctcccaaagtgctgggattacagacatgagtcaccacgcccagccagtgatgttcatgtttgtggtgtctcacagatgttctctggatttctagctctctagcaagattaggaaagttttcttgaattattccctcaactatattttccagtttgttttctttttctcctactttctgaggaatgccaataattcatagggtttttttgctttatataatcttatatttctcaaaaacagctcatttaaaataatttttttctttatttttatcagattgggttagttcacaagaccagccttcaagctttaaaattttttcttctgcttgatccagtctattgataacgaatttcaaaatataattgaaggctttaagtgagtttttcaattccagaagctactattgattttttttaagatgttcatgtctttcttaatttcctagattgctttagaagtttgtgttggttttcaaccttgtctttgattacaatgaacttccttgcaatccatgctttgaattatttatgtgtcatttctgagtttccatcttggttagggaccattgctggaaagctagtgcaatcccttagtgatgtcactgcaatcagatttttcattatgccagaattcttgcactggtttcttctcatctggagacattggcacttcaaatttttgtacttattttcatgtgggtagtagtttttcttttttttttctttccctataatggtattattattattattttaataattttttttgtttcccttttaccccttttctagggcttgtgcctctaaagaatgctgggtaggatcttttcactttgattctacagccctatgtgcttctttcagcaggttttatactgggctctgcaggtcatcccacaggcccataggcggcacgtataggtaagagctggctgtgaccaatgtggctggatatatacttgatccttgtttccgagcaaaagctctccattgtcttaggcaataggctgattctgattcatagaatgcacagtagttggaactccctgctcagccccaaggagaagggaaccacaaagggcaagtttggaccgagcaggtccacctgcgtcccctgatggcaagcacaagcaccagtgccaaggaagaatccagtgggtggccaccaagcacccagagttgtacacagacctgaagcttggaaacctcctcagctgcaaattctctgcatgggaggcatcctaagctcctgattcaggagagtgggtgctccagatgcctggagatctgctttggcatggaatagagaggggccccctgcaccaagatctctacacaggaggggtaaatgacaattatatatagtgctgcaggaaacatgtgaatgcagataatatcttcaatataccagttttctttcttttggctatatgcccaacagtaggattgctgcatcacgtggtagttctgtttttagttttaggaacctccatactgttttccatagttacagtactaatttagattactaccaacagtgtacgagaatttctctttctccatatcctcaccagcatttattttttgtctttttagtaacagccattttaactggagtgagataatatcttattgtggttttatttgcatttccctgatgattagtgatgttgagcattttttcatatatctgttggcatttgtatgtcttctttcaagaaatttctgttcattttgcctatttttaaatgggattactttttttttttgctattgagctgagttccttatatattctgataattaactccttgtcagatgaatagttttcaaatattttctctcattctttgtctcttcacattgttaactatttcctttgctgtgcggaagctttttagcttgatgaaattccatttgtcaatttttgccttgattgcctatgccttgaggtcttactacaaaaatatttacccaaaagtcttaaagcagttccccaaagttttcttgtagtagttttgtagtttcagatcttacacttaagtctttaatcgattttgattttattttcgtatgtggtgagtgatagtgatctagttctgttttctgcatataggtagccagttttcccagcagcatttattgaagagattgccctttccccaatgtatatccatggcacctttgtcaaaaatgagttgactgttaatgcatggctttatttctgggttctctattctgttccattggtctttgtgtctgtttttataccaatatcatgctgttatggttaagaattctcatttctgacatagagaccatttaaataacaaaagataaaacatgagagaatattagaaagcttttaaaagatttaataaaatcttacagtagaataatagaggtaataaatatgttttgacatgtcatgacatagattttgttaggagcagtttgttcttatctgcttccgtggctatgttttgattataaaaattatgttttgagttatttgatttcttcgttgcatatgattcttgtctttaatgaatcacttccctaccttgaacaggtcacagtgaacttttgctttagttcactgctgtacagcactgagtgggaagatagttacacccttaaggatgataatatatcttctactttaggtgttctgcttccatcttctttcttctagaaaacatttttgtttaatgactcacaaaaaaatatctgaaatgaatacagctttatattttgcagttgtaaaaatgctaaactagtataaggtaattagctctttcaaaaataagtcgctttctacataaaagaatgattaaatgaatagttatcttctttgaaattttttaaatccacagttacaggttttatgggtttttctttttttctattattttcttttttggtagcaagccttatcttcacattttaaaaggttgtgttagaaagccagtttctctccttctccccctacctcctcctccacctagattcaaccacttcttatggcaaagagaataactttctgggctagagagtatgggttgtgtagtaaagatttttgttgtttttttgttttctcctcctacacttgacagccaacaaggctacaagtcttctttggaagaactgcaaaattcttgaatttaggacacagtggtatcttttctagaagtacagagtcctgctctgtgcctttaataccctaagaacaaaaatcatttttcctctttaaggcaagatctactgtgggtgatggctaccacctacctctctagacctcacagaatcttcttcttaatgggcatctctttttccacccaaatcctggcctttgaatcagcatctctcagagacagcacctctcacattgctccccaagttcactgcattggagcctgcagccaactgatgtccttctcatcagtctggttgtttaccctaaacaccatctcacacatgctagctggggatggtcctcagactattcattctcatttctttgcttaaaatttttctgtgtttgtatgggatgtcttttatggtttgccaactagaacttttcagtagtatctacaagcatttattattttctagactcagtaaaaagttagaattgaggggttcaaatatctcctccattgtagttgactttatttgaatgattaagacatatacatttaaaaaaatcaattctagtatagttttggtttttggaaaatacctgatttcactttatatttcctgttgtctagcatctttgttttctttgaagtatatacaaaggcacactgtgttttgatctggaaattggaggtgaatcctgaaaaatggaaggcaagcactatcagtgctataaaggattgttaaagtgtagtgccagtggactgatcccagcactgcgcagtggtcattatcattttggtaatctgaagtagaagcatgcctctagacatccttccataattttatataggtagtgtaaggatgactgtctataaattcacctgaactacagagagacttctgatataataaaagaaaaatacagagattgttcaggatgggaatacaaacactaggaaactggaaaagcaaattaaaacttctgaattaatagaaaaagttaaataggaaagagaaaataaagggaaacttgaccaaggtagcaaagaaagaaaatggaaaagaggtaattatgaggcagtataaaacaaactctgtcgcaaaaaaaaaaaaaaaaaaaaaaaaaattccatttgtagttttaaaaaaatagtaaagatatagaaaaattagtagaaaatacaaaaatctgtattcttcttttatcagaattaaataattatgcctgccctattttaccaaattattttattaaaacatgctaaagaagtttataagcttttcttctccctgctcccattctctataggatttttgctgagatatttcaaaatttttatttttaggttatatttaagctttcacttctaatctctctcaaaaacctttcatatcacttgtcataaaaatttcttctcatagtatcatcatccagattcagtcacatatacatcaagaataattgtgcaatactgtttcctagactcttcatcttatcttttcaatgcatgatatttaaataagccatactttttaatgttttcaattttttaatttatatttatttatttcaaattttttattatattttaagttctgggatacacgtgcagaacgtgaaggtttgttacataggtatacacgtgccatgatgttttgctgcacccatcaacccatcatctacattaggtatttcttctaatgttatccctcccttagccccccaccccccgacagatccctgtgtgtgacattcccctccctgtgtccatgtgttctcattgttcacctcccacttatgagagaacatgcagtgtttggttttctgttcttgtgttagtttgctctgaatgatggtttccagcttcatccatgtccctgcaaaggacatgaactcatcccttttgatagctcaatgttattgcatggtgtatatgtgccacattttctttatccagtctatcattgatgggcatttgggttggctccaaatctttactattgtgaatagtgctgcagtaaacatacgtgtgcatgtgtctttatggtacaatgatttataatcctttgggtacatacccagtaacgggattgctgggtcaaatggtatttctggttctagatccttgaggaatcaccacactgtcttctacaatggttgaactaatttacactgccaccaacagcgtaaaagctttcctatttctccacatcttttccggcatctattgtttcctgagtttttaatggtcatcattctaactggcatgaaatggcatctcattgtggtattgatttgcatttcgaccagtgatgatgagcttttttttcatgtttattgcccacataaatgtcttcttttgagaagtgtctgttcatatcctttgcccactttttgatggggttgttttttgtttttttttttgtaaatttgtttaaattctttgtagcttcttgatagtagtcctttgttagatggataaattgcagaaattttctcccattctgtaggttgcctgttcactctgatgatagtttcttttgctgtgcagaaggtctttagtttaattagatcccatttgtcaattttgtcttttgttgccattgcttttggtgttttagtcatgaagtctttgcccatgcctatgtcctgaatgatattgcccaggttttcctctagggtttttatggttttcagtcttacatttaagtctttgatctatcttgagttaatttttgtataaggtgtaaggaaggggtccactttcaattttctgtatatggctagccagtttccccaacaccatttattaaatagggaatcctttccccattgcttttttggtcagatttgtcaaagatcagatggtagatgtgtggcattatttctgaggcctctgttctgcttcattggtctatatatctgttttggtaccagtaccatgctgttttggctactgtagccttgtagtatagtttgaagtcagctagcctgatgcctccagctttgttctttttgcttaggattgtcttggttatatgggctcttttttggttccataggaaatttaaagtagttttttctaattctatgaagaaagtcaatgttagcttgttggggatagcattgaatctataaattactttggtcagtatggccattttcatgatattgattcttctgatccatgagcatagagtgtttttccatttgtgtcctctctgatttccttgagcgttgatttgtagttctccttgaaggggtccttcacatttctcgtgacttgtattcctagctattttactccttttgtagcaattgtgaatgggagttcagtcatgtttgggctctctgtttgtctattattggtgtataggaatgcctgtgatttttgcacatttattttgtatcctgagacttcactgaagttgcttatcagcttaaggagattttgggctgagatgatggagttttctaaatatacaatcatgtcctctacaaaaagacacagtttgacttcctctcttcctatttgaatacgctttatttctttctcttgcctgattgccctggccagaacttccactactatgtttaatagcagtggtgggaaaggacatccctgtcttgtgctggttttcaaagggaatgctttcagcttttgcctattcattatgatattcgctgtgggtttgccataaatagctcttattattttgagatacggtccatcaatacctagcttattgagagtttttagcatgaaggggtgttgaattttgttaaaggccttttctgcatctattgagataatcatgtggtttttgtcattggttctgtttatgtgatggattacgtttattaatgtgcgtatgttgatccaggctttcatctcagggatgaaactgacctgatcatggtggataagctttttgatgtgctgctggatttggattgccagtattttattgaggatttttgcatcaatattcatcagggatattggcctgaaattttcttttttgttgtttctctgccgggttttggtgtcaggatgataccaaataaaatgagttagggaggattccctctttttctattgtttggaatagttttagaaagaatggtgccagctcctccttgtatctctggtagaattcagctatgaatctgtctggtcctggggtttttttggttggtaggctattaattactgcctcaatttcagaacttgttattggtctattcaggaattcaacttcttcctggtttcatcttgggaagggtgtatgtgtccaggaatgtatgcatttcttctagattttctagtttattttcatagaggtgtttatagtattctctgatggtagtttgtatttctgtgggatcactggtgatatcccctttatcattttttattgtgtctacttgattcttctctcccttctttattagtctggctagtggtctatctactttgttaatcttttcaaaaaaccagctcctggattcattgattttttttttttaagggtttttcatgtctctatctccttcggttctgctctggtcttagttatttcttgtcctctgctagcttttgaatttgtttgctcttgcttcgctagttcttttaattgtgatattagcgtgtcaattttagatcattcccactttctcctgtggacatttagtgctataaatttccctctaaacaaacactgctttagctgtgtcccagagattctggtatgttgtgtctttgttctcattggtttcaaataacttatttatttctgccttaatttcattatttatgcagtaatcattcaggagcaggttgttcagtttccatgtagttgtgcagttttgagtgagtttcttaatcctgagttctaatttgattgcactgtggtctgagaaactgtttgttattatttccattctttcacatttgctgaggagtgttttacttccaattatgtggtcaattttagaataagtgcaatgtggtgctgagaagaaggtatattctgttgatttggggtagagagttctgtagatgtctcttaggtccacttggtccagagcctgagttcaagtcctggatatccttattaattttctgtcttgttgatctgtctaatattgacagtagggtgttaaaagtctcccccattaatgtgtgggtgtctaagtctcttcataggcctctaagaacttgctttatgaatctgaatgctcctgtattgagtacgtatttttaggatagtcagctcttcttgttgcattgatccctttaccattatgtaatggccttctttgtcttttgatctttgttggtttaaagtctgttttatcagagactaggattgcaacccctgccttttttagctttccatttgcttggtaaatattcctccatccctttattttgagcatattgtgtctctgcctgtgagatgggtctcctgaatatagcacaccaatgggtcttgactctttatccagtttgctggtctgtgtcttttaattggggcatttagcccatttacatttaagggtaatagtattatgtgtgaatttgatcctgtcattatgatgctagctggttattttgcccattagttgatgcagtttcttcctagcatcgatggtctttacaatttggcatgtttttgcagtggctggtaccggttgttcctttccatgtttagtgcttccttcaggagctcttgtaaggcaggcctcgtggtgacaaaatctctcagcttttgcttgtctgtaaaggagtttatttctcctttgcttatgaagcttagtttggctggatatgaaattctgggttgaaaattcttttctttagaaatgttgaatattggcctccactctcttctggcatgtagggtttcagcagagagatctgctgttagtctgatgggcttccctttgtgggtaacccgactttctctttggctgcccttaacgttttttccttcatttcaatcttggtgaatctgacagttatgtgtcttggggttgctcttctcgaggagtatctttgtggtgttctctgtatttcctgaatttgaatgttggcctgtcttgctaggttggggaagttctcctggatactatcccgaagagtgttttccaacttggttccattctccccgtcactttcaggtacaccaatcaaacgtaagtttggtcttttcacatagtcccatatttcttggaggctttgtttgttccttttcattctttattctctaatcttgtattcatgctttatttcattcagttgatcttcaatctctgatatcctttcttctgcttgataaatttggctgctgatatttgtgtatgcttcacacagttcttgtgctgtgtttttcagctccatcaggtcatttatgttcttctctaaaatggttattctaggtagcaattcctctaaccttttttcaaggttcttagcttccttgcattgggttagaacatgctccattaactcagaggagtttgtcattacccgcctcctgaagcctacttctgtcaatttgtcaaactcattctccgtccagttttattcccttgctggtgaggagttgtgatcttttggaggagaagaggcattctgatttttggaattttcagcctttttgcactggtttttcctcatcttcatggatttatctacctttggtctttgatgttggtgaccttcagatggggtttttgtgtggacatcctttttgttgatgttgatgctattcctttctgtttgttagttttccttctaacagtcaggcccctctgctgcaggtctgctggagtttgctggaggtccactccagaccctgtttgcctgggtatcactagcggactctgcagtacagcaaagattgctgcctgttccttcctctggaatcttcatcccagcagggcacccaccagattgccagccagagctctcctgtgtgaggtgtctgtcgacccctgctgggaggtatctcccagtcaggaggcacaggggtcagggacccacttgaggaggcagtttgtcctttagcagagcttgagcactgcgctgggagatccgctggtctcttcagagccagcaggcaggaacgtttaagtctgctgaagctgcgcccacagccaccccttcccccaggttctctgtcccagggagatgggagttttatgtataagcccctgactggggctgctgcctttctttcagagatgccctgcccagagaggagtctagagaggcagtctggctacagcagctttgccatgctgcagtgggctctgcccagtttgaagttccaggtggttttgcttacactgtgaggggaaaactgcctactcaagcctcagtaatggtggacgcccctcccaccaccatgctccagcgtcccaggtcgacttcacactgctgtgctggcagcgagaatttcaagccagtgaatctcaacttactgggctctgtggggatggtatctgctgagctagatcacttggctccctggcttcagccccccttccaggggagtgaatggttctgtctcactggcattccaggtgccactggggtatgaaaaaaaactcctgcagctagttcattgtctgcccaaatggctgcccagttttgtgcttgaaacccagggccctggtgatttaggcacccaagggaatctcctggtctgtgggttgcaaagaccatggggaaagcatagtatctgggccggaacacattgttccttacagcacagtcactcacggcttcccttggctaagggagggagtttccccactctttgtacttcccgggtaaggcaatgccccaccctgcttcagctcgctctccatgggctgtagctactgtctagccagtcccaatgagatgaggtgggtacctcagttgaaaatgcagaaatcacccaccttctgtgttgatcgcgttgggagctacagaccggagctattcctattcagccatcttgccagccagcaaccactctactttttttttttttaatttaagttctgggatacatgtacagaatatgcaggtttgttacatagatatacatgtgccatggtggtttgctgcacccaacaatccatcatctacattagatgtttctactagtgctatccctcccctagctccccacccctcaacaggccctggtgtgtgatgttcctctccctgtgtccatgtgttctcattgttcacctcccacttatgagagaatatgcagtgtttggttttctgttcttgtgttaatttactaagaatggtttccagcttcatccatgtccctgcaaaagacatgaactcatcccttttgatggctgcatagtattccatggtgtatatgtgccacattttctttatccagtctctcactgatgaggatttgggttggctccaagtctttgctattgtgaatactgctgcagtaaacatacatgtgcatgtgtcttatggtacaatgatttataatcctttgggtatatacccagtaatgggattactgggtcaaatggcatttctggttctagatctttgaggaatcatcacactgtcttctacagtggttgaactaatttacactcccaccaacagtgtaaaagctttcctatttctccacatcctctccagcatctgttgtttcctgactttttaatgatcgccattctaactggtgtgagatggtatctcattgtggttttgatttgcatttctctcatgaccagtgaagatgagcttttttccatgttttttggccacataaatgtcttcttttgagaagtgtctattcatacccttcacccactttttgatgttttttttttcttgtaaatttgtttaagttccctgtagactctggatattagccctttgtcagatggataaattgcagagattttctcccattctataggttgcctgttcactccgatgatagtttcttttgctgtgcagaaggtctttagtttaattagatcccatttgtcaattttgtcttttgttgccattgcttttggtgttttagtcatgaagtctttgcccatgcctatgtcctgaatggtattgcctaggttttcttccaaggtttttatggttttaggtcttatgtttaagtctttagtccatcttgagttaatttttgtattaggtgtagggaaggggtccactttcagttttctgcatatggctagccagtttccccaacaccatttattaaatagggaatcctttccccattgttttttttggtcaggtttgtcaaagatcagatggttgtagatttgtgacgttacttctgaggcctctgttctgttctattgttctatatatctgtttgggtaccagtaccatgctgttttagttactgtagagttgaagtatagtttgaagtcaggtagcatgatacctccagctttgttcttttgacttaggatgtcttggctatacaggctcttttttggttccatatgaaatttaaagtaatttttttctaattttgtgaagaaagtcaatgttagcttgatggagctattattggatctataaattactttggtcactatggccattttcaaaatatacattcttcctatctatgaatatggaatgtttttccatttgtttgtgccctgatttccttgagcagtgttttgtagttctccttgaagaggcccttcacatcccttgtaagttgtattcctgggcatttaattctctttgtagcaattgtgaatgggagttcactcatgatttggctctctgtttgtctattattggtgtataggaatgactgtgatttttgcacattgattttgtatcctaagaataagccatactttttaatatattttattcataaaaaaatgcacataaagcaaatgacatatagaaacaatatgattaacatccacctctggactcagttggcttaagaaaatatgaatattatcactacacttgaaattgattgcatatttcttccttatcacattcctctttatctttctccagaaacctctatatctttaatttggagttggtcattttcttatattattctgtaggattttttaatatctatgtatttctcactaatagattttttagttttgagatgtttttttctactccatagaaatgctatgtatatttatgcaatttgatcttactgcctaatattatatttgtgttttttattttgatttgtattattctggtttgttttttcctacactgtatgatttcattgtatgagtatctcccatttatttattctcatgtattgacatgtacttccacttgatatttgctgtgctttacctacagttcaattgtgaacattattttacatgtattctggtggttcatgtgtgagagtttctgtaggtaacctgcacacctgggcatgaaatttctgactgtaatacatgctcatgctgggctttactagataatgctagattgtttttaaagtagtagtagtttacactccatggcagctcttcattgttttgtgtgttcctgtattctgtgtccttgccgttttaggtagatgatgtctcatgtggtcttactttgcatttctctggttaataatgaggtcagtcatattgttgtattttgtcatctatatatttcttcctctgtgaaatatctgttcatgccttttctttctgatttataggaattctttgtgtattttgggtatatatgttataaatatctataggatagataaaaacaagctatctgataaggcgatatgcagaaatataaattaggtgaggaagcaagccatgcaaatatccaaggaaaaaatcatttcatgcagaggaacttgtcagtgtaagaccccaaggcagaaacacacttcaagggcaagatgggcatcaatatgggtggagcatgagggagaatagaagagagaccatctatgcaagggtaagttgggccttgtagagcttgatatgaattttaacttcattctaagtaggatcaggagtcactgaaaatatcaagcaagaatgacatagtctgattaagtctttaaagttgtatagaaaatagtctacaaaaagtgaaagctgggaaaccagccagcatatgttacaatagtccaactgtgattgtggggacataaattatggtgcaagcagtggaaacaggtatttggatttgggttatattttcatggttatccactaggatttgctgatgtattagatatgaggtgagaaaataagtgaggtatcagtaatgactctagagtttggggctagagcagcaggtgtgtaaatgaagttacaaacctagaagatgcatgtttggaccaatgcatcaaagttctgctctaaacatattaatttgaggggtctgttagaaatacaagtggagatgctgagaatacagttgcatagttgagtctagagtttcttggaaaagctgggtctaggactgtaaatttggtaatcattaatgtctagatgatattagagacatagaactagatgcagacacctagaaagagcatagatatctaagagaagtctgaggactgagcttggtgtactcaaagatttagaagttgagaagatgaaaaagagctagacagagagactgaaagagtgactacaagaatgaaatatgtggaagccaaatgaataagagcgttaaaagaagaaggaaacgatcaatgtgttaagtacttacccgggttaagaccaggactgagaattggccattgttttttgacatttagaaatctttgaaggccttgccaagaataatttggttgggataaggagaggaatgacctgactggagaaggttcaagggagaattggaggagaggaaatgaagagagtgatatttctccacggaatacattatgtgtgagagggactattagaggatgcagacaagagggcaaatgatttcagagaaaagtccctgagtgggtgagaaggactaagatttggtattgaaatgtcaggagtatgaattgtaacaggagggaaggcagagtacaggggtagccatactgtagattggccacaaagaaaatattctccaaatggagcttctttccccctaagcctcccccaaatcattacctctgcttctgattcaatccctcaaaacctcatccatcagcttgaatgagagacaactattcagccaccatgtccatccgctttcttatccccccttgctcacccccagcgtctcagcccaaatcttccctccttccagccaacaaagctcccatgcctgtcatctcctgatgtcaatgcagcgggcaggggagtgggggaccactgaccccacatgcctattctctgcttagattacccaaaataccaggtgtcgttatttttcagaggtgcaaaaatataatacaaagtcattctaaactgtcactgaattcagagtactttttgccattgtctagtcactgaattcagagtactttttgccattgtcttattttctcaatcaacaaatgctaaggagtacaattatatgaagttctacagatttatttgttacttgcattacttagtaatggttcttatgcataaaggttaggaataacttctttgaacaaatatcctatataaaaaaacaacaaagtggtttttaaaaatcacattgctgttcacattccctttttagtactctcttctcatattcttttttaagctatgttaggtcaaaacaactactttaataacttagcaaatatctatcaggagtccactgtgtagttagcagtttataaagcttcagatctacattagtgagtgaaatggacctagcccctatccttacagggcagcaagcctggtggaggaagctatgttctctgaaggcaacaaaaacagtcatgcgtcatttaagagtagggatacattttgagaaatgtgtcatgaagtagtcaatttcatcattgaacatcatagaatgcatttacgcagacttagatggtatagcctactacacacctaggctgtttggtgtagcccattgctcctgggctacaaaccgatacagcatgttactctgttgaattttgtaggcaactgtaatgcaatggtaagtatttgtgtacctaaacatatctaaagatagagacagtacagtaaaaaatactatcttatgaaaacactgttgtatatgtggtctgtcattgactgaaacaatattatgtagtgcaaaccatacagcaacagataataaagacaagatattcagagtgggagatggaaaagacaataatgtattccttcattcatttagcagacatgtattgccaaaagacactggaaaaaataaataaaggtgacaaacaggtggtgcctttgttgaagattatagtcatggacagggaaactttagccctcttcttaacattatcttcccttagacacaaacacacacacacacaattcctggcatatgctatatactccataactgttccttcccttccctttgtgactcattccttcccccagaaagctcatttgatctctgcaaataattttgaatcccctttgttttttaaccatggcaattgttttgttttcccatctcctacaagttttagctcaactcgttggggctgttttttttttttttttttttttttttttttttttttgaggtggagtttctcccttgtcacctgggctggagtgcaatggcatgatcttgactcactgcaacctctgcctcctgggttcaagtgattttcctgcctcagcctctggagtaactgggattacaggtgcccaccaccacacccagctaatttttgtatttttagtagagacggggtttcaccatgttggccaggctggtctcgaacttctgacctcaggtaatctgcccacctcggcctctcaaagtgctagaactacaggcatgagctcaccatgcctggccattccttggggctttatagaacaagtataatcctttttctttatgacaataccctgagttcagaaatctcagagacaaatgtttacagagaccaggtaaataagtagctagagtgacaagacttaagaaaagagaccattggcgtaccaccagtttgtggagggaactggaaaaactggaatacacatgccccatccaaaagcaaccattgcaactaaactttaacagattgttgccacctaagtaattcacggatggtctcataattctggtcagcattgtctgagccaaacaaaatgtatctatgggcatgatcagatactagagccagcagattgcaacctctgcttagataattgcaggtatcagccttcccttggctaaacagctacttcatactgataagtagcccttgcctggcacaaagcaggtggggctgaatccagcctgatatcacatcaccacaactttctctaattctcctcaaggcgtctgtgaactaccagcagcccaaataagcatccttttctccttcaatcatttctcataaagcagattctactcatctcaccatccatctttttcccctaacatatcagaattcatcaaagtagaaactccagaaatcatccagaaatacaaatgtgatctgaccagcacgggtataaactttctctttccttaatttagaaaaaggattattaattttgagtcttagatctcataaaagtagagctggattgattttaagggatcaatgaacctactgaaattgtataaaaagattttgtggggctggcaaacaaatgcttttcttttaacatattcttaaaagaacaaaacctcaaagaagatttaacaaccactatagactaagtttcaattaatgtagtctgtagcattagattttggaaggctgttctatcagaatatggaccaatactgagcgtagtcgctactaaaactctttgtctttttattcatatcttctcctaaaaagctccatgacccctgcagaatactggtataattacccacacctcacccacccagtgattgttgatgtaactaattatttaatccaagtctgaggcctaaattttttttaatcaagagttagttacatgttttaatttattttttgtaattttaatatctaacacttttattctatttcattcgattgatgctaaaatgcataatgctatgattctaagacttaggaaaaataatactatactgggatatggagtttatatatatttacatgaatttcttttttttcttctctgtaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggtaataataatttttatatacagcatgtaataaaaaatatactatgtttgttgtattagtacattgttaaataaaacactctatgcagtaaattaactacaatataaaacagtatgtgatagtatgtgtttgagcagttcaaaatatttgtctaggaccctaatatgtgttacagaaatataaaaaattagagaacacactgagtcttactgatgagtcagaaattgcatacattaaacttatgctaataagaaatagcttaggtttatgtgttcaaccacagatattagagtagctcagaaatgataaatggaccattttttataaatgccctatttattctaacccttaattcaaccaacctcatttggttgaaaataaaactgaatgtataaagtcatataacaaatcaaagtagtattcagagtacagtaaggtgtcaaaagtaaattaagaaaacaaaattccctaacgtaaattactttaaaaaataatagcacacagagaaaagaatctctagtcactattcctctaatttatacccaaagagagtatatcgcccagcaacagagagaacttggattatatcatcacagaagaatttcagtcactttacttatcagctatttttgctccctcagcacagctctgtaggagccaagtacttgaaagaataacaaggatgaaattctcacttggttaaatcttagactgcagagccaggagaatacatgtatagcaattgtttgtgaaggcattactcctataattagaaatagaactttttaaaaaactacattctcttcacatcagtaatacccttatactgctatagacaaattatttttctaatatctgatcaagaattaaacatattatgtccttttagtccccaagtaaattcaatggcacttttagaaaaagaatttcttcccaattctccttaatataattctcagttattattctacctaaaaggtttgaaatacaatagatgaattgttactgaaaattcaattacatgaaacagaaagaaaaatagatacctgtttgttgaatctttcaaaaaatacatattaagaaaagttaatagaattcagtattctagtggagatgaagtaattttatagaaaaatcaaaatgcccagattcttattggcttcagtctcaccaaaaggccttaaacagacaataattttttgaacattctaaatgtttaagatttatcacatagtggttatcaaacttgacagagctttaataaataaaaataacccaatagcattgatgaactttttctgtttaaaaatgagtgtttaaacatgtgtttaatttttctccattgttctattatttggaaaatatgatttctttggtttttgttgatatagtttatattccttttgtttgcaattttggaggttctttactatttaaaaagattctagcatcagctggtaacgttagaaaataaccagttatacttgaaaagatgacttattcactttggataaaagctaagtgacctttttaaccggaaaccgttatctatcaggactttttgacccccacacaaccacaaaaaggaatgagagaaaactcttacattgaatttggtggcaacttttttaatgctgcaaaatgtaatttttgtgtagtaaatcagaataatggcaacactagtattacccatactgtttccattaattgcaaacagggaaacattgagattatcaaagtctcttgtggcctgtggacttttaaagccatattttcatggtctgcattttgggaatagcactattgaatgaattatgaaaatggtcagtgagctagagtgactatttgacctctgagaaaggacttggatggacacatgtatagaaagtactttagtattattagctacttaaaactgatttcaattgacttgaaataagcttacagtttttattcacttattcactcaataaatgtctattatgtacctgctgtgttcaatatctaataattatacagtggtttagaaagaaaagccacaaggctgggctcatggtgtggatgcattttggtacagcacatgctagcatctggtcatcagttttgcatgtaaaagaaatttatttcgttcattcactcatgtgtaataaaactaataagtctgtggaagacagacttttgttaagtgatcctcactaattagccagaatgtcaactaacttgcttatttacagtgagacacacacacacacacgcacacacacacaatataaatatacataatacttatgttgctaggagaatatattaacagatcagatcattctttcacaataggaaactgtatttggaaagtcacattaagatctgatgcagaatgaccatcataacaaaggtgacagcgtttatgaagacacctaggcatatatttgcaggtgccctaagaattcttattgcctggtagggctttctcatttcttctttgtctacactcttccattatcttggatctgttataataatggtagtttatatttcttcaaaaatatttcagatatatccttttgtttcttttcttttttttctttttttttttttttttttgagagagggtctcactctattgcccaggctggaccacagtggcatgatcttggctcattgcagcctggacctcttggtctcaagttatcctaccacctcagcctcctgatgagctggtagctgggactacaggcatgcgccaccttgcttggctaaattttttttatttttagttgaaattgggtttaactgttttacccaggctggtcttgaactcctggactcaagtgatctgcctgcctcagcctcccaaagtgctggaattacaaacatgactcaccgcaccccaccccttttactttaatagagacttgcaagatgctctagccttatgtcagcacgtttataaaccatctcttaggatacattgcaaatgagtgattttgcatgggcttttatctgtagccttagtgggcaatattttcttatttgaaatgtagagcaacacgatatttgaatttttttaatgaacaagacatattccctctattaaggaactctcaatccagtagcagagagaagatacccaaacaactatagtgttatgtgaaagtgatataagatacagatataatgaaagtggggacagaagaacatttttggcttcaaggactaaagaagccttcagagacaaaaatgtcagttaaactgcatcttacaggagaaacaagactttgataaatcatgataagagaaagcattctagatagaaggaacagtatggctgaaataagaaaagcatgagataggtttgctgaataatgcattaaaccagcatattaatggttctcaaccttttcaagtgtggggggtcccttagtaacatcaaaaattttatagtctccccatagggtagtaattaaagcttttagtagctatggattgagaaaacacatttgtacatacagtccctcggacactgctacagtaagtactggccttcgggagatttaatcacccaaatggtaagaaaccattgaaaagaaatttattttgaactgaataatggaaagtaaacttagaggtgtaagttataggctgatcaaggagggtcttaaaaattactgtagatgttagagtttaaattaaaagtactaattcacaattcggtgtcacctttaaattgtcctcatcctgtacatcaatacgttgcagtgaaattgatgtgacagagggggtatgagggaaacacttccgttgcataaattttgtcttgatatttcagttaacttagtgaaaactccatttaggtcaatgctttgaatttttaaaccttgcattttttaggacatactttattctttgtgtcatttcaccagactacttgcaattatcagtatcagaatattagaacagtattttgcctcatttttctgcttttgaagcgtgccaaaacaacttttgagtcagtgagtcattgcatcttgacagaggattttttctcttccttcccgaatcagaagactaaattaaattattgctctccagaaaaaaatgatgagagagaaatgagagtagcatactgagagtaaaggccttaataaatgtgttgataaagactaaaccatggtttttctcacaccctattccactgaaattatgattgccagtggcaacaaaaatttttacttgtcaaattagatgaatatttccagcccttaatgtgtttcacctacctctgggactattggcaaagtaactatttcttgctaagactcttgcttaggtatttgtcacttcccttccaggtagatatgtttctctccctatgtacatttcccgactcctgtgtggatttgttcttccacccacactataaatttgtttgtgttctgggttctatcttttccagtcatttctcactctacacagtctgcataagctcattcatagtcttgtcttcaactaccactatatttcgatgactcctaaatacataatattagccagaccctctacaaaactactgaactttcaactgcttattacacagctccacccagatgacttctaagttagcatgaccccctaaacctaaggccttttccagtatcttgaaatggcacctcagcaagaatttttggtatcatccttggctcagtttctccttcaccccttacccaataaattgtcaaattctatcaactccacttattaaatatatgattcattatacatgctacttctgttgctacttccctgacttagtttggtgctggtctttttttacttggattcatgttgcagcctcctgactgattctattaccatcaatttcacgtggcgcccaaatgatcctctattctacccccagaatcatttttctaaaacaattttaatcaatcatattttccatttctttttccaaatagcatccaaactccatggcctcaatatccaagggctttctgtgatctggctcctgaatttgcagtgttaatctctcatcattcctcttcacacgactctaagatctagttccctaaatgctgtttgctcaaattctagccttcttctcttgcccatattatttttcctacctggcagcccatctcttttcccacgtcttcctttgactgacctgtaactatctttcaggattcgcattacttgtcacttgctctgggaagatttctctgagccttcctagactgggtgaggaaaccctgtaccctcccttgtctcctttgtgcttgtcaaccataacactatgactctgagttacaattgtgttctacttttctatctgtctcacaagcctatagtgttaaaggcagaaacagcatctttctaaccttgatcctaattgcaagtataatgcttcctcccaaatagatggttaaagaatatttatagaaatttaaattacagaattgatttgcaaagaactgtactaccttagattattagacattaacttcttattcagcataaatcatcaaacatacgttggtgattatacttaatcatattgaagcttctttgtgcttctcaacattgatacttgtgtatgaaagttgttgctttgtgtcagaaggtgctgagatatttaatgctctgccattgttgtagattatctgtttcaattacatgacattttttacagaaccaaaacctacatattttatcaaaactctgggagtaagattggggaacttagtagtactgtcatacaggccatcttttttttttttttttttcttgagataggctctcactctgtcacccaggctggagtgcagtggcatgattgtagctcacggcagcttagaactcctgggctcaagccatcgtcctgcttcagcctccccagtaacttcagcctccccagcactacaggtgtgcaccaccacacctggacaagctttttaaattggtttgtagagactgggtcttggctggtctcaaattcctggcctcaagtgactctcctgcctcgcctcccaaagcactgggactacgggcatgagccaccacacccagccccaggccatctcttcactatatactttctgttaattctttaagctaaatttggacagctgtaacagggcttttgtcagaaattatcaggtcaagtcacttaaaaggaaaagtgtttttttttttaacatttgttaaacacaattagtgataatccatcacttctccatgtgaaggtttttcattttggtcatctcaaatgtactaagtttacctgatcattatcatcactgggaatttaatctctgtgttcccatctttgtttcagcataaagtaatgaatgatattacagttaataaggaaaaaaatagcatttctatactaggcatgttcaagtcaatttaacattgtacatttatcacagataagcactgtaaaaggtggagtaaataaaggttattttctgagttctattccattctgtcaaacaaacagaaatatagtttctgctataaatattggtaattttataaatttaaagttattgtaataagatttgcctttaatgttgtcataaaataaaagtaagcctggatttctagtcccagaatgcaaaaacaaagaaaaaagcaaaaagacgaaaacaaaaactaagagtaggataaagtgaatgtaaacatgtaaatgtagacaggatctgtttttggataaagaacaatttaattcttacataattttgtaaaatgtttaaatgtttaaaactactcaaaggttaacataaaacaaatgcctgaagtgaaaaattacagcatagttaagtcaaatatttaaatattataaaatactttttttagaaagtcataaagttcaccaagaaagatatagagaataataaatgtatttgtggagattattgtgaacacttggttaatgttttaatacatctgattaatgaaaacgaactttctatgagcctttttttttttttttttttttttttttttgagatggagtctcgctgtgtcaccaggctggagtgcagtggcacgttcttggctcactgcaacctcagcctcctgggttcaaaccattctcctgcctcatcctcccaagtagctgatgagactacaggcatacaccaccacacctagctaatttttgtatttttagtagagacagggttttaccatgctggccaagatggtctcaatctcttgaccttgtgatccacccacctcggcctcccaaagtgctgggattacaggcgtgagccactgcgcccagcccatttttttgtattatatgaaatatataatttgttatatataacaacacacataaaatatatattctggaaaatatatattccagaacaaacacataatttatctttaaaattttttcaccattattttttatacttcagttctatcttatatgttctataatatataaaatgcctcctaacacttttttttatggcattgtgttttagtattagagacttcccattaaactgactggtggatttcatactagtattactccaatgagcaattctgttgcattgatagaccaataataaatatctccatagtgttctacagtgtgcataattatcccatttgtctcatagcaactcactgagttagttatcattgtgaattgtgatttttacttatgaagaaatttagattcaatgataataagtgatgtttccaaagtggctgttagtaagtggtagagccaggactggaacttgggtcttctgtcctgaatgccttccaatttgttgagacagatcagcaatagggaggtttatatgtgcctccctttagaaaggcttccttttcaaaaattaagacaattcattgatctcttgtcaaatgattctaaattttatcacaaaattacccatttttatagtctcttaaatatttgacttacaagcagcatttatgtattagatttattgtattgagctttataattttcttaaaaagttattatgtagacctatacttgaagacacgttcaagtcatatgcaaattaaaaaatgataaaacttgcataccaaaaatttttttggctgcttagttagagagtctttctgcacctgagtaaaccaggattcttggatgccagtattaaaaataaactatgttaattataaaacacacaagcaacaacaaaaaaccctgacttttaaaaacaaaagaaaaagaaaaaaaataatttactgagaggacaacaggggttcactgaatagaagctagaggacaagcttagaatatgggcagaagccaaggcacatctgaagggctaaaaagcaagcatcacaaatcctcccattggttctcattatctggacaccaccaacatcaagaataaatagtcatatctttctctttgctttagtattttctgattcaaattcctgttagtatatgttccatgggccaaacctatgccccaagcccaaagaaggaggaggtttacccagctttctccgtgggaaagtaggaaggtaaggcatttgctctcgcaaaaactacaaccaatggggaactctgcccacacagagaaaggaaggaggggaggaaggaaggagggaaggaaagaaggaaagcaggaaggtattagggagcagtgagggaggaggaggaaaaagaggaaaggaagaaagagagggaaggaagaaaggagggagggaggaagggagtgagagaagaaaggagggagaaggggaagaaagaaaggagggaaaaggggagcgaagaaaggagtaagaaggcgagggaagaaaggaggagaaggggagggaagaaaggcagaaggggagggaagaaagggagaaggggagggaagaaagggagaaggggagggaagaaaggagggagaaggggagggaggaaaggtgggaaggagaaaaggttagacattgaagagcatcccttctcagtaaaaggtaaatgctcactatggcatctctaattatgaatatgcatttgagtttttggtcttattgaggctaaggagttctaagaagagagtagcaatttttctactattcacatgaagatgggacgatctgaagtgtatgaagagaagagccttcttttttgctacctaccttgacatgattaacattgtcaggaaataactttcttttgctcttgatagctaatgaattaagttttgctttggttttacttttgaaacagattatttgtaagaacatcagtggatttttagagaaaatagatgtttttaaaacagctttatagaaagtggttgatgttctcagcaaaacattgtctccatacctttaattttaaaaattctccattttcatcatttcagttatactcagatacaaataactttcaaatttatattaatatttttagcccatatatctccccatacttctaattcatatgtgcagctgataccaggatgttgacccctgaatcctatccaaaactattttctccctagcaagtttcttctcctttattttatctcagcaatgctgttatcatcatctacccttcaagacaaatactgaaagatgtatttgattccttcttcttcccatctaccggcaatcagttgacaaatgtcttttatttttccctttaaatatttttctgatgcactctctcctcttaattccaatgtgttgacttgacttacttcaggcttttatcatctctcacctgggctttgacagtatctcccaactgtcctccctaactccagacttattcccttgaatccacctaccacatagctaagaatgatccatctacaatgcaaggctatgtcactcccattgctccttaatagacttgcaagaccttggatgatctgacccagcctacatctctaaacacatctttgcttctcccacctttaagttactcattgttgaactggtgatcttcccttgagaattgggaagacatggagagacttgtgatgattaagtcaagattcatttgccctttccctgccatccttctgccaccaacaccatggaacagcctaaaagaggatgaaagaccaaagcattcacaccataccccccaatacacacacacacacacacacacacacacacacacacacacagattctaaatctcttaagccacacggaagtttaaaacaagactggattaagtttcagagaacgaaagtgacctgatgactgtggaatctacccgacatagttaagggttgttaaaagaaaattagatataacacaactgaaagcagtggttttacaaagtaagaccagtttatgtttaaatcccaaagaactgagatttaacgaactgattatattccattcaggcattatctctctttttttctagaaagtttttcctgacctccctcccgattgactgatacactcccttttaaccttctctaccccagcactcatgtgcttgtttctcctgttgagttgtgagctgcttttgaggctaggattgactcttactcatcttcatttttatacagtgcctggcacccaaatggttcttattaaatgggtgttgcatgaatgagtgatggatgatggattcacttagcaaaatcccagaaatgctaaatcacagtgactaatttcaagtgacttccaaagttgctgatattttaggctgtattatttattaatgttttctgattttcagtgtaaaatatgttgggattgaaaacattttattaccctacgcatacctattttcagatttatatgtattttcaacatttttgagataattcagtcatttttatggtcactgtatttttaaatttgttttgtaggttttcgaaacttacatattgatgaccagataactctcattcagtattcttggatgagcttaatggtgtttggtctaggatggagatcctacaaacacgtcagtgggcagatgctgtattttgcacctgatctaatactaaatgagtaagtagtaacttttgttgtttttgttattttaagtgtacatgtaggataattttgaaagttatatttcaatagatgatcacatatttagtgttcttgatatgatgacattactgtcattttacggtaattttatatttggagctttttcctcttgtttcaaaatatagttatatcaaatccaattttcttacacatcaagaatgtatcaagaaatatatttaaagataaacttaaatgtttcattaatcaatttaaaatttcatagcttggtactaatgacaataataaatgagaaatatttttgttactgacttacattcaaaaagtaaaaacatctttcttcatacatgacaaattagactgctaatttatttaaaaaattgaaagataaatatttcaatttgctttatatttaaataattttaattaattttctacctacaacctttaactgaataagaatcttttcatggtaatatttatattgttctagtggtaaatgctgacttagaagtatataactcacacttatataagtctttacagtttttagataattttcatgtttcattacattttatccaacaattccttgagataagtaaggaatcagcattcttcattgtacagtttagaaaactgagtctcaggagaattatataatctgccaaataatttgaatgacagtgagattccttatctctttttagccaaaatctagttttcattattcttgttagcttcatttgactaatgtggacattataaaacaacacaaggttgggaaaatgccttaattaaattttctcagccttcagcacttgtgtttaactttgtcaattaattaatgcttgccaatgtcctcttttactcttttctgtatcattgtatatttccctagaaaagtttaaaatatggtaagctttgtgaactgacttctcctatttaattgcacacaaaattatataatttttcatagaaaataaattgtaagtaaataaaacatttctgagcattcttcagcttcacattctcaactcctacacctctgctgtgttttcttggtttaggtatttaaagtgtgataataaaagtgagaaacaatgttaatcttggtcactgtgtatttaatataattttctagttttaagatttcttaacctcaaaaattcagtattgtgaaaagtttagaagatgtttaaaattccaaatattgggtttgtttattaaaagtagtagtcattttcaataatatgtaaggtaattaccaaaaccatattccctgataaattacctaaactggctgagacactattttttttcctgttgctttttcttttgtgtattgtgtgtgatgcaagacagcggatgaaagaatcatcattctattcattatgccttaccatgtggcagatcccacaggagtttgtcaagcttcaagttagccaagaagagttcctctgtatgaaagtattgttacttcttaatacaagtgagtgagttcaagtaacttaatgcaagatatctagtttcttaattcattagaaaagttgcaaacaatatgattatatagttatgtatgaggtagacgtcttggattataagtataaagaagaaatacccaatatattgttatagacattaataaaattactggattttttcatcttttacctaccatataatactaaaatagcctcatcaatttctttttattttagataaaatgatttaattactctttcatattcacctaattcagtaatataaactacagtcatgtgccacataataatattttggtcaacaacagaccacatatacaatggttccctaagatgatagtggagctgaaaaattatcatcgcctagtcctgttatagccaccataacatcatagcacaatgcactaatcacatgttcgtggtgatactaatgtaaacaaacctactgtgctgccagtcatataaagtatagcacatacaattatgtacagtacatagtacttggtaaagataataaaaaactcttactggtttatgtatttactgtagtatacttttctattgagagtcactacttctactttttttaagttaaccgcaaaacagcctcaggcaggtctgtcagagggattccagaaaagggcatacgtcaccctgggagatgacaactccgtgtgtgttactgccccctgaagaccttccagtgagataagatgttggggtggatgacagtgatattgatgattctgactctgtgtaggtctaggctaatgtgtgttttgggtattagtttttttaaaaaaagtttaagcaaaaaagaaaatatttaaaaatagataaagtttatagaataaagatatagagaaagaaagccaggcacggtggcatgtgcctgtagtccccactacttgggaggctgaggtgagaggatcacttgagcccaggagttttaagtccagcctaagcaacatgtgagaacttgtctctaaaaaaagaaagaaagagaactgtaccttgtgtttttgtttttaactaaatgttattacaaaagagtcaaaaagttaaaaaactagagtttataaagtaaaaaagttacggtaaggtaaagctaatttattataaaagaaataaaaatatttttataaatgtagtgtagcctaagtgtacagtgtttataaaggctatcgtagtgtatagtaatgtcctaggccttcacattctgtcaccactcactcgctgactcacgcagagcaacttccagtcctgcaagttccattcatgttaagtcccctatgcaagtgtcccattcgtatcttttatattggatttttactatgcctcttctgtgtttagatacaaaacacttaccattgtgttacagctgcctacagtattcagtaatcacatgctgtacaggttcatagcctaggaataaggcctaggtgtatagtagtctataccatctaggtttgtgtgagtacactctgtgataatcacacagtgatgaaatcacataaggacacatttctcagaatatatccccatcattaagtgatacacgactgcaattaatattggataagcacaaaccatactctcctctaccaccactctcaccccatccccaaagtatttactatataaaatacataattttgtttagaattatttttatcaagataaattgttaaaacatgtaactataaagattagcatcttaatataatagtggtttctttatcactgacacagtccagtgagttagcaagaaacacccaggctccttctagccagtggcttcaccccttcctagtggcttgcaaacctctattggacatgactagaaatgagcactgagtgagagagattttgaaggctagatctgaaactatcatacatcactttcacccacattccaaggcacttaagctgcaggaaaagctgggaaatacagtctagctataggcccagaagaaagaggaaattatgttttataaagcattgcattgatcaccagaaggacaggcaaatatccgttccactttttcttatatccaaggaacatacttacctctgcctcagtggatccccaagggtctgggtgggcaaagttttaaaaaaaagaaaaagcagctgctttgacccttgcataggcaggatcagccctcaaatgtacaaactgatgcttttgtgattcattgtgatttctatgacaaccacagggagctaagacctcaggccgagggtgagcctaaggtctttcttggcaacatctttacagggacttctttctaaggtcccaaatctcaaatggctagggggtgcagatcaggagggaagggcaggagagataaaccctgaaatggaaggcttcctcatagaatttatgcaaagacagggatgaatacataaccatcttgggaaccctatttggacaaggaatttcaaggctaatttggtgacagagcatcaattgaacaaaggatatttacgtggaaccggcccagagagtcaactggaatacatttaataatacagtaattagctcctgcccttctttgcatgaaggaatgaatcctatagcacttatgtcacagatagtcctagatcttccaaactggcttatatccttaacataattctctatttatggataggcaacattatgctggggaattaaacaacaatggaattaatcaacagggaggctttgctcattgttgtcacttagaaacttaggcgatcactagagcagtggtaagaaaaggaagtgagattcatacaacttccactcacataccatagagagtaagatttttagccatttgccacttcacaaaaaggaagaaaaagaaactatttaatgaatagtacttacgctttccacaaattctaatcaagattctaatgagatttggggagaagagggtgaacttgacaaacctactgaaaatccatctttaaaactagaagaataaatagataagcattataaaaatatgcagggaattagaaagctgctgttaattaatacagcatgggagaagagatatactgaacttttgggcaaatcagacaagtatatattagaatataaatagtatagtggaaaccacaaatcaatgagtctgaaacaaataaatgttaagaaaaatagttttatatttggaaaaaaactgtttggatatgtagctcaaattatatccttgaataacagataattgagttaaatgtaaacactcaaataattaaaaaacaagctagaagaaatagaaataatcttcaatctcaaataccttttataaaataaatgcaaggagaagattggcaaagtaaaactttgataatttggtagttatgaacttaaacctctcatttgccattaaatatgaaaatataaatctccaggaatagacagtaggttgaacaaacatttttacattgttctctccaaaattacactaaaggccagatgtagtcggtcacatttctaatcacactttgggagggcaagctgggcagatggcttgaacccaggagtttgagaccagcctaggcaacttggaaaaccccgtctctaaaaaaaaaaaaaaaaaaaaaaaaaaaaaaaaaaaaaaaaaaattagccaggcgtagtggcaagtgcctgtagtcccaggtagccgggaaactgaggtgggaggatcacctcaacctaggaagtcgaggctgcagtgagccatgattgtgccactgtactcctgcctgggtgattgagtgagaccatgtctcaaaataaaaataaataaataaataaataaaaataaataaattacactaaaatcttagtaaagggatttactatgaaaaattaagaaaaaatgattttacattcatgtttacagctgagggaaatatagggattggttggtaaccttaaagagagctgtgaaagtttgaaatgactgctatttgaagtagtccagaaaattagtacagcctctatggaacaccatatggagatttctcaaaaaactataaatataactaccattctatctagcaatcccaccactggatatctacccaaaggaaaagaaatcattatgtcaaaaagacacctgcactcttgtttattacagcagtattcactatagcaaagataggaaatcaatccaagtgtgtatcaacagataataggataaagaaaatgtgatgtactcacacatatacatacatacacacacacacacacacacacacacacacaaaatggaatagtattcagcaatcaaaaagaatgaaagtgtgtcttttgcagcaacatggatggaacaggaagtcattatcttaagtgaaacaattcagagacaaagtcagataccacatgttctcgcttataagtgggagctaaataatgcatgtacatgggcatagagtatagaaatattgacagtggtgcctttgttggttggtaaggtgtgaggggggtgagacattacctaatggatacaatgtgcattattgggtgattgtataccataagcttagatttcaccactatgcaatatattcatgtaacaaaactgcacagatggtcattaaatttatacaaatttaataaaaagaggttctagatatacatatagatgtacatactagagttaagttttcaattgacaaaaatttgcatagatatactgaattgccagaattactcttcagagtctcctttatatacaagatcttgaaaactcaaaaccaaagaattaacttatttgtttttcataagtttgtatctctggccttcttttctaggggaaatggaaaccaagttttgattggggtgcaggggataaatacaggcttaagaaatagtaattttcctccctgttccctgagatacaacaatattggaattaggccaaggctgggcatggtggctcaagcccgtaattccagcactttgggaagctgaggtgggcgaatcacttgaggtgaggagttcaagaccagcctggccaatatagtgaaaccccatctctaccaaaaagacaaaaattagtcggacatgatggcacacacttgtaatcctagctactcaggaggctgaggcgggagaattgcttgaacatgggaggcggaggttgcagtgacctgagattgtgccactgaactccagcctgggcgacagagcaagaccctgtgtcaaaaaaaaaaaaaaaaaaaaaaaagcaattaggccaactaacaatcttggaatggcctctcagtgttccagtaaaagaaagagttgcaagtctgaggtagaaatgattaagcttaattaggaaggcatgtcaaaagttgatataggttgaaaactaggtctcctgagccaagcaactagccaagtttcaaatacaaagtaagagttcttgaaggactttaaaagtgccattccagtgaacacatgaatgataagcaaaaccgccttattgctgatatggagaaagttttagtggtctgaatagaagatcaaaccagccacaatattcccttaagcctaagcctcatccagaggaaggccctgattctcctcaatactaggaaggcaaagagatgtaaggaaggagcagaaaaaagtttgaagctagcagaagttggttcatgagatttaagaagccatttccataacaaagtataaggtgaagcagcaagtgctgatgcagaagctgcagcaagttacccagaagatctaggtaagattatcgctacttatgaaagtagctgtgctaaaaaacaggttttcagggtagataaaacagctttccactggaagaagatgtcatctaggactttcatagctacagagaacaagtcaatgtctgtcttcaaagcttcaaatgacaggttgactctcttgttaggggctaatgaagctggtgacttgaagctgaagctggtgacttgaagctgaagctaatgctcatttatcattctgaagatcctaaggcctttaagaattacgctcaatctgttctgcctgtggtttatgaatggaacaacaaagctggatgacagcacatctatttatggcatggtttactgaatattttgacccactattgagacttactgctcagaaaagaatactactttcaaatattattgctcattgacaatgcacctagtcagccaagagctcttatggatatatacaaggagattaatgttttcatttctgctaacacaacattcattctgtagttcatagatcaaagagtaattttccactttcatgtcttattatttaagaaatatattttgtaaagctgtggctgccatagatagtgtttcctctgatggatctgggtaaagtaaattgaaaaccttctagaaaggattcacctttctagatgccattaagaacattcgtgattcatgggagaaggtgaaaatagcaacattaacaagagtttggaagaagtttatttcatccctcttgcatgactttgagggtgttcaaaacttcagtggaggaaataactacagatatgtgaaaagagcaagagaactaaaattagaagtaaagcctgaagacatgactgaattgaagaggtttcgtggtaaaacttgaaagatgaggagttgtttcttatggatgagcaaagaaagtggtttcttgagttggaatctacttctagtgaagatgctatgaagattattgaagtgacaacaaaggatttcggagattacataaacttagttgataatgcagcagcaggacttaagaggattgactccaattatgaaagaagttctattgtgggtaaattgccatcaaactgctagcattgcatgctacagaaaaattattcacaaaagagtcaactgatgcagcaaacttcattgttgccttattttgagaaactgtcatagccaccccaaccttcagcaaccaccaccctggccaatcagcagccatcaacatttagacaacaccctccaacagcaaaaagattttgactcagggaagactcagatgattgttaccattttctagcaataaagtgttttttagttaaggtgtgttcactttttaaataatgctgttgcacacttaatacattctagtatagtgtaaatataacttctacgtggactgggaaacaaaaagatgcatgtgattcactttgttgcaatatttccttcattgccgtggtctggaaccaaaccggctatatctccaagatatgcctgtgtaacaaagtggctggatataagataaatatttaaatattaatacctttctcccatatcagcaggaaggcattagaaaacttaatgaagcaatttttaaaattacaacaaaaagataaatcatctaggaataatcttaatggcaaatacttgagatttatataaagaagacaaaagtttactaagagatccaagtattcattaaaaagaagggaaaaaaaagatccagattacatgcagctgtaaactaagtcaaaccaagtatttaagaagcatgtagaataaggccaggttctcttttgagcaaatgctaagttaaatgcacaatccattgatacaggtctaaaataggtcagctgaagtgttctttaatatacctattaattcttatgttcttccagtgaactagaagtttatatgtcctgatattgatagtgatatcaataacactatctctttcctatataaggtgttttttttctagagtcatgtatcagaagaaatcattatatagctcagaaatatatgttataaattgttaatgtcatctttttatacacaactgccacttttaattgtcttcttaacagttcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatgtaagtatttggttgattccagaatatcaatgattattctctgaatttctataactttttaaatgttacatgtaaattttactttgtatgattttctcagattaatacttgtatgttaaaagtgtttggatcatgctgctcagactttttattgtgtttttttttcattttcaatatagaccactcaaatattcttttacaagtatttgtataatgtgagggtaatttaatagctgatagaaattatggtacatttcctgaatatgttctaaaatatttgtgcctaaaattataaaagattttatatatacagtaaaaacaaaggtatgtatgtgaaaaataagactcatgccattttcagtggaattataaataacattgctgatgggtgggcaatcaggcaatacatagcaaaagttaaaatttgcatgcttttcaagtttctattttttaggatttatcttaaagaaataattagacaaatgtaatatacatgcaaggatgttcaccatagcagagggggaaaaaagaaaagcaaacaagaaatgcccaacaccagaggtggattactaagacaagatatctgtggtttgtcaagatatatgaaatacaagcttttattgctactatgttcagatcacattaaaatgacagtgaaggcataaaaaagctatccactctccaggtcaacttttgaggtcttactcctgaatacgaacagacagccaagattatgagctatttgagtaaagcctctaaaatgaaaggcagaaagcaaaataaaaagaaacttgaaggaaataaacaccagtgcagagaacagaagaaaacttctaacatcctcagagaaataagaatgatacggtatccatgacatgagaacagaaaacatttttaaaacagacatttagcaagaaaatacttttggataattaaatgaagaaaggcagaaattgaaaattcaatgaaagggctgaaatggaaaggaaaatctgaggaaaaataaaagatcaaaacatggaaaattagaaagaagagttatagtaaatttagtattcaggagattctagcctccaattaataggaatgtccagaagaaaaaatagagaaaatcaaggagagaaatttgtgtaagaaatcgcaaaagttgctggaactgaaacatacaagttttctaacaaaaagggtccggtgtagaggcactgcacaattgaactaaggtacattattgtaaaattgtaccaggccagaaatgaagagaatattttaaagtataccagtgatgaaagaaacaggtcacatagacgttatcaggattcagaatgatgttggacttctctgcagcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatccagcagaaaaccataaaaaaatctttatgatataaatgctggatattgactttagctaaaaattgagccaaaagctctctctggggagaagagaacatgtatgtagttgaggaagagagtgtctagtataagagagcttcattttcttcatttcctatagtagaaactaaaactaactttagtggaaatatagaaatatcaaaagacacaggctacaaaaagttgaaggtagttgtgtctagggagctggaatagggatgggaagaagtctatcaggaaactgctaggctctattgatgctgctgctgctgctgtttttgtttttataatcatgtggtactacttgactttcaacattatacacatgaattactttgataaaaattaaacgatgttggattattggcataggaagaaccaatatgttgttatataaaacagctagattagcaaatagaatttatgaaacatgtgtaatattgtgtgtatgcttgggtatgtctgtatacatgtataaaaagaaaaaaaaacttgagtaatacaccaaaatgttcacacagcttatcctgtagaattgtgaataactttcatttctttaaataaatctttccataatatcagaatgttctatcatgagtatataacattttacatattattctagaaaatggtgggagttattttcactatggtaagaaaaaaacaccttgagaagtatttatattataaatagttagaaaaataaattgccatgtttgaatagcatatgaatttattatttttattacatgttttctactcatttgttaaaccaacagcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttg

SEQ ID NO: 16434 - DNA, 4598 bp, Human
atccttgagcaagaggaaaaaatcatctcagtgggaggcctacagtaaacaaaatataagtgccacggagaaagctaaagcagagaaaggaatggagaatgttcaggatggaggtcagagtgttacatcaggtggtcaggaattaccttaggtaattcctccactcaaaacccttcagtgacttccatgacatgaaataggaagtcattggagggtttgagcagaggaatgacctgttttaaaaggctcactcaggctgctgtatggtgaatagagttgcggaggggtggcaagagaagaaatgggaagaccttctgcagtcagaaagtttctgcagtaatttagagatggtagtgaattgatctagattggaaacaatggaattagaagtgtttagattcttctaagcaaaggttttaaaaactcatttttaaagaatgagttaagggccgggcatggtggctcacacctgtaatcccagcactttgggagaccagaggtgggtggatcacctgaggtcaggagttcaagaccagcctggccaacatggtgaaatcccatctttactaaaaatacaaaaattagccgggcatggcagtgcatgcctgtaatcccagctactccggaggctgaagcaggagaatcgcttgaacccagcaggcggaggttgcagtgagccgattgcgccactgccttccagcctgggcaaaaagagtgagacccgtctcagaaaaaaaggaatgagttaaaatttgctagtactttggattgcagggtgtgagagaagaggaatgaaggatgataccaaggtttttagcttaagcaactagagttgtcatctgagatggggatgaccttggaaggggaaaatcagcaagagtttgcctttgcacatagtcttaggtgcctattagacattgaaaaagaaatggcaagtaggcagtagacagcagagtctgaagttctggaagaggtccagactggaaatgtacatttggaggatgtcagccctgtgggaatggagttaggaaaatgctatgatttgttcccttccctgtagtttagtttttaccctggcagatttgaggcctgctttggatttagagaaagctgagttggccaggactttactattatgtaaccaggactacaaatgtcagcaactaaaaataaagaaagtcaggccctcttctgcccttcgaaatggctacagggaccaagtatgcataccccacaagaccagaagtaaggaaggaccagtaggaggctggaggtaaaagaaaaataagggcccagcacggtagctcatgcctataatcccagcactttgggaagcgatggatcacaaggttaagagatggagaccatcctggccaacatagtgaaaccctatctctgctaaaaacacaaaaattagctgggcgtggtggcacgcgcctgtagtcccagctactcgggaggccgaggcagaagaatcacttgaaccgaggaggcagaggttgcagtgagccgagatcgcaccactgcacttcagcctggcaacagagcaagacttggtctcaaaaaaaaaaaaagaaagaaaaaaagaaaaagaaaagtaagttgcctctcccccttccaaaaatggctgacatttctctttgttgcccacagtgttcaagaaggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctcctttgggacactgtccagctgggagctggaagcctggtatgaggacctgcaagaggtcctgtcttcagatgaaaatgggggtacctatgtttcacctcctggaaatgaagaggtaagaatgttagccctaaagctaaagggggatgttacctttcccttctcaactaatatctatgttccctttcctcatttccttgaaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaaggtcttttactttttcttcttgcctttaggggcttcagggggtttcccctcagctacagccaactgtttctttagatccaagagtttcgccacctccgcagcaacctcgttcttgtctgccttttgtgctttcagttctcggacaatgtttccctaagataaaggggggtggggaggtaacagtgaggcaagaaaaagatctatttaggattcagcttgtccagtctcccacagggcttaagcttcatacttgttttgtcacttcatccatcagcgcttgtatctgctgtggcttggctgttgtaacagtctctacaactgctggcttcggggacgtttttgcctggagaacaacaaagttatcaccagcaaccataaatatcccctaacctccagttttatacagcatctcagagggaaagtggttacctttaagtcgaaggtctcttctagttaagacaggaaagaaaaactgtaagtgaggaagcggcagggccaaaagatggaaagagtgatgggtgaggactacttagggaaattagggaagtgatgctgtggctgttgtggagcgagggcacagcctttagctttctcacctggccccctccaaagcgctgccttaaactttcaatctggtcattttccaatttttggaacaagggactgacctgtaaaaaaagagttccagaatcatctactgattggatacagactctaccatagactatacagatgacctctccaaccccaatctctgatgtgttttagaaagaacgagcttaacactgagctaatatctgctgattttaggaaattagctgtagctttccctgtgaaaccccaaataatttgtagggtcaaagattctttaagctctctaaggatgctaggctgatccagaagtttagcaatgtacttactttttcattttgtgtcaaagaggaaatggctttcctgtattttccctgcccactatctgctagcattatggagactaggtgatcacagtgtttcttcaaatatctgtttaccagttagttttgtgtgccaggttctggtttctggcatgaagaacaatgaagatgtacagataattccggacttgtgaacgactaccaaggactttatatcagaaacttaggagtcccatgaccaaagtaacactggagagatgttaggtcttctctcacccactccaaaagctgcatggcaagagtatcaattttaagagaggctggctcttccacctactgtgccaatctggtgtcctgctggtaaggtacacaggaagtttgtcagcaggatactgcaggctggaggtgggagctgcagctgggcctggattgtggcactaaccgtgggcatgtaaggctgaagcatgacagagagcaaggcagctatattcactgccaagccagtcactgttcctgcccgttgcctgaggaagaggagacattagtcaagacctccaggaggatacagcttacaagccactttatgcctttagccaaccctccccgcttacctacctgtcagcctcactgcctttaatccgcttccagggctcattcacctgaatatattggttgccatgtcgagatatggtgaggatactgcgcaaggcatcccggatcctgggaagggaggaagcaggccaaggtgtaatgtcctacagagaccaatacaaggaggctctcaacatgccagcagaaaagacagaggtgtcagttacttaccgaaccttctcaagtagctggtgatagtgctggagctccaggg

SEQ ID NO: 16435 - DNA, 258775 bp, Human
ccagagttgatctgtttccctttattaatactttcaccgtgttaatacttttccagaaaccttgcctccaccatggccctaagtcctaacagatagcttaattttcttagaggaattcaaataacaataataaataatgtcacatagacttctaatgttttaataaaaaccttcagcaacgcccacatttttacgtgacaattttttaaagggctatgagggagccaactatgtcagcaaacagacatgctctgaagacagggtggtccatggcattcaaagtgtattcatttctaccgatggtgcttttcttgcataggttctgacttgtgtagatttggacttcaagctaaaataaaaagagaggaatatgtgtatacatgagaatgtgtgtgtaacgtgtcgatggtataaatagtctcttcctctctctctgaattgcatgcacttaagcccctaagaaaagatctcttacctcttatctaagtaaagcagaattttgagctttgaagctaaatgatacaatgagatcagtgtaaatactctttaacacaacaatatttgagtagctttgaaacagtcgtcctcatttcgttacatacagaacgttcgtgcttcctccctctcaggcaagaagcggagtccgtcgtcagcagttagcagagtccagtgcgagtgcacgtttcttaaccggataacttagttgcccctgccccccgtcgctgcgcccgaattcgcctccagtagaagacgttcagcgggcgacttggcccggcgcctgggatcggtggctatgcgttccccaactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctagaaaaaacaagggctcgtccttgcactctcgccccccatggatcacccctagaaggtgctttccccaaccctcctggtgccaaggagagcaaacctccccggggatttgcccaaagtggtgggaggagggttaatatttgctttgttattcggataaggggaggcaagtatgccttgggtgtgtgtgtgtgtgtttgagagagagagaaagagagagagagagagaggtgtttttgcagcgggaaacaagcaggaagaggcacagaggccggcgcccctgctcccctcggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggggtgggcgggggcgggcccggggcggcccagggcggggcccgccgcttcccccgccctcattggccgctggcggactcacgtcacccgagctggtgctctcccccagcccctagggaattggagctgaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaagctctcccatgcatttcgcatgttgtttcaaaacggggggacgggggggcagccctgcgcaatctcattgcagatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctggagaggtggattttgagggggattccctacggagaagtcgaggtgtcctctcctgatgcgtgggcggccagcctggctttcccactagagcgtggggatccccattccaagaagttgccagagttcgacagtttgagcagataggtgagcctcccagctttggacaccttggatctcctttggagactccagggtactcatcctgggaggacagagagaagggcgctgggtgggggctgtggctgacctgcgtgtctctcctgcaaaagatgtatcagggttctccagtgtccttaggggacctggcgcaggctggggtggagtgtgggtgcagagagaaggtggggcgaggggaacccaaaggacagagatgtggctaccagagggctgggtggaggtccctgagattttaggctccatctcgctcctgatcccaggaagagagaggagtgagatgagcggtgggtgcttttggttattggttttgccttgaagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagagacaccaacacaataaagaagccgaccttccttcttcactcccccccaccccaaacttggcaagacccaggacccaaacgccattataaaatataatagtgattattattagttatacggaagcttacgtgctggagtccttacatagatttttacttaatcttctcaacatctctgaggaggctactatcattattgagcctatggccccgttgaggaaattggttcagaaaagggtgcgagataaaaacaggcaagggcttcaatccagatctttcagaagtgaacccatgctctttactccttagtacccacccaagcaagctaggtgctttcaggggatgtggggcattgagataagttgaaaagggattttaattcttgagtgtgatcttgctgcagaaacctgtggctccctccccctcccccacaccttttcatgggtgcgggggagtgggagggagccataggtttctgaaaaccattgttctcagtggttttctcttctctttgctgccccctttgaaaatgtgcccttaggatcagagatcagataactaggcctctttgtccttcattctttcttggagaggagcacactgattttgcatcacaacctgaaacctgcagttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattatttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctattttcccttttctttttacttttattatatttatcatttattttctattaacacatgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctgccaggtagtaaaaaattaataaatttctggtcgcttcacttttattaaagtataatttaggaaagaacacagcttagggaattttcacaaactgagcacacatgtgtaaccagcacccaaatcaagaaataaaatattaccagtatccctaagtccttttctcactcacttgctttgttttcaggttttagctattataaatatagcttttgtggatattaaagtctacgtattttggcaaacacatatatggccttctacagggaatcctagaaatggaattgttgagtaaaaggatatgcatgcatacagctttataagaccatcagttttctattgctgtgtatcactaaaaaacttagtggcctaaaaccacacaagtttgttatttcacagttttcatgggtaaggagtctggcacattttagttgggtcctctgctcgagtcttcacaggctgaaatcaaggtataggctgctgggtcccatctagaggcatgaccaagaaacaaccctcttctgagcattttcacggctttaaaggaattgagtttcttgtggttttagacctgaagtctttattttcttgctggctgctgggccaggaccactctcatcccctggagacctctccatagccctctcacacctcacccttcaaatatctgccttcaggaagagcccactctccttgcaaggttaacctgattcgttcaagcccaccaggattgttttccttttggttcttctgatgaactcagagtcaactgatttaggactttaataacatttgataaatctcttcacctttgcgtaatctaatcacagaagtgaaatctatcatcttcacagtcccacctaggctgtccacactcaaaaggaagatgattacatagggcatgtacatcagggagcagaaatcttgggggccatctcagaattctgccggctacagacaaacagccacatggctttcctaagtagttataccaatttacattcccttcagcagtatgtgagagttccagctgctccacattctcaccaacactagatattttacatctgttttcttttagccattctggtggtatgtagtagtgtctcatcgtgactttaatttgaatttccctgattatcaactgaagttaaacacctcttcatatgcttattgatgatttggatatcctcttttaaacacatttgtttcagatgctttgtcctgaaaagtttttcttttgggttgtcgatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttctttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctcatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatattgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttccagcaaaagacgcctgtaacaggctgaagagctaagcaccagattcattgctccttcttcatgggctgcagcaagaccacatttcccagcctgccttgtaaataagcgtgatcatgtgacaattctagcctgtgtaatgcaagcagaagtcatgtgtacttcttccatgcctgatgcataagaattctctatcgattgtttctctgtgttctgctctcctctggggcttgatgtaattgagaacagtacattttgacaccaaatgccaaagcagcatcacaagatgaaaggagcccaggtccctggtccgtgaattagaagaccttatatgagtgagaaataaactgctattacattaagacactgagatttgggagtactgcccaaactaatatgctgtcagtaaatatccctttgcttaagttgctagagtgaatctctaaacctcgaaggcaaaccgagccagatcacaacaaaaattgttccaaagttttgtgagagcacacatattttcacaatatactaccaaacaacttttcaaatatttgtgatttgtcttctccagcaacaaatagaacccattctacacactgttcttcctgctggcaaccaacgtgccctactcataataggtgtttaatatgtgctccttgactatgactacagttggaccacaaggtggtgatttgtccataatctcaggttgaaggtgctggaaaaactattttttaagaaactgttcctgtagaatccatttctctataggcagccattcagctaggaaatagaattaagtgacaaccagcaagtgggcaactggcatgcttctttgtttctctaaaattccccaacttcgatattatcagtagtagaacagatgagctctttgaacaaagaaagtaaagtctgcagttacaacctgatcaaaatccaaaagaagggaaagaggggaaatacacctttttttctcaattgaatgaatatctagaaatcaatttctatttcagaaggtcttattagctatagatcataacgtcatagcacatcagatagtgatgctatagttaggttcacaataattatatattccactcaaactaactgctcaaagaggtctggctttaagaataaaacatgaaatctgaagttcaatttttcattgagttcagatccaacgtttcaaaaagaaactctgtgctgaatttgtgaattattatttgagatacaaataatcacgggacagctcaaaaactgacatttctatttgactttccttattaaggtgtatttatttagctaaagtccacaagtgattaagaagtcaagaaattacatctgagtcaacacttcagtctgaaatgtatagttgtgtattaatggatggtttatatgcgagacacatatgaaaataatttaactgccttgacaattttttgtcactgaagctaatttgaccacaactttttggaaattgttgtgatgtgctgagattgtcgataaaaataattgaataaaacaagttcttacattgaaagtagaacaatgacacactcttaatttcctgacataaagtagacttcagactgttacagcgtattggcagtttctccattagaaaattgacaagaatggggagaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagattgtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctattttaagttttaaatcattcagtttaattattataaaatttaacagaagagaaaatcaaaagaaaactatggaaattgttaaacttcagataaatatgctatacaaaggagatattatttcctaatatacctccctaaaattcataagaaattattgtgtctcatatttaggagtttgtagttacatattttatacatacatggtagataggttacatatatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttcagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagaatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctatggcaagaaataggattgtcaaggaagactgttgagagaaaacaaagcgaagtcctaggacaaaatgttggagaactttggacatgaaaggagaaagaggaaccaggagaggagtcagaacttggacggttagagatatggaaaaagaatcaagagcacacaggcctgtgaaaggaaaggaggagagagttaagaaggaaagaaggaagcaacctcagccactggttttagagacaaagtcattgttgaaataggaggagtcaccctagcacagtggaagaggagacgagtgttaatttgggtccccagatgtaggccctggaataaggacttaaatgcaagtagtttacttaaagagtgattctacaaaatactggtaaaggagtggggaattgagataaggaaaggaaggcaggaataaagggtacatcataaagcaagttgtcactgtgggtaactggaactcaatcccactggaaaactgggagctggtgtagaatatgtgcttcagagttatcctgcctgaggggtgaggaagttggggtatttatacacgcattgcattgacatattaattaatgattgagagttactccaggctgatgttaacactccagcattttgtcctggcatatgctcagacagagcagaatttggccatccagaaaaatacttgcaaacagatgcagaggctggcacccacaaaatggtaaggcctatccaagaggatctgagtgtgaaagtaaacatgtctgctacaggaaaaaagcccaatcatgaaggaaagcatcaagtgtgatgaagtggaggtaccaaatatagaccatcccttcaagaggtatagtggttaaaatagaaaaatagtgttacagtcacttgatgtggttttaaaggtatttatgaattaataatttcttagcacttgtcagaccacttggagattgctatcccaccagaatattgtgacatacctagccaatcaagtctgcattactctaactggtttttccagtcatttacatttttacaaatgataattataattatgaaattacagcctttcagaacaggaagggatcctagaaagacattaatttaacccttcatttaataaatgaaggaaataaatgagggaaagggcatcgaacactatgtttgtatgcttaactattccaaaaagcatttgagccttgttgctcattggcggtggtttagacaatgcattattgatatcactgaaccagctttccagactggatgagatagacaactagattgggtgagactcctataagtgattagccacatacaccaacttggtctgaccatactaattcatttcaggtcctcctgatgtgcttttttggtttgtttttttaccattttacccgtagaatttttataaattctgattttccaaacaaagctattcatagactcaaggattccacaccaacaaccattgggtttacacttggtaaaagacagaataggaatttatacttccttgactactcccttagtgactaaacagtgctatatatttagtaagcactcaataaataccaaaataaatactgagaaaaaaatttaaaggcttagcatcatcattagattttcactgcacacccagccgatgtctcatgagatggtgcaatcaggaaaaccaagtatgctaggaagggttataggaacatcctatttagtgcctgtgttaagtggatttccttaattgcccttaatagcctaaaattttgtgacttaatcattaagaatccagtgacagaggagaataaggtgacccacaaatcctattcctctttgcctttagcttctcctctatttctgtgggaagaaaaaatatcacttttatcagggcaccaccaattctcttcagtgatgatggaagctcaaacccaagaaggtagttgacatccaagagtcaattctagtcagttccagctgactatgtttctaggaactgtcagccaagaatgggagaccaagagagaccttgaagaacctaaaatgtgggaagaaggatgggaaacaagccatttgtgatctcttgaagttcagtagcagcactttaggcagaggagaagggacagggatccttggagagttgtgtcttaaatgaggtttgtcattaacccaaatttggacccagcagccgaagccagaaacaaaccattctggccataaactagaaaatgaggagaggaccaaagaagagttatgggagtttcaagccaatggaccaagaaattagcaagagctacagtcataccacagggacgtatagaaggagaagattattaaggtcattcaacaaacatatactgagtaagttcagtaaacaaacataatgcaacacactaagacatggatttgggaacaagtaagcaactgggattcaatcttactggcctaagatgattccaatagatagatgaaaaatcaaaccccaaggtgaaaacactttttttttttttttttttttttttttttgtgagatgaagtctcactctgttgccaggctggagtgcaatggcgcgatctcagctcactgcaacctccgcctcccgggttcaagtgattctcctgcctcagcctcccaagtagctgggagtacaggcgcacaccaccatacccagctaaattttgtatttttagtagagacggggttttaccatgttggccaggatggtctcgatctcctgacctcgtgatccacctgccttggtctctcaaagtgctgggattacaggcataagccactgcacctggcccatgaaaacactttttaagtctctgcttgtgttgcatttactaagtttcattggccaaagcaagtcacatggccaagtttagagtcagtgtgggaggagactaaccaagggaatggatacagggagatatgaacaaaacatggatccaatttcctactacaggcccctctgacagttacaacttatctgtgttgtcccatcaaagggtgaggaggctgggatgtttaacctccagctaccatttcttcttggttgatggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctagatgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcatgtataaaatgaagggttaaacgaatgtctttctaggatccgttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagttttgtctgtctagatgacaagagactgggagatgaggccaaagaagtgacctggggtcagttcatgaccagtcacccatactatgctgaggaatttggattttgcaggtaggtggaaggaggcatcgaagggtacttgggaagtgtggcaggatggccacatacaggacatcctaggataagaagttgagctaatagtgacttggagaagccttgatctctgcctggtttctttgtcctgtggaatcactaattctggcaacaagtagcacatcatttaatagatgatgccactaggaagtcaggttatatgtctttgattccattgtcactggatgatggcatcagtgatactaatggcttgattaattattgtccttgtagtcacactgaacggctggtagagcagccagttctatccatgaaatttagtccagctaagaacaaaacaattaaatgcacctcccctgacatataaatatatgaatgcagaacaaatcccgtaacttagaagccaagaagaaaagaaagaacagtggtgtatcaccatgatcctagctcacctaataggcacattactccctgatattccaaagaaataatgctcatttttaattttttctttctgggatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtaagctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtgttgagccctatgaagatgaggcacattgaaaggggttgattctacagacagaaagataacaggttcaagtttatgcccaaggaaaagcacacttatagttctatagttctatagtctagtttataagaattcatacaatctgaggtctctattttgctattgcaaatgtctactttatgtgttggggtgtgacaaactgttttagcaattggtctctcgttctaaatgcaaaggaccttctcagaccatgctaacctggtgacacatcctaataagttgaggctgaatgagatcttttgtcacatctggttactcaaagacatgatgtcctcactccacaggccttgtgctattgagagaggagctgaagtcacacataaataatttaggctcctccactgcatgaaaagcatctgtttaaggagctgtcaagctgtccacctctctagtgaaatcatatttactttattcatctaaataatgtggcttgtttgccttctgtgtgaaattgtcttgcactgtttctcattggtgggttttatgggacagcatatgattttctgtgcatccatatgccactctacctctgggaatggaatggcttcttgttcagtagttttgattattatagccctttatagcttatgagtcattgggtttactcaaaatgtccagctcctcattctcatttttttctctatggcccagccatgcccgtcctgaaaaatttttaaaaaggaataataaaaataaataaataaaagtcatgtactctatatttcatttccaatgagttgcttcttgtttgggtaattttttattgtattagagacaaggccttactctgtcacccaggctggagtacagtggtatgatcatagttcacagcagcctccaactcctgggctctagtgatcctctcacctcagcctcccaagtagctaagactacaggcacacaccacctaatctgactaggtttttattttttctaaagacaaggcctggcaatgttgcccaggctggtctcaaactcctgggctcaaatgatcctcctgtctcagcctcccaaagtgctggaattacaggccaccatacctggccttgtttggataattatagcaataggagtccaccgaagtaagttgtgtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgcctttttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctagattttcattttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttatctgtgtggaatttaatagggtaccaataaggtttcactaacaaattacactttatacgaccttgccaaatgcagcattcttgtgggttattctagctttttaaagggatatcttgcttgtgaagatactagcatgtaattttctagcttagacatctacttttcacccccttttctcctttatttagaaataactctgaacccaaagctgatgtttgggagtagttaacttcttctcttgttttctatagctgctccaaagagcttggacctgactacagaccaaagtaacagagaatgctagcctcatctgtaattgataggatttttttttttgctagaatatctgagagtatttttacctcgtgttcaatctcatgagtttcttttcattccatatctcttatgatgtgccttctgtcttgtgcttagcagagtcctagacagctcagagctaacaagtgcaatgtgcatcactcattggatcacagattgagtttggccagcacaatgctttcaatctgtttgacttgtggaggagcacgtaccctccagtttaccacaatcctcaccactttctattgtcttttacctgattcgcttagttagacagcctgcttgacccccaatatattaaatgtcttaccaatgcccaaagaactccataaccttagtcatccacactgaatagcacaactacttaataactcttgctagaatctagaacctcctgatctttttaatttactcagcaggtatctatgacatgatactctgcacctaggacatgagcaaaaccggtgttgtccccatagagcttgcaatccaggcattccgaggactgtgttctgagagataattctttccagcataccaagataattttgaaagatgaatatttaggcaacatgtcagtacctcaattttctttttcatttaagattcttctgctccctactactgtattcgaaaccagcctagtggatggctcttcctataagcaagaactatttccttactataaagtgtgtacaatccacttggctgtgggttggagcggctctattagaattgactggggatattcagttggaggttgacaatgagaacacgacaaggcagatgatcagagaaattacagtaattactcacaatcagtcttcgatagtaagtcacaaaattaaaaaggagaatgtaagtcacaaacgtaaaaaggagaatgtaaaagtatgaaccaagagaggttccatgttcctggtttaacagtggaatagtaaatgcaggatatcctccagaaaatgcctgaatgaatggtgcctctactctctgctatggaagttagttgggtccaacgcattccatgggggacgtggtccaaagtggacctgaagagtgtggtctgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcacacaatccagggaaatcagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgcagagcttatccctgttggtaaaattcaggtccccaaatgaaatggacaagcaattatcaactgagccagttttcaatccttggtgattgtttcgtctgccagtttttgtttcttaaacctcttgacagcagtccctcttacaaataaaattataaaaatcctatatagcaaatgatgtccagtgttctaccaaactagatcccgactaagcctgactgaggaccatgaaaaccagcacagtggacaaacacaaagaaagcagccaaaggaaaagtgaagagtctgatccgggaagccttaactgttctgagggttctgaatccatttgagaatctgtaataagcagtagactctcctgagaacaagcgaatgcacagatgcacaaaatttggaatggaggccatgccaaggtcacagaccctctggagcatctacagattccctaagggaagagaactctagtgtttaaaagaagcaggaaataggctccatgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcgttcacttctttttctccttccttctggaaccatgcatattttgccttaagagaacaaagtgatgatataaaaaaggtgtggtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcaggagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaaatgttgcattaagtcgggcgcggtggctcacgcctgtaatcccagcactttgggaggctgaggcgggcggatcatgaggtcaggagatcgagaccatcctggctaacatggtgaaaccccgtctgtactaaaaatacaaaaaaattagccaggggtggtggtgggcgcctgtagtcccagctactcgggaggctgaggcaggagaatggcgttaacctgggaggtggagtttgcagtgagccgagatcgcgccactgcactccagactgggagagagcgagactctgtctcaaaaaaaaaaaaaaaaaaaagttgcataaatagcacacaggtacacctatgttcatggcagcattattcgcaatagccaaaaggtggaagcaaatcaagtgtccatcaacggatgaatggataaaccaaatgtggtatacagggtggaatatttaaccgtaaaaaggaaggaaattctgacacatgccacaacatgatgaaccttgaagacattgtgcttaagtaaaataagccaggcaccaacagtcaaatactgtatgattccacttatataacctaattcgagaaatcaaattcataaagacagagtgtagaaaggtggattccagggctggggggggaatggagagttactgtgcagtaggtacagagtttcagtttgagatgattaaaaagttctggtaatggataatagtgatagttgcataatgtgagtgtacttaatatcactgaactattcacttaaaaatcattaaaattgaaaagttgatgttatatatatttatcacaataaaaacattacttttaaaaagaagcagagtttccatatacccttctttattcagcttccccaaaattaacgtcttaggtaaacatagcaaaattaccaaaggcaggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttagtgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacactaaaacaagccagaatcatggtaagatatgttcctctgatacccactggcacttaacaactccaaattttctttctagtgttaaaaattctaagttctaggccagatgcagtggctcacacctgtaatcccagcactttaggaggtcaaggcgggcagatcacttggggtcaggagttcaagctcagcctggccaaaacagcaaaacctgatctctactaaaaatacaaaaattagccaggtgtggaagtaggtgcctgtaatcccagctactcaggcggctgaggcaggagaattgcttgaatccaagaggcgaaggttgcagtgagccaagattgcaccactgcactccagcctgggcaaaaaagtgagactccaaaaaattaaaagtaaaaaaaaaattatcagatccataatgcttcctgcaataagaaacaaaaggtcaaatttcatactacctgatagtgttcaaagtagaaagtttttggaaagcaaaatacagcacacatacattttcttcctctcccctcactttttttattttattaaatcttaatattatccagagtatatcagcagggttaagtagagaaaacatttaagaaccattgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagctgtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaagctgcgctcttccaggattgtcaggcaaagcactacacatgcttctcaatgttgcctgggcttcctcataacatggcagcctgagaggagttggacttcttaaattgtaggtcaggactttaagagcaagtgtgttccagggaacaaggcacaagtctaatggccccttatgacttagattcagaagtcacatggcatcacttccaccatactcgtaattaaagtgatcatgttccccagatgcaagggctggaatcatggacctcatttcttgatatggggagtgtttaaaaaaaagctgtggctttaaacagccacactcttcaaaattaaaacactagaaaaatataatttttaacagaagtggaaaagagtctcttaagctgactgccctcccctttctccaaaaagtctaagaaatattccccaagtatccctctgattgaaataacctctcctttgggtttccatagcagcttgtgaataactctgctacagcacattctattctaacaataaaaagagtaacttatgcttgagtgcaagatattattccaagcacttttcatgcattatctcacttaattcccataacaaaaacattttataagtaaaaaatctgaggcccacaagggttaactaacttgccaaaggtcatagcgctgttacgaggaagagcgagaatttaaaccaaggcaatctggcttcagaactcatgttcttaaaccactccaccacagagtactgttaatagattgctgtgtgcaaatcttccttccctgtgaattgtgagctatttgtaggctgagaccatatcatcattacctttgtctctccagcaccaaacacagtgcctggcttatgacaaggaacacaaaaatacacaatagaaaaatgcacaaaagagaagaaactaaaatgtcaataaacatatgaaaagatgctcaaactttcaaaacaattaaaaatattcaaataagatgaaacattttgcctataaattggctgcagttaaaatatcattaataaatgtcaatccagtgttacttagagaatgggaaaaaggatatttttattcttatttacttttcggtgaatcttggaatatacaaccttatagggaaacttttctgaagtatctatcaaaatgataagtgttcataatctacgacttagagattgaattcctaggatatatcctacaggaaaactctcatctatacaaacagtgataatcacaaagctgttcatcatagcatttttaatagcaaattgattaagatatagttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcttccgtgtttttaccatgtgtcattgcttaattcctttccatttagaaataatattccattgtacatatatatcattttgtttactgttttatcaattgatagcaatgtgggttgtttctagtttttgactatcatgaataatgttgctatgaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccattttactatcccaccaacagtgtatgagggttcaaattcctccctatccaggtcaacacttgctggtttgggtgcagttgggcaggggttgattttacccattctagtgtgtgtaaagtgatatctcatggttttaacttgcattctctgatgtctaataatgttgaacatctttctgtatgtttataggccatttttacttcttctttgaagaaatgattcctctaatttgcacatttttaattggatttcttgaatttattgttgaattgtaaacatttttaaaacattcctgtgcgagatccttatcagagatatgattttcaaaatttttctccaatctgtgggttgtcttttcgtttccttcgctatttcttttgaagtacaaatattcttaattttaatgaagtacaatttatgttcttacacttttggtgttgtatctaagaaaacattgcctaacctaaagccatgaagatttatttatatgttctattctaagagttgtacaatattagctcttacatttgggactactaatcattttgagttaaattttgcatgtggtatgagataggaatccaaattcatttttttcatgtgaatatctaattgtccaagcacaaaactgtgcttgaacagactattcattctcattgaattgttctagcatccatgttgaaaatcaattgaccataagttgattatcataaattatttctggattcagttttattccattaaactactatatgtctctcctatgccagtaccatactactttgattactttagctttgaagaagtgttgaaattgaaaaatgtgagtcttccaactttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttatattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaatctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcaacattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgtttctaggttttgttgtttttactattgctatttgttttcctgcacccccacccctgtttttttttctttttttttaattatactttaagttctgggatacatgtgcagaacatggaggtttcttacataggtatatacgtgccatggtggtttgctgcacccatcaacccatcatctacattaggtatttctcctaatgttattcctcccctagctctgcaaccccacaggccccagtgtgtgatgttcccctttctgtttccatgtgttctcattgttcaactcccacttatgagtaaaaacatgcagtgcttggctttttgttcctctgttagttgactgagaatgatggtttcctgcttcatccatgtccctgcaaaggacatgaactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggtgatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgccattgaatctgcttggttaacttaatagttagccaatgacagggcagaggttttcttaaagaccttgaatcaataaggctttttgtttttaccctttgctaaggggctctgttgtgtatatcgggacatatcctcaattctcaagcaggcagttttaaactctgctatggccttcacctcctgtttttaaagagacatcaagtcaactaaaggtgagcacttagggccttcttagatatttcctggttgtgtgtacagctctgcccatgtgtatggccttctaagtgtccaggaatatattagagctttgtaaagccttcaatggacatcttattccctagattcttttacaaaggtttttgtccagccttttatttgccccagttcatattgctacttcaggaaattgcaaccttaaaaatttgccactgattatttttgacaaattccctggggagtaggacttttccaactgagcaaaccctgggacagatcaaataacaacaaatcctataaatggaacttttccagatagcttccaggcaattatttagggatggagctttttaaataactctaaacccagtctgcaccctctactatgtatttggctactggttttcacagctgctgtgattgtgaggttgttcatgttcaaagatgctgcagagctatgaagaagaggatggtcatagggcaatctaaaacagcacagagtttgccattatcactgagattcaacttttttattgaataaacacccttcgggttgctgcaaacctcttgtcaatttcctgtgttctgaataagttgatttggcaatttttttcagagttctatttgcttttctatagcagtagatttttgaaggttcttattctatcatacctgaagtttccccaccccaacacacagcattatctttgaatgtaaaaaaaaatggaagcatcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaaaactttcaatagccaatactttgagtagtggaatgctttttgatttagggactcttttgagaatctgatgaaatcatgtgtcctatttccaaaaaaagtacatatttacattatttgtctataatttgtaagcattcaattaaattaattaatcaggttaagaactgcaaacagcatgtcttcatcaatgtgaagacgtggagaaaagggagagatctgggaacttcaagcccctatatttatacagaagagaaaaagatgcccagagaggaaaccacttgcccacaatcatactgatggtaacagacctgagccacatccaggcctccaaactcccaggtcaaggctcttcccaccaagttaccttgaatcatagaacaaatgattggcctgtttaggttctccaagactcttagaggccctgtgccaaagacaacctctcattactgtgacttctctgactggttctgacctgatttcaaggatccttgagataggaaggtagagggaaaccagacctgccatccaactggtatttactaaatttagatgttcacactgtgctcagcctgataaaaggcaccaagggttcacagaaaaagcccaagacacagacagacagttgaagatctgtcacagacagctatgaagacatgactacaaaacatcgcagcataattctgaagcaaccaggtggtacctggggtatgcacactagaccaaggaaggcaaggagaatctgatgcaggtgtgaatgtaaaggcaaggctccatggaaaaggaaagggaatcaaagaatgtgcagaaagttaaaaaatgggggaaagaatagaaggtatttggggagcaggaggagagtggacaccacatgaacaaaggcaaggagaagagaaggaggacattgatagggaaatagaggaccaggactgacaggaggtttgccagtggtttccttgcatacttccctaccccatggagcccctgcaagcagccccagctttggtgtccctgtccctgggccaaccccagaagctaactatgcctatgtctacttgactctccacagcttccctttgctgaaggtctgtaccacttttatcacaatggccttgcaaaggccaagagaagacgcagcctacaccacaagcagcagctggagagagaccccagggtgagttttccccagaaacctgcctcccaatctctgctgccatggctgagcccaccaagggggtgtggaggggctggcagggaattttgaagtaaaggcacttaatgtactatgatagggcaaatgaatgctttgcagagtcatatcagggactctctgctcctttgtctctgcataataaataatcacaggcccctttgtatggctggaggaagaggaaattgggataccacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttctagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaatcactaggaaggaaagtatgtaataactcagacaagttgttctctgtacattgaaggcagcgtaacctctttctcaggactctcagggaccagctgatgaaaagcgtgtcagatgtttgagttaaggactttcacatgagattcttttgagctgatagaatctgaaaactcattcttgtggggcttttcatgtgaacatttccctgggtttaatttgggcttcaattaggaattcagataaaacagtctctcagcagattgccaaatgacaggccacaggcaattttttctttaacttctcaagagttcccaccttccctaaagaggaatttctgctctaggaagccactttaactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatggccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgggactaattgggtaataaaaagaagagatcagtcactggtgattctaatcatttgtctttctcttcaaaatattatctgttatcaccaaaaggggtgcctatttccccttcattatctattataaggatccaggtagccaattgcctctatctggtagttgtaaccatctgccttgcccatgaagaccaacagaaaatagcagaaaaactaaagaagaccaagtatcctatatcttttccctatcttgtcatcaaggttaaatgctggggatgttgtcaataataaactcattctaggaaaataaataaagcacaaaaatctcataatttttttcaaaacgaaaaaaaaaactgctaatgatgactgcctttttccaaaatattagattaaggtctgagtctttcctgcatgatgttctcgtggttgtctaattttggcatctgctgatagaaaaatagagtggcaactattctgaaccaaaaatcattgactatgaacagtgcaaagatagtaaactaaagattctgccttgtgggtttatagctgttaaacaaaagggtaaataagtctagagtaggaataccccaatttgggggttctcaaacacattcaaacaggttgcaaaaagaaaagtaaatgaaagaaaaagggagagaccaagtagccagaaggaggtccaggcttttatgtcttacatagatgtggcaagttatgctttataaacacagaatttaagagtaagttgttttagcattccctgaaatgtactgtctcctagaactgctaacgttaactacggttgcagccccagcccccagcttccttctccttcctgtccctgcaccacttcccagcctgtctcactcactgtctacaggcttgtggtaaggaacacaaagcccagggagggtggtctgagctgctattcgctttcagggcttcatctactgaggtagctttttgaccaaagaaacctccaagctctgctagcaacccaagaaataaaaaagaaaaaggtagaaacccaaggtactttttggctttttttgacttcagaccagaaatttcaatgatgtttgcctctcatgtaacaactaatttttatgctaaaaggaaaacagaaaaaaaaggactagaaagagctaaagtgctactttccatgtgctcatctttgttcatcaatatgcagacaatagctaagaaaacagattctgatgtagactgtgttaaagatgttcgcttctctttccagttcttcctgctaaaagattagctgactgccaagtatcatcatttagatgctaaaaagcaaaagttgtgtcttgtttatttcagtaatatctttgcacagtgagatgttcaggaaatgactgagcatgtcaaatgaatgaatgattactattttttcttcagggttttaatccatgtaatagtattgcccttctcattttatattttcctccgtatcccaaaatttgtctccattaggaaataaaagtactatatagtcttctccctagcacctcttttacatacattcttaattgtgggtaacagaaaccaatgactgtttcattacttccaagttttatcacaaagaatcccatgaagaaccagttcttaatttccaaaacccaatctgccttcttcctaatcatattcacagtcgtggtacaggcaccaaagcgggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgccaataacccacaaaatttagcttcactggataatataatcacttcagaaatctcataataccactggagcaaaagaaaagtttcctattctttaaaatcaactggacatgatttatatgatttgtgtgtattgtggccaaactctccctttcaattatagtagttaattatttgattatttattataaattaaaagggaagagaagggaaaatgctgttatcttttggaaagtctattttcttttctttctttctttctttttttttcctgagatagagtctcactctgttgcccaggctggagtgcagtggcacgatctcagctcactgcaagctctgcctcccgggttcaagtgtttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggataaggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctcatggtttgtaaggagacttaaccactccatggtgctgctctacactgatttgtattccataattttccctgctcctctgcacaaagagaattatagagcaggaagagtcttaaggaaacattgattcagcccttgaccttgaagcattaaaatataattttaccattgaggcaaaatagacccagagagagagaaggtgacttccctggggccacacagctataactgataggaagaaaataaaactcgtgactcctctcaatacgaagtctgatttaaataaaaaactaagtgagaattgatactgcttatgaatctgtcgttctttaaacaattgtttgcactaattagtcactgaattttctcaattaaaaataatgtgctgaaaagaagtgaagttacctcctgagtttatgtcacttatgtgaattcagtgagctcagctataaatggaaaagtgaaaaagaagagggaaataaaaagggcggcacttgagctcactgttctgctcaatttgcttatgccctggagtggccttgaactgaaggcagctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtcctgctaccaaaggcaattctcagtgaaagaaactctgagccacatttagcagctggaggaaatgtgtgagggccctaaagaggaaatctggagagtgcaccacagttttcattacacctgccatgcccacttcactcaatttgtctgtaaattcacatttgattcaagaggcattttctgggatctttgacctttctggaagagtggacatggcttcccagatcaggagctctccgtgcccaatccagctccccatccacccctgctgcccttttccagagattgcactgaactaagaggggaaaacatgaatctgtaggcacatgagctggaccatattttgaacacaaatagtgaagccaagagacccaagtgaaacagtttctgacctaccctcccatctgtggccaaattcattttctagataacatgccaagaggtcagcgggtgtaaaccattcatgagtgatgcaagttgagagttacttgacagcatcaggaaaaggagaaatgcaatgggggaggtatgcataagaagcagggcagaggtatcttcatggatgccccaacctgtgggaaaaattcatctgttctaatcctctgctttcagaatgtggcagggaggactttcagcatctcctctgggcattgcagatatgcctggcttcccaactcaaagagctgctgctggtgctataattaactatttgtggggaacaggggagaattatttactacagctacagaaaggcacagggaaagctgctaatgagtaagcctggtttttttctagatgctgtttttttctagatgttcatttttaaatgatgggtactgttcgtgctgtcatgcttcctaaaggaaaagcgggaactctctgggaggcatcatgctagcaaagccagagatctcttggaagttttaactttctttgggagaattcttacaagccctggtatagagaaaagttaacacagagaaaattggtggctctgtatcgtctttacaattcacaaggtgaagagtctctaatggtgggctagcaaacctttaggacttcctgggaaaatcttagatgtttgaagggcaaaattctcctgatctgcctcacctgattccctccccaaccttccccaagatgcaaaaggaaatgcatttatatatccaatgtgtatatatatatatatatatatatatatataatgcatttatatagcctctattatatcttctaaaaatgattatatgtgtatgcttattaaattcataatgtaactctcttatttagttgttggctagaaaaccagcattcattcagcaaatagttatcaagtccaaactatatacagggcactcttctgcatactgaaatataacagtgaacaagacaaagtcctcctcccagggggcttgtatactagtggcaatgaaggagagaaacaaaaaacagatgaccaagcaattgtatgaatggtggtcaaaatgctatgagaatgagtagagcagagtatgggaagagggagagccatagaggggtgtttctattttataaaaagcatccaggtttggctagtctgggaaagtggcatttaaatatagacctgaaggagatgaggaaggtattcatgtggatatctggagaaagggcactccagacagaggaaccaccaaggaaaaaggcctggaatccaagacacacctggtgtgttccaggaacagcaagaatgcgagtaaagctgcaaaggaatgagccaaggacagtggggaaggagatgaggttagagaggaaaaataaagcaagatcatgggcgacatgataagctggggaaagaactttgaattgactctgaatgagatgtggcttctgtgcctatgggcaaataatagacaatggggtagaggtatggatgagggacaactggactagagagatccatgcaaggtgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagaggaagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagataatgtgaaatgaacagatggacttaaggatctaggagagaggtcagagttggagatataaattgagaggcatccatctattgttagtgttcaatgccaggagactagttgagcttacctacgaaatgagtgtagatatagaagagaagatttgtgggactgagccctagggtactctaagatttagaagtcaaagagataactggggaccagcaaaggagacagaaaagcagcaagtaatctagaaacaggatcagaggtcaagagaagaccaactttagccattgtgttctagctcgtctacattttaccatagtaacttggccatccctataattatttcttattagaggtatcaatgtttcttcacttttcccctctctgatctatttttcaaacgctttctcaacggatattgaaatacatggttcacacatgaacttatgaaattaaaggatactgatgtgtttgggctgggtagtgtgctttaaagcagcaggaggtcacatttgactcagaatgttgagaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttaaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaaatttttttaatactctttagaactctttctgggtattttaaaattggtttagctatttttcctttttgatgcctattgacatgtttgtgatcacatctctttctataaacaggtttcacggtcttaaagccaaaccaagggaattttgaaaatgagtggaattgaattcctgccatttccagtaatttcaaagctttatgggttcaggagaggataacagtgcagccaggtctagaaatgagtaaacagcagttaggcaaagagattcatgtctgaataacaacccaattgctggagtttatctaattggtttgccattatctgtaccaaaaacattgtgtttttcatcttctctacgatgagcatgtcccatttagcaataaagaacttattgcttgagagaaaacaggtaagacaaaatagttttccattccccctgaaaagggagagcagtccatcccaagtaaagaatagtttaatggatgttaatttttaaggacaacttagagaatcaacatgagaaagcttcttctcccaacagaagcaaagcaaagcaattaaaacctattgtgtggaaagagacccaaataattgtctattagggagaaaaggaacatgatagagtccaatttgaggtcattcttgagttccaatacttacactgacaccaattaactgtgctctccttgaacaaaccgttgtttcccccagtcttcagttctcttgtctgtaccatgaggagtgtggactagttagtctgtaaaatgccctctgaggtcctaaatctgagattccagggactaacctgaagcctctccaactggttaatatcaaagccacgactaaaacccagcaattctaaccagtttgtgatccttcctttacatgtctttcttttcatctgagaaatagggctttttctttaaaccaatgctataaagtgtttgcaagaactagcatttatatgttggtatcctcaacttatagaacacaatttcaaatcctgtactgttcaaaccaattcaatagtaccctaaaattccatttcttgtctcgggggaaatattagattatgagatagaggttattcatccacttcaaagataatagctcctctatcatgttttataaattgggatttggtttaagatttccctggtatcatgggtgtgaaggagtgggggtccttaaaataaaaaataatgtttgaaaacctttgatagctaaacaagttcgattctttagcctagtcaatcagtgtatccaacagggataacaagcttgatgcctacacaggccatgcaaataaattacaaattgaggtgggtcagttgtaagcaaaacagctactcaagcaagagaataaacggcaaaatgatcttctcctctgtgtgaggaacacaacagagagtggtggggactgtggtgaacctgagtgtacacaccctcttaaaaggaggaagcggattcttattctcagctaattgttacctccaataatggacgccctggttgccacatctacaattttgaagaaaagtagcaactaccaatctttgtaaagattcttttatctttttaaaaaaattagtgattaaattaaaatttcttaacacactgtccaatctaaagaaaatacatcatcagaacaaatttttccatgcactaccattttgcagtccctactctacaacaccccaggacaggatgaaacctgatagaacacctctatgactagtccgtgacttcattatttgccaaggtagtccacataaaagttcttccttaagggaattccaaagctacttccttgtagcgttggttcataatccacattctcctttctgaggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttttggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaatgacaaagttcagaaccctctgccaggatgatatgaatctattaatatagactctaaggagtatttcacactgaccccatattaaaaggaaattctaaagcacccaaagttctgaaaaatcattcaagttaaatgaaaaaacagtgtctcaccagggaggctatttgaagactgtttatatggcttaactccaacactctgaatctggttgatttgtgtgtgtatatggctctctgagaaatcagtttatttgccatggaacaatctaatttggtcattcacatgactaaaagtaccagaccaacatgttttcaatccagtcccttgaggcaatttgaattctgttgataacttgtccacacacctgctactgatggatgtttcgtcatgaaattttaatcagagagccaaaatcaatgggtaattgttaatttcaagggtgccaggtgacactcaagtgtagaccaaaccaaatttttataaaacttaataaagtgatttcctttaaatgagtaagtcaagatatctcagacatagattaattcagctaaggatcatattctccagagctgaaatattaactatcattgaacttctatcagtgcttccaaaataattattctaacacttattcatgtgacatgggcaagtcatttaaccttcactaattgtcttcattttatcatctctaccattaaataacaatgaaagtccaaatgactggaaataaattgccttaatttttaatccctatcatggaattacaatgaaagtgcaaatgtctgccaatacatgcctaagacttcaaagctggaagtatgactccatctaaagtacatgttaatttcacaaatacattataactttgccaaagcagaaaaggtgatagtgtcacctactccttttgcatcttcttagttctctacttgttttccttgcctgcccctactccatgaaaaatatgggtgtgaattaaatcagtgttccttaaactgtgttacgctggagtccttgggttttcttccagaacgttgtgaataataaagatattagttaggataaactagattacgctgcagtaacaaattaacttttaactcccaatggtttaatatacaaatgtttccttttcactgtgctacaagtcacaagtccagcatgagctggatagatttgattaatataatgctgttgaaagtttcaccatcttgaaacgccactatcctagcacatgaattccaggacactggaagagaaagaggaagtgaaagcataataagctctacccacttgtaaatgcctcagcttgaaaatgttacatatcactctgctcaccacccattagcgagaactaggcaaaatgaatgtcttaatgaaaagaagctaagaagtgtggttctcccatgtgctcaggaaggagagacaaactggatttggggagcagtagaagtcccttgcatagtgtattttttattcaaaacaacaataaacatgtgaataaaagcccatattctattattctgggtgatccttgggattgagactttcccataagttcagcactcatgtttataattgtattggcagcaatactgccatccagtctctggctattgagaaagggtgggatacaccccgggatgcttctgttgtcctaaaatgattggaacatctctcttcatgtgtgaccttctgcaatagggcctggctcctcctctatccataggtagagtctatttattcacccatgtgaaggctctgtaacattttatctggtagaacgtggtgggagtgatactgggccaattctgggcatagccagcccctacctgacctggtagcttctactccttcctcagagaagctaaagaattgtgattaccctgagaactccatgctgtgagtaggccaagccaggtggagagattgatataccgtggggagagagagaggccaaggagcaccaagataccagaactatgagtgaagaagccatctcagaagtggatcttttagccccagtcccaactgctgttacctggagacaaactacccagtcatgtctttcctgaattcctgacccaaaaaatcttgagccaaataaactggttgttttaagccattagtatgtggtgtaatttattatgcagcaatagataacaagaagacaaacgaattttcccagcagtgcagaggggatgagtggtggagaactgagtcatggcataaagcacattaaaatgaaccccaagacactacaccccagcagtctacagcatagtcacattgtgttttaatcagcattgcttctttggctattattgtttttgtggtgtttatatttaactcgtaaacttgtcttagttttatagttgtataggaaccataatcattaggagttgttattctatcttattttgtgcatattatttatacatatatatatatatatatatatatatataatgttgggcgactaatgaaaaatggttttcttataaaagagtccctttcttgtttaaatttattcgagtttaagaaatcaatgcatttgaaaagatctaaaagaagtaggcttttccaaagtataaactttggcatgaaacagaagcaatgcatcccttttggtgcagtgatatcagcaggtaacagcatacgtagtgagaggagaatcaaaggaagaattaggagttccgagttctaatcacagctcagccatttattgtctatgtgggctccaggtaaccacttagttttatggtcctcaatgtccccatctgtgaaatgattaatgacattacctgtgcttattacatggggttactctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcaaaactcttgtccctctctaaattcttgtaaccttctaatctctctggagtgtaaacttgtggccaagattttgagctctggataaattctagttttaatctcaggtccaccactcactcacttgccagttacataagtttacattgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgattacatggtgactgatactgatctctgaaacttgcctatgtagtagcatttttgttcactgctgtcctttagtaattctacataccataaaaaaattagttatgcatggtggttttattttcatcttaccaaaatgatagtttacagttttaaaaatcaaatgcaagccttataattaaaaacagaagcattttgctccagctttctcaaatccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacacacataccatgtttatattttttctggcttttgaatatagatgtatcacaagatggggctaggttaatattcagtgttcatattattgtgagtccttaagtactatttacagctgagccatttataccaataacatcccttcctctctcaaacagctttttgtttccctgtagttaataatggccctgtgatgccctctctcaccactcctattcaacatagtgttggaagttctggccagggcaatcaggcaggagaaggaaataaagggcattcaatcaggaaaagaggaagtcaaattgtccctgtttgcagatgacatgattgtatacctagaaaaccccatcgtctcagcccaaaatctccttaagctgataagcaacttcagcaaagtctcaggatacaaaatcaatgtgcaaaaatcacaagcgttcttatacaccaacaacaggcaaacagagagccaaatcatgagtgaactcccattcacaattgcttcaaacagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagtttatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagatatatagaccaatggaacagaacagagccctcagaaataatgccgcatgtctacaactatctgatctttgacaaacctgacaaaaacaagcaatggggaaaggattcccgatttaataaatggtgctgggaaaactggctagccatatgtagaaacctgaaactggatcccctccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaatttttgcaacctactcatctgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacacagttcatgggactgtaaactagttcaaccattgtggaagtcagtgtggcaattcctcagggatctagaactagaagtaccatttgacccagccatcccattactgggtatataaccaaaggactataaatcatactgctgtaaagacacatgcacacgtatgtttattatggcactattcacaatagcaaagacttggaatgaacccaaatgtccaacaatgataggctggattaagaaaatgtggcatatatacactatggaatactatgcagccataaaaaatgatgagttcatgtcctttgtggggacatggatgaagctggaaaccatcattctcagcaaactattgcaaggactaaaaaccaaacaccgcatgttctcactcacaggtgggaattgaacaatgagaacacatggacacaggaaggggaacatcacacaccagggactgttgtggggtgggaggagaggggagggatagcattaggagatatacctaatgctaaatgacgagttaatgggtgcagcacaccaacatgacacatgtatacatatgtaacaaagctgcacgctatgcacatgtaccctaaaacttaaagtataataatgatataaataaatagataaataataatggccctgtaaccccaacactttgggaggccaaggtgtgtggattgcttgagcccaggagttcaagaccagcctgggcaacagagcaagacctctgttgcctttttttttttaacttgctcactttcctatctccttatgtctaatttttcccctacattgtctaatagtttcctaaattttttcagtatggtcaaacgcatcccctaaacgatccattgctttatttggttgtcatccaccctagagataccatcctttgacttcacgatgtagtggttgctttctggaccagctcacacctcttaccctagcacttccttcactattatcccaggaattccctgttggctggatagtgttggattcctctttcctggaaccccttcatttccctttctcagattatttccgcattccgatgcagaatgtccttcatgagaggcgactttttaggacttttaatctgcgttcaaatcaattaatagtttgacggttatcaactattaggttgggaataaacatctctcagaaatttgcaagtgtttctctgttatctttgcctacaatggtgccattgggaggtcaagatcattctaattcctgtttcctggtattcctctttctctctagaatttgctcttagttctctgcattttgtagtgaaactcgtttctcttatttgatttttttgtttaagttcatttttttccatgaaagctatgtttctattgacatgacatttgagtattcattgcaaagctttaaaatgtgtgtggcccagtggtggctcacgcctgtaatcccagcactttgggaggccgaggcgggtggatcacctgaggtccagagttcgagaccagcctgaccaacatggagaaaccctgtctctactgggcatagtggtgcatgcctgtaatcccagctactccagaggctgaggcaggagaatggcctgaacccgggaggcagtggttgctgtgagccgagatcgcgccactgcactcctgcctgggcaacaggagcgaaactccgtctcaaaaaaaaaaaaaaaaaaagtgtgtggcccatccacatgcaaatatccttgtttctctgataaaattgctgattgtattcttgaagtgttgattcaataagtgttttcaaaacaacacttttttatttttttattttatttttaattacaaaagtaatgcatatatgcatttttatgctaaacatccaaacaaatgtagaagacaaaaaaaaaaaacacacttgttccaaatcaagcttatatcctccgcagaagaaaacactattatcaatttaatgtgtagctttcagacattttattatatgtcaacatggttatacatgcacatatggaaatagagagtttaatttttgtggtaagagttttttaaccaaaattgaattgtatagtatatactattttgcaaattcctttcttccatttagtagtatatcttagagaatttgacttataagtacacacatattgaatttttcttattaatgactgcataagattccaaaatgtagatatactatggtggaaatttctttcaaacttttcactacataaacaacattgcatgcttctttgtgcacaaatataattgtttctttaggatagctgtcagaagtgaaattgatgggtcaaatttgtgttttggtcttgtaattatgccttatcccagaatgatgccatgtggaagttagacacaggcccttgtgttttagaaagtgtggcagagccttctcaacttcagagtcacccagaggaagttataaaagtcagaagggacctatggctacatatagtgggccatgtctaataagaaggtagttttgttccagaattctttaggtagggaaatgctctaacatctgttagctctacctaagacaaatagaagattctccattaattccccaagtcaggaagtgataatgaggtacacctagtgcctgggtgtttaagatcaaaatgatagctgagtaattaattggcactttccatgtgccttttgtctttctagctggccaaataagcatatctgacagtgtgtggcaaatgataaactcccacaccaaccatgtggaggcccgtatctgctgcaaaaatcagttgttccgatttgcttttcagcaacctcagtggattgttcctttctatccactgcattttcacttgtctggaaggtctttcaagcaatatgactataatttgcaaccaaatctgatctcccgccatatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctgaacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaacttggctggtatggcttctcatccctggcccaccttttatcatactctcacctttatgtttgctgccccctgttggttgctgtgaatcccagtgaatgctgtatgttagccaagcaattgcaggccatggccagcctatgcagcaagccaggtgttctgataccttttcttgcaggaatgggaatgtttctgaaccctctggaaagtgccctgccactctcacctgattctcatgcttactggtcccacctatggataaagattctctctgggaattgcagggaagctgccattcctacctagtatgatgtcccagtaagccacttgactgttgcccttaggtacctccccttccccatattattcttaatctttgaccttcccagtgccattcacacaatccataacagttctctcctaccctggaatattctctattagtctgactccacctttcaggagtttctcatggtgtatgctccactgggggcacccattttgctttctaatgcagttaaggatgtctatataggcatgtatatatttacatatatatatatggatttatgtttatatagctgtgtatctgcacaaatggcagacagacaatccctacctctctctccatacacacacacataaacacacacacacacatatgtatatatatgtatattctgcatatcatattataggatgatacatatgtatgttaatatcaaagggttcaaagaagggagaagacatgggaagtggctcttagtctgccatttgcactgagtcctctgtagctttaagaagaaatatcgatttatttcattggttgtgcttgtttttgacccaaatgttcactttagcccatggtctgatcttttcaaagacaagcttactcaagcaaagaaagaggaaagctccccattgtcacgtcaattatagataagttcatgccaacataatacctcctcctcatcttatttctgtagctcaggataaaaagataatctccaaaggaggcctaaaaaacagccacattaattaaaggaaagagattttttttttctaggaagtgcctaataactaacggacaagcaaaggagactcattagtggaagtatttcctttgaaagggcacacacgctgtgaaaaaaaaaaaagaaagggttatgccaggcttttctctttgtaaataaagtgacaccttttatctttttttctgttaataacacaggctggggagaatgagtctgagggaggcttgtagataagctggcaggatttgaagattattcagatctttagtttcttatttctctatgttctagggtaagacttttcttcattgttcatggccttgtataaagaatggttaggattggggatcttagggagttaggcttaagagtggtggcttagactccattatcccagttaactgatgaaccatttgccatgaacacctttggtaggtcatgctccatttagcaactgggcagggaatccgatcacctcaaacactacattcaaacagaaaggcaaaagatgctataaaagctagatggagagataggtggatacacagataaataaacctgatagaaagatgatagatagagatataaataagtaggtagataaatgaatagataggtaaagagactacagaataattagctaaattctgtagaaagacctaaaagggaaaagatattcacaagcgggggcattcagggtgagtttgaatctttaaggagatttcaaaaaggcacagagtgatgtctaggatttgcatgataaactggaatcttacttggagcacattttaccaacaccccataatgaaggttacacacagaaacagcctcagactctccagaaggaactgtcgaatttgatgagcacacatagagctagactaaatggatggggtgctgaggctgggcttccataccttaagtacctacgaatcatgtgagtgattaaaagatttcttaggtcaggcctaatttctaatcatctctcactcaagccagcatatggccactgtatgagttcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacagataaggaaaacaagcctgccaaatgacagtttgtcattgcaggagccatggccaaaatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttcagcagcaccaggcttggccccgtatacatgaactctgactgctccatcactaacaaggcacatctaatctggaactgtgccttatgctttgctaactgtgacatacagcacactattggcaatggctttcgtccactccatccaccatcaccactggctctactttgcaggagttatctgatccattttctctgttgtttccttgtgagggagagcagacatgcacaagctattgtcaaaggacaaattacaacaaatttagtttaaagatctcgctgggctttatagcaattttagaattggtcaacacttaattccataaaatagaataagtgttccaatgagcctagcagaagaggttggctttctagacagagaatgtaattgtactaggtttgttgcccgatgtgcatggcaaatcaatatgccaagacactggattgtgacagagaagagatttaaccatagggccaccaaatgaggaagagggagggaaaatcaaatctgtctccccaaggagtttggggatagagtttttaagggttatggagtgggctgaagcatggagattgttgacggggtgaagagtacagagtgaagtcatgggacagggagataaagaaactatattctcactctgatttcattactctgtggggggtttcaaactggttggcaacaactgttttgctggaattcaggatctggaaaacaccttaagcaattcttaaacaaaagtcttgtgattttaatgtcagagatcttatctataggaacaatggggatgccagtggtcaggatcagtgctctgtgactatcaggttcaaggaagtgggtaaaagtgaaggctgattatttactcttatttataactatatttctgtccagaattcttcttaaccctgtgaggatggcttcaagaagggttgaagaaagcagaaacaaagaacaaaggatgtattcattatttttcaaagttactttttcttgtcgggtgggaacagggaaatagaacaatagaaaaataactgattagttaacatcaagtcatgtcaggctacttattttgtgtaaggaatacagcagaaggaactttattaccatgtcgattgataattaaaactgacctgcttggaaaatggctgttatttctgtctcccgatttctcagaaggctggataatgtcatagtttaggtttggtgatgtagaactttagcatgggtgactctattttgatctttagtctggtctgttgaagtctagtgcaaaagtttagtccaaaacaacaacctcctataatttttaacactgtaaatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtactagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatgaagtaacagctcttcctggagccccattgccaaaaactagcaataaaggaagaccttactacctaacacatgtggctacttgaaaattatctgaaataaaaacaagccagaatcaacataatagtgtataacaaaacccagatgtctcttgaataaaaggttaatcaaatgctaatgttaaacgaaagagtttcaaaggcaggaggaagaatgttagagataaatgaagaaattaggtgcagcctctgtatgacttggaagagcaagctctctgcacaggatcgtttttttgttttttttaggaaattaagcttttctttcacacctagaatgtgtcagatgctttataagaaaggcactaaatacttttccaggagcttaatcttcaaagtacaatctactaagatgtacctggaggaagaaaaatgtagcaattcttgcaaagcaatgctttggatattacctttctgccatattttggtagacgtttatatataaatcctggtttggtcaggaatccagtaagaatttgcaatgtttgtaaaagcccacctgctttgctcatgaattgcagaacagctcatgcctccctccacagcaccctctgccctggtctccatcccagtgaagggggttgtgctcacagtctgtatcagaatcagtcagggttctccagaaaaacagaagcaatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaaaaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgttaaaatggggaggaaataagagaatgatacaaatgaagctgaggaagtaaacaggtcaaggaggggagggtggattctttcttgtctgctcaagcataggagcaagtggggtcatgcaattttattttataactagtggctaagcatccacttatcttatggaaggaggtcctcaattctccaagaaccctggtgcttcagagtcagcagtgccattagcaaccacaggtggcgctgtcctttctcaggagagcaccaatcctacaactcctttggttaagattataaccctggccagccagtattcccccaagccaccctagtgggaggcctggggagccttcctaagcccctgggctttgtgtcatacctggccataaggcttgcctgccttcatgctccagatagctttactctggtggcctcgttgcccttgcctaacacctgaccttgatgtaccctcccccagctcaccctgaaagagcagcctgactgggaatctggggatggggtgtttttcctttctgtcccagaacgccctgtcttcctcatgcaaggtgatgagctctcacccaagggctggctctgcaggctggatcacacagctgtacatgcccttccccacttcccattctaaatccacctgatcaagctggactccttcaccaggcccttccaggaacggacaactctgctctgaggagatcccttctcatggaggatgactcagcatgtcctttcatgcagcttccatctaacctctacctcagcaggtgtctgctaccctagggcacatgaggatgctcccaaagccagcagaaatccaggacagcatttcaagaaggggagaggccagggattctgcaacatggtctgtcacagaggagggtggcttcgatggacagcaatagcaagaccagagcaggtgcaattccaagggtgcaaagacagctctggatgctggagaaagtcaatgacagtgagtccctactcacctgctccaccactaatggctgcagcaatgccacggctcatgttctgggctgaattgtttccccccagattcatatgttgaagtcctaacccccagtacctcagaattagactgtaattggagattgggcctttaaaaggataactcaaatgaagtcactagggtgagtcttaatccaatataatgggtaaacacccatgagaagggcaaatttggacacagacacacagaagaaagaccacaagaagacgtaggagaggaaggccatctgcaacccacagacagcagtgtgagaagaaaccaacccagatgacaccttgatcttgaacttctagtctccagaatcgtgagaaaataaatttctgttgtttaagccccccagtctatggtactttgttacagcagccctagcgaacaaatatactggcttcaatctaaatcaacttgcagttagcaatttcaaaagactgcgtgaagctatcccaaaaggctatccgcaaaggaaagctgcgttcttgtgcagtactattaatagattatagaaggaaataaggatgacagatgttactggaaaccaccttgtgcctagaaagaagcatttcctttctctcaaccgaaggacagcagcaaggtcccagatggtgctgaataagcaagtgatcaaatatcttatcattttggatataaatcaatgcagtgatattacctctcaaactttgctcaatcacttagccttgttagattagtcaatatctaggttgaagagcaaaatgagaattggaattggccttttcaaagtcagatttgtgtacctaaaacaagccaaattagttttgcattaaaaaaaataacacagcaagtcacatatgcatatttgagggtcactatgaagctccttgtttaacaactaacactgattgtaataattgtgccactgtggttctgaatgtcaataatgggagaggttctgtggagatggggtatatgggaaccctctgtactttccactcatttttgctgtaaacctaaaactattctaaaaaatatagtttattaatttttaaaaactgaaaatagtaactatttaaaaatactttgactattcaaaaaaccaacacatcaattagtctgtatctatcaatatatatattttagagagtatcactttaaaaataaaaattacccatacccaaagctaaacatcacttaactttttttgtttatatcttttcagtgttttgtctctattttttttattttacaaagctgactttctattgtaaaatcaatgtttgttttactttcctttataatatagcttttgaaagctgcaatgtttttcattgtatggttatagcatcatttatttaacaattcctctatttaggaaaaatggccatttctaattttttgtagtaaatgagattcaaaaaacagtgtcaaaataaattctcttttgtactctttaatgtacatctgattatttgcagaagataaatttctagaagtagaattggtgcattcatcagtttgctcattgtttaggttttttaatacatctctgtcaagagggtattattagcatttttcctctgtcatcaatttggcaggtcagagatggcatcttattttattttaatttgcatgtacttgatttttagtgaaagcaatttttttccacatatttctcaatcatttatagttttctttggtgagaagacaggtaccttgagtgtgtggcttacagcatctatcacagatcactgcctggcacacagtaggtcttcagttagtgactgaattaatgatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggatgttatcatcctgtttactaatggaaatattaagactactcctagacgttaaataactggccctggtcatactctcaagagacagtagcacctagttctgtctgatattccataagccttcacctacagtgctatatcgcttccttttaaattatatttatgtgggatttttgaaggaggtaattgtctttgtctattttctgctgctgtggcagaataccaaagactatgtaataaagaaaacaaagaaaagaagtttatttggcctacagctctggaggcttggaagtccgagagcatggtgctggcatctggtgaggaccttcttgtgttaacccatggtggaagggcaagcaagcatgtgagatagcgagaggaaacggggaccaaactatactttcctgaggagcccacccccacggtacctaaaccatgccctcaataatggcatttatctattcatgaaggctccaccctcatgacccaatcacctcttaaagttcccacctcttaatattgttacagtggcaattaaatttcaacctgagtttaggaggggacactcaaaccatagcaataatatattcacctgcatcaaaaataatatatataggtgtgaagtttaaaaaaaaaaactccttccctcatttgctcatttttacccctacttactttaaataaccactattactaatgttgcacatacaaccttcttgagcctcttttatgtatatacaaaatatgcatatatattcttctcccatctttttacacagatggcagcacactataaacaccattgtgtacctgctgtttagacctttcttattagtacatgagcagcttccttgtttttgttgtgttttgttttgttttgtttttgtttacagacaaatgatattccattgtatgaattgattacattttagctaaccagttcaaatgttacttaacatttgggttctatcaatcttttgctataacacagtgttacatttattgttgaccacatatgcaggtatatctgtaagataaattcccagaaatagaatggttacagcaaagggtatatatatttgtaattttgatagatgctaccaattgtcctccacagcaattgcagtacttatatttatggtacttctgaggtatagaaggtttttattttatcagttagaaattgtgtttggctgctaggaacagagacctaaccacagcagcataaacagataagggttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacattgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaagaaagaaaaaatatttctatatttataagataaaattacaaaagtattaggcaaattaattaacaatatgcatctacatggttaatctatttggaatttatttttgtgtatggtgtgatacaggaatttcttttgtagttagctaattgactcaatatcacttactgattaatttatctagacctgattgtttgaatttattatatacaaatggtttaaaatcaaatatttggattcaatttccattaagcttattgattattaggaagaggagaaattgatacctttacaatgttgggtcatacccttcaagaatatggcatatctcaatttattcacatctggtgggttcttcagcagaatatcatcattttctttatttaggtcttacatatgtcctgtaggtctagtctcaaggctcttatagctgggttattattgtgaatactttttcttattaagttttctggggtgtttttttttatttttgtttgagagtgtctagctttggggcccaggctggagtgcagtggtgctatctcagctcactgcagcccctgcctcctgggttcacacgattctcctgcctcagcctcccgagtagctgggactacaggcgcgcagcattatgcctggctaatttttgtatttttagtagagacaaggtttcaccatgttggccaggctggtcttgaactcctggctttaaaggatccacctgcctcggcctctcaaagtgctgaaattacaggcatgagccaccacactcggcccttattacattttctaaaactttattgctaatacatagaaaagctatgaagtttttacatgttgattttctccagcttgctgaactcttattaattaaggcacctataaaatgattctctcaaattttctaagaagaaactctcataaagaataaataatggttatttaacttgtgttttataatatatttatatctcacacatttttcttgctgttgttttggctacaacctccagactaatgaataatagctgtcagtgtggacatccttgtcttgtttaagattttaataagaatgcctctattttgtttttatgtcctttggcttctaacaaattcccattatcatgtttcagaacattttttatgtttctaatttatacagagattaatcagacatggaaattttatcaactatatcaagtatacttgaaacatgtatccacataatcacgttgcattttcttttaacgaattaatttaataaagtgtattatatgaatagatttcttaatataaaatcattttgaaatgactagattagattttactttgtcatgagattatgttttattattctttggattcgatttgtcaatattttatttagaattttaaaaatctatattcctaagatatatttgtctatagtttcctcttctggcagccttcttctcaggaattgttcagcccaacaaatgaactggaaccttcgtgtttttctgtgcttctttacagtttaaatggcaaagaaaacatgcctcttgatggtcaatgtaactcatttttaaaatgggctggtccagtccctttttgaaagtgtatctttggggtttcaatttcttttaagcttactgtctatttaggtttctaccatttcgttagtcatttttggtaatttacatgttccttgaacgtacttattcacctcaattatgaaatttgttgttgtaaacttgtataaagtattttcctttttttttttttttttttttttgagacggagtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaatttttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcgtattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcagaaatttcactagatgtgatttattttcagtaatcttgtctgtcattcagtgagagttaacaatctgaacactaaaacttttctgcaaatcaaaaatatgtttgcctgttttcctccatctcctctgttctcttcttctcaaactcttattacataggtgtaagacactctaggtctctcaacacttcttaccctcccttcctttacttctttctctttgctctgggataattccttgaattcattttcttatttattagtttggtgtttagcaatgtccattttattgctaaattaaatctggaattttaatagtttttaattgcttggagagctctctttttcctatctcttgtttttctcatagcaaattgttcatatcatagtgatagaagcatccctcacatttcactgacattcaaaattgtaataatcttccctgcattttcagttgtttcagtgaggtctgcatttatacgcagttaacacacacacacacacacacacacacacacacctctctcaagagtttaatgcatgccagatattgttttaaatgccattattaccacttcccaagcaaggagactgggcagagcctggaagccaacccagacagtctgattcagagccaggaacactctaccaccgtgcaataccagcatttgttctttacgctcagctgggtctcctatttcaagttgctacttctacagatttgtccctaatttttctatctgcctcatttttatttacttatttatttattatttatttattgtatatttatttttatatatatttatttatttatattatatatatttatttatttatttattatttattttagagacagagtcttgctctgttactgaggctggagtgcagtggctcactgcagcccaactcctgggctcaagccaccctcctgcctcagccttccaagttgctgggactacaggtgtgtgccaccatgcccagttaatgttttaaattttatttttgtagagacgggggtcttactatgttgcccaggctgttctggaactcttggcctcaagtgatcctcctgccccagtctttcaaagtggtgggattacatgtgtgagccaccgtgtctggcctctcacttttacaaataaagataatgtatccatattgataaccactgtggcctgcacccagcccctcctcaagcaagctgatagcagggcatccacaaatgtgcttgtgtgaggggtggcacagacctggggttcaagccatgccagcttctaagggtacacaaagttatagttccataacctcagagggtgcaggactctgatgtgtttcaaagccccagaatctggtgtctgtccgattttactgctccagcctctgatggccaatgagcagaaatgtgactgccagtgtaaagcagcaagacagcctaagcaaagcaggctcccttgggccacagacgtggcttggcaatggtgagtgccaagggcctctgagcaggacacagggtccgctacacagctcagcgtctcaaaaactcccaacatcccagaacaagacagagttaatcagctacataaattgagttaattagctacataaatcatgaaatataagttgttcttatctaaaattataaagaattaccaacttttaaagataaacattaaataagatgaccttttgtagacatccctactgctgacactgccaaaccactcgcgcccctctcagcacttcacctgtgctcacctggacgccatctgtttcctgtcttccagaaattcttccaacctggcctgtcaaactcagccttctgggttttccagctctgttgcatattttatcctaaatgaacatcccttcagttatttcagcagaattttgatagggaaggaaagagagcacgtgagctcaaatcaccttaaaaatgagtcttgtatttctggcagattttatgctgcatatttttaaattaattatcataattttttatcagaagaaagtgtgagaaggatttttcttggtgaagtcacttcaaccctaaaagtttgggtgaattcacggctactgtaaaggtaagccacaagcccacttacgacagctcttcacagtaagataatgtatgtctaaagatcctccattcgttggactcaaagatatttatttttgttaaatatcatatttccttgcagaccagagagcagcatatctagagagtaagctaagcttaaatgagcttcagagtggcccctttatatatttatttttaagggcatttaaaaagattaatgtatccatgacataagaatacaattataatcgtataaccttcattaattaaaagagctgacgtttaagcagagaagttagtaaacagggtattgtatgcagtggggacagccaagttcaaagtcaaaaaaggagctgtttacattagagaaatagcaaagagtccgaggtagcaagaggagaaggaagcagagagcgatacagaacagtgccagacagagacgtggagtccagatcctgttgggtcttgtaaaccatggcagtaagcttgcatttcctttgaagagggaagtgagaagatctgggatttgggagagtagtttggtaactccattgaggtggtgttggtgagtgtcaggtgctatggtggagttgcctgggcagagagagctatgcatcctcgagcatcatctggggaactaggaatggacttatcatgaatggatccagattcaacactaccgtctgaagcagcactagctcaggttgactggactgtgcacttcaggctgcaggaggggctcagggggttgccatgggtctctttccaggactagcccctccctggagcttgctcattacatggcaatggcaagagcggtttatatactttgacaggatattatttggttcagagtcatcagggttatcctcttcgtgaatgtccttccttatcaatataaaatcatatcatgtaatggtttttgcctttgagtctacttcttccaggataaacactgccacctttactgtcttattattacatcagcctgatacacctttgctcattccttcattttttgccttcctatgtcagttatttttaagctaattttttaaaataacatacaattggattttgcattttgatttaagctaaaagtatttttattttagtaaagcactttaagatattttctatgtattatcaaaacaaatacatttactcttataacttctagactagctcctttttccgccctttattttatgcattatatttttattgctcttttccttcctcttacgctttgaaaacttaatccatctttttattcttctcatggttgtcataaaatataaacatattttaacccattttctctaattataaaatgtcaactatcaaacaatatttattatatcaatcctgagtaagatactaaattttagcacactgttacttcctctgtacttgactacttttcaattttaattgatagaggtggggtttttatgctttgctttcagccaccctcctccacagtctacattttatgactcagcttaaaaggaatggttctcaccacatagaaatggggtgattttggccccaggggacacttggcaatgttgggagacagtcatgattgtcactggtgggaaggtgggtgtttgctactggcatctagtgggaaaagaccaggaatgctgttcaacattctacaatgcacaggacagagtccacaacaaagaattgtccagcccaaaatgccaatagtgttgaggcaggaaaattccattttagaggttttgtggctcttatgataattgtaagttaatattactcattgtatttaaattatttttaccaccagtactttcatatcctcactcttaaatttttaaattcctgtttatccctcgacgggctagaaaatatttttaagtaatttttttttcaagtagactctatagaaaggaggaattatacttccctaagctgccagtatttgagcaaatctttctaacactctcagacacactcactggaagcagatgaagctattagtcagtcattccccagcctctgagaaggaatatttttcttgtagatgttttccctcatatatttgcacatgttacacttccatttgttaatcgcctgtccttatcttacccgtttacctattcctatagtctatgatgcaatacttttatgcattttagctcttgcataatgtatgtgttacaaatatttaacctataatatttaagatatcactgatacttaatatttctaatttttaatgtacagaaagtttaaaagtttatttttttaaaatttacctcactgtctcttccttcacttttttgctagaaaggtcttgtctattctgagatcaacattttcctaagtgcctcatctatttgttttcacatgcgatcattttaagccatgaggatttattttggtgtttgaaaataccctcaaattgttaagcaattctcataatttggtttattaaataattcatcctttcctctctaatatgaaatgctacttttatggtgtaccaaacacaagggcctgtttctgcagtttatgtcttgtttcatcaaatctatcttttcttaccctaaattttatttcaattattttggctgtataatgtttttatatttgccagttttccttcattacaattacttttaacaaccatatttttaattttccttgcccatttattctttcagaagaattctggagcaatttaatccagtttcaaaaaaatagcccttgggacttttggttagaattgtattacatttccaaataccggaagaattattgcaatactagatatcctcagcccatcttccatttctcttttcttctacaatttttatttctttattgtttcctctgagttctggaaatttttcttaagtttaccttttccttcgctaatccaatttttcacataatctgccattcttctggtgcaggggttttgaatgtagtaatcctatttctgttctttatgtgatccttactgatatcaaatcatttcattttggggactctcaggtctattttcataactttgggaagtagaaaaacactctttcccctatcccttgctatatgtctattttggtgaaaagcattgactaactctttggaatgaacaaagctagtcttcttagagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggaaagtgtcagagttcaagggatggtcacaacatccagcctgactcccaccccttctgctgaggcagccatgagttagccccagcagtctccacagttcactggctacacctgccctcattagaagtccacagccctgtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttaggaggatgacattgacatctgtgtccaactcgctgtctctctggatatttaagaagtagaaaggtggtcaagggaaagttgaactttatttatgtctcagtttttatagtgagaatatttttatttttctcatttctcattttcatattttttagttaataaaaatagaaaggttttaaacaataaagtccaagataattcctaaaacactgaatttttcctaatgtgagttgagactttaccaaaattaccctcaaaaggagcaagttgccttcaggcgaagtcctcacaaagcctcttataatagtgtgtaatagtaagtgctctcaaaattatattactcataaaataaatttgtatttaggagaggcataatttcccttaaccttaatcaatgctaattgagctcttagggaaatgacccaatgaaataagtataaaaaggatgaaaagaaacttaatgaagatgtagtcactattgcttgggaaggggcctgcacttcaagagtggggtgtcgttgttaaaaagccttctaaaatcaatttagaaagcaagacactaagattgcagaccatcatctacaggataagcaaagagagcaaatgtatttgacgttagaaatttgggaatgtgaacttaggtcttaggataaaatttccagcactggctggatgtggatgccaagagttctgtatctcatcattttggtggaggagacattgctagcagctctgctctgacaactctgtgtgagactcaaaaagcagctggaggaggaggagggctctgatatcaaaggccccttggaggagttaggataaaatagtgtcaagaactgtgagagtaaaaaagcagtggtttgaaatcaatattccatatacataattttaaatgtgtgtgagtaaacaaataaattaatttccataaggagacatttgactgattcatctacagtccaaagagctttgatatttaagttgcctataaaacattttttggatagtcttcttggagaaaatgggatatcaccttatattagagattggagatcaccttttatttggatttttatttatataaaaatacatatattatgaccaggcacggtggctcacgtctgtaatcccaacactttgggagtccaaggcaggcagatcatgaggccaggagttcgagaccagcctggccaacatggtgaaacccagtgtctactaaaaattcaaaaattaaccaggcgtggtggtgcacacctgtaatcccagcttctcaggaggctgaggcaggagaattgcttgaactggggaggcagaggttgaagtgagctgagatcatgccattgcacttcagcctggtgacagagcaagactccatctcaaatatatatatatattattatatttttttctcctcttcaatttacatacttggtacagcagccttgaccttcacaccaagtcaaagtgtgtgaacccagaaataccaatgtttaggatgtaggcaagtaaaaaaatcacacgttttgtctaacatctctccataggctgtccctgcttaacccagaacttcaggcaaccccaggccttgagaaaacaagaatattcttattgggttacagtaggagttttgtgctcaagtcaaaacaggtgatactaaatttttcttaatcttcgaattccatgaccctatatccactcaacaactccctccaccaacccatgtcagtttctatcaattattctttgtcatttgccctgagcatgtttaaatttaccaatttaaacatgctggtaaatggtctgaaccatttgaaaacaatctgaaaaacaattttttcagattgttttgttgctgttgtttactattgcttcttatgtcccattccttgcctccaggcctcatttttcttcttactgaagcacaccccttggtagctctttcagtaagggtctgtaccgaaaacacttttggagccctttatgtccgaaaatgttcttcacatcatgttcactcttgattaatgtattagttggtaataaaattctaagttcacttcctttacctcaagaaacagtggagctattctctttatcttcatgggtagacagccctgtttcaactcctgaattcacacagagaaccaggatccaggccgtgctgtgaatgagatttgtttgaccccagtcatcagaaaagctttgaggaacgcactatgatgttgttattcagtactggttacgaatagcatggaaagcttcagatctcacccttttcccaatatgttgttggtgttgttattcttgtctcctgtttctggttgaagaagagctcccttccttgtttttgaacatggagatatatttaatattacccttttgtatttgatctatgtttggaatgagaagaaggctcaatgtgagctcactctgacatcttgaaccagagaacttgaaaaaatttaataaatctataatccatttttctcctaaacttttttctataaattctcatcttttctcatttgaatttccccacatctctaatgtcaagttgctttttcctatattgttcaatctcttgccaggcaaagggatgggtatagctcagtgatttaaaaatatatacatatataatatatatatttatattattataatataaccatacatatctatttcatatattatagataattatatataatatatattagtataaccatatatgtctattacatgtatattatatattactatattataaccatatatatctattacatataatatataatataaacatacaatatatgatatataattatatattaatataatatataatatatgtaatatatatgtatggttatatatttttaatatataatataatatatattatattaaatataatatatattatatataatatatattatatttaatataatatatattatatataatataatatatattatattatatataatatgatataatatatattatataatatattaaaaatatatactttttttttgagatggagtctcactctgtcacccaagctggagtgcagtagtgccatctcagctcactgcaacctctgcctcccgagttcaagagattctcttgcctcagcttcctgaatagctgggactacaggcacgtgccaccccacccatctaatttttgtatttttagttgaggggagttttcgccatgttgtccaggttggtcttgaactcctgacctcaggtgatccaccccccaccccgccctcccaaagtgctgggattacaggtgtgaacgaccgtgcctggcctatatatatatttttaagtgagacctctcaatttatgactatatgtattggaggtctctttccagaaccatatatatatacataatatataaatatatattataaccatatatagctattacatagctatatatggttctggaatgagacctctcaattcatgattatccaactgggagtcttttgggaaagttacttcacctctgtaagcctcaggtttttcatctacaaaatggagataataagcataacaatttcttaaggtggttttggagaattaatgatacttggtaaggaaagtgcttagcacaaagtgagcactaaataaacattagttattttattatgacctattgtaagtttttgtgtttttattcacattatgcaggatcctaatgtctagatatatttctgccacataatagccattcaataaatacttatgaaggaattaatagcagtaacagctcaaaagcctaaaagagagaaagtaacagtatattttgagttggggagatggaatttcagcataacattctttaatcagcttttcaatccatgatttcttatctttttaagagccaattactggttaatagatagaattttctgaaacggagcacaggaagctattgtagggacactggactggcaatctgggtagaagattcttttcctcactttttcttgtttacctattttctctacttagaaacttttctgtgttgtgtaatttccataaggcaacttacacatttttttaaaatctgtgagcctgatgggataattgattttgaagtcactccttctgagttttaattgcagctcaattcttaattgtgtgaccatgtacaattgagcttatgattcagtctccccatatgtaaaatgcagataataatagatagcaaaagtttttgcttattgttttcaaaaagaagccatagtagggagagaatttttcagtacccagaagctgcgacaagaatatagttaaaagcaattccacctggcctcctattgtgttttattttgttttgtttctgactgaatcatctgctacggttaagcccacctcagcaggctgcagctcctcccagctctctctcctttcaatctcatttcacaagcctagtaatgcttccattgcctcctcctgttaccatttttttgtttcctacaggttgagattcagtacgttctaagagggagttcagtttctgctccattgaaaaataattatgacaaagcagcattttccaaaatatgtttactaataaatgttaggcaagaaaatgtttctatggcccaggaatttagggaaacactcgtataaataatattaaacagatgtctttatcttaagactatttgacattttaaatatcagaagattctgtcgcttttctgaaaaaggggacaggataagtcacttgcaaaatgaaaatgtttttttttgaggcatctggagaactacttttatgaaaggcacatgttgggaaatgttctgatggagctaaatccaaagaggatagtaagacaagagggatgattggagggaagaagggaaggaatcgtgtgtaatctggtgacaagagcagcaccatcaaaaccccaggcttggctgcaaatctcggctctctgccacttcccagccatgtgattgaaactggtcactttaattcttttacaagctgttttctcatctttaaaatgggtataatactacatctctcaaaaggtcattatgagaatttaattagaaaaatcaagcacatagcctaataagtatgctttcaagacaataaaaaacataaacacagaaaaatgtcttattttccttatgtattttttgcattcctagcatttgcaatggcatcaatcatagtaggcactcattaaacttttgctgaataaataaatgaacaaaaaagctttatcaattcactgaataggtaattaatcaaacctttgcaggtttagcactatgccatatacacaaaaactaaacaaaatattatcattgtaattaagttgaacaggatgcattttgctactgttaggcattcgcattgtgagtgctacagtcttttcttagcctgacatttttctgcaaatgtgttacttccaaaatgagggcagaatttgcatgaataacgttttggtactaaacactgtatttattaggatgaaccatttttatagggctttctaaaacacaattatatggacataaagatggacaatacaatcttatctccctttagccaaagagtattgacaatgcaatttgtgcaaagtttatgtgaattcctgtagttcctcagtcgtttcttggtttgtagataaattatcatgttgagtagattctttgttttcaacttggcattttgatttgttttcttacttgtttacttgacaccaaacaattaaattatgcccccccaaaaaaacgcataaaaataagcccttcggtgactgaacctgcatacagactgatgcagaaaaggctgaagcttcccaaagaggattgtttgaattctcaaacagaagatggtcccaggcaggcaataactgcttctgtctagtgggcattagatttataaagtgaaactgcttttctccaagtttaaaagtataacatgtaaaagtttgaccaggcctcattgcacaagtggagtgctaatgagaaatgggaggactcactgaagggaggacactgttcgcataggaacagtgactcagtgcctcgcagtacccttccctgatttctcattattgctccatctatgcaagactgggttaaaccactgggttcactaacagaagcatttccagtgactccagaatctttttaacgtcctatgtaaagagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaatgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtagtggtggcagtggcagaagagaagcagcctgagagatggttagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctggggagacttctggaagcttccaatcatggcagaaggtaaaaggggagcaggcatcttccatggcaggagcaggagcaaaagaaagagtgaggggaaggtgctacacacttttaaacaaccagatctcacaagaactcattcacggggagcaggcatcttccatggcaggagcaggagcaaaagaaagagtgaggggaaggtgctacacacttttaaacaaccagatctcacaagaactcattcactgtcatgataatggcaccaaggagatggtgctaaactgtccatgggaaacccactcccctgacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccccaaaaaagaactaaacatgcaaagatctgagggaagagcattccaggcggaagtgcaaaggtcccgaggacagaacaaattctctgtgttttaggactagaaataaagctgggtggctgtagtgaagggagttctgtacatgtatcaagtagctattgttgcataataagccatcccacaatttaatggcttaaaacaacaatggtttatttagctaagtattcttgcatgtcattaatttaaaccgagttcagctaggtgggtgtctcatacatctatggacagctgtgggtcatggaggcaactttgctgatcttagccaggacctctagcatttctggggttttcgtgggggcatttgaactgactcaactctgccccatgtggtctcccatcttccaggaggctagcccagcttggtgactatgtaggatcccaaggagagcagaggctcccaggcttcttgaggcctaacctgagaactcacacaccaccacttctgccaaactctatcacagagtaaatatcaaaggaaatcaaaggccagcccagatttaaagggaggggaaacagactctgactcttgatggaagaatctgaaaagtcacatggcagagggagtgaatgaagtagacggagcagtggagtattgtggccattttcgcacagtccaccataaaattgaaaagattgaccagagacagatcatggagggcttggcaatctgtactgatgaagccatggaccagaagagaagtgagtcaatgaagagagtttctcttttcacatggccataaaataatagtgagggctatgacagcaaagaggaaacaaaagctgtagtgatgagtgttagacaattgatgagctgggagagaatttgttgatccaaatgcaatcttctcatccttactgtgttccagaaagttaataggaaagctgaagttcaaaaacagtctccaaaatttatttaaaaagcaatgaataaaaatatatatgtcaagaaataataaatactctgcagagtactaaaccatagtgtattagtatgttctcacattgctataaggaaatacctgagactgggtaaattataaagaaaagagatgctgggcatggcggctcatgcctgtaatcccagcactttgggaggccaaagtgggcagatcacttgaggttaggagttcaagaccagcctggccaacatggtgaaaccccgtctctactaaaaatacaaaaattagccaggcctggtggcaggtgcctgtaatccctgctactcgggaggatgaggcaggagcatcacttgaacttggaaggaggaggttgcagtgagccaatatcatgccactatactccagcctgggtgacagagcgagactccatcaaaaggagagaagaagaagaagaagaagaggaagaggaagaagaagaaggggaaggggaaggggaagagaaagaggaggaagaggaagaagaagaagaaagggaaggagaaggggaagggggaggaggagagaggtttaataggctcatagttttgcaggctgtacaggaagcatagtggtttctgcttccggggaggcctctggaagcttccaatcatggcggaaggcaaagggggagcaggcatcttccaaatcaggagcaggagcaagagaaagagcaaggggggaggtgctaaaacacacttttaaacaaccatatcacatgagaactcactcgctatcatgacaatggcaccaaggagtgccatttccatacacgagtcattccaaccaccacactgtccccctgataagacttgctgagacatttgctgatacctaattggcttagaaatgcaaaagtacacctctaaagatgaaatttgaccctttcccccaggctctgtctggaggttgggttgctatcacgaggttaaaaaacattgatgataataaacaatcatgataatattttcttatgtggaaattttattacctgatatttgcaacatttaaaagagctaatgaaaataataatatattaatagccaacactggttgagaacttgccttgttcctcttatcttgacctctgagatgccaaaaataaatgttgccaatccatgcatgtgcagttattcaagctatattttcttgaattgaaatataagtcttaaaaccagtctgttccctcacagcagattgatttccttgagattagagagtaggtttcatttatctttatgtatctagtaggtcatatagcatcctgcaccaagtaggccatcaaaaaatattcatggaggcagtggctgacacctgtaatcccagcactttgggaggccgaggcaggtggatcacgaggtcgggagttcaagaccagcctggccaagatggtgaaaccccgtctctactaaaaatacaaaaatttttatttttgtattacgggcgtggtggcacacacctgtaattccagctactctggatgctgaggcagagaattgcttaaacctggaggggcagaggttgccgtgagccaagatcgcaccactgcactccagcctgggctacagagcaagactccgtctcaaaaaaaaaaaaaaaaatcatggaaaaagtgaataaatggtcttcctcagggatagaaagggtaaaaaatgttttttaattagaaagatcaacaactagagtagtttgagcccattaaacatagagcaaacctccttggacaccctccattttcatgtctgtgtataaattgaacaagataatgaaaccttctgcttataagaaaaaatgttagtttctattctgcattgtagtagattttaaaaagatttccattgaaaacatctactttttaacatttggtgctaaatttgtaagttcctgtttccgaaaaaaattcacttaagttgactaatttatttcctgataaatattacatgaatatctcatatgaatatatttctttaaaaatttaggcacctataacctgattcttatcccaatagaagcaattaaggggcaggtggtggtatcacctttaactgaagtagtaagctgttggtcttccaaggtgacccagcaagcagatgactgaatccaaaagtgggtgatttatcatgtcattctgggagaacatgaagaagttctcagcttttagaatgtaccttaggccaattacgtgcacgttgacaaagatggatgtgtcttcattatgtagtttattatggatagatcagggctgggacaagaacctacatcttgtaatcctagtacagtacatttttaggaagcacaacccccatagatgaccctacaaggagcctatactggagtgaaataggaggctgtgagttttacaagacatcaaacaatggctgcaaacttgattttataggtttagtaatatctccagggaataattctctttccctttccctacttctgtaattggtatatactctaaatgccattagacccagcttgctctaaagatctgtagggatagtatttctctctctccctcattcagtatgtgcccatgtcaggcctaactgaacacagggaccaaataaatagaagatattccattcagattttatagcctgactgctttactctgcaacctctattattgagaattatctattttgactgcaaacacgtcatttcatcaaaggttctttacaaagcagatgacattgaaaagcagcctcacatttttcaggtttagagactagatttttatggacttggaaacttggaagtcagctcaccattctggcatagtcttcctgccaagcccaaattctgaaatcagtgtgggagcaatcagagggtgacatccatctcagagtcaaagaaacaggggacttctgattccttgtaatttctctagaagtaaatcctcttttccttgactggcactcttctcttttgagggccaataacaacctactcattaagaaccatttaacattttccaaaaatacttccaaaaccattaactcatttgatccatgtatcaattctatgaagtcagtaggccaaatattaatatttgtagtgaacaagaaagccaagcacgaagtgttcaaaaaactaacccgacaacaaactgaaaccctggatattatcaggataacaaaaaaatcacctgacctgacccccagttaggaaatttcccactgtcctatgcactgttctgcacacagtaggaaatttcccaattaggggccaggtcagatgattttttttgttattctgataacattcttctcttctagactatgagaagagaggtgctgtagtggtggagaagcgagtgtgtgtgtccccaagaatattttaggtatggccaccaagttagccctaaagaaactacaattaaactaggaaatagagcagataaactctgtgtctagaattctaaacttcttagatttatatgtcctaaacccaagtctttcccgtctcttttcaggctgttcccacaagtactgacattacttccaaagaggagaatttgggtcactaatctagcgaaagcatcttcccctctgaattcaccatcaagatgaatgctatccactagaaatataaaggaagccacataggtgatcttaaattttctagtgggcacattttaaaaaggaagacaaggcaattaaaatataattttaataatatatttcacttaacccaacatatccaaaatattaccatttcaacacatgatcaatattctaaactacattagtgagatagttacactcttattttcattcttagtcttcaaaatccagtgtgtattgtccactcacagcacacctcaactcagaccagccacgtttccagggcctcaaagtccacacctggccaggagctgacggtctagctcctgtgagtaagctagtcctcagattttataaaactctctcttcagggttgtgctcaccttccccctcccactcctgctgctcctgacctccatcaccagaagagacccccaagagcaaatcatatttttgtttccaagagggcccactgacaacactaaaacccaggaggaagcagttgacttaagaccttcgagtgactcactttgtaggaaaagcagagaaaggctggcaaacaagaaaaacataagctcatttttctccccctcatcaacctcattccccaacctgtttgcatcctgaagagggcagaggcctccaaagttgctttagagggcagaggcctccaaagttgctttctgggtcactgcggggtgattcacccaacaataggctataatttacaaggtttttctctgcaagtcaactcttgctaatggaaggacgacatgaatgttgaggctgacaggctggaagataagagtagttgtttgttccctcagcccattgaaaaatccagccccaaacccatttgaagaacagttcctaatagataatgagacacaaatcgtgtgtacctgattgtaaatgaatagctcatatgcacaaagcaaactgtaaaacctccatttctcagccaggatagcactccattaatgatgtgcttttgtttcttccaaagactaagtgctcctttccaggagaaaatagacctcaacctcacctccccacccaccatgtccctacccccaccccaaagagactgcattaccctgagtattaatatacattgcctaacaaataggcaggcaaccaaaaactgagcaattttagccatttaaaccctgtcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcaattgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgctagtcagtggcctcaaaaattgaattttcacgtgttgtctttgccacttaacattatcagaagcttcttgaatgtttactaatagaagtgtgactcctttcatgcttgctgtgtctaatgttatttttgtgttagcaaaattgctcttcaggaatatgctgatggctaacttgcagaaatagagatttaggatagacataatgaaggacttccctacaacactggatattaaatgctgaaaaaggcttttcaattccttcctgaaataagccagggccataagcacttagcccactctatcgaagtctccccgagaaaaccctgcggctttctctgcggattcctccagcccaacaccgaggaaccagggcctgggacttctggagtccctcccaggactaattcccgctctgatgcccagcacaaatttatcataactgcctgactctctcagtgtggtgtggtggtggtgatggtgtgtgtcttcctgagtgtgttggttggggatgtggtgggaggggttggccagagagttgaataaagaggaggaaaaaaaaaaaggaattagatttttcagaactgcacaaccaaagatttgcacacttatttatagaggtgacccgtgagcttggttgaccctggatgcttttctgcgctataagggaacccgtgggtggccgatcactctctggccctccagagggggcctccctcctgcgcggaaagcgtcccggtgcacagcgcccagctcccgggtctctgtcggacctgcgactcccggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggccggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcatagaaggcactgggcacctggtgtgggcaagttgtgcctgctcagtaaatattaactaccgactcacaggacatgcctctctttttgctaccctcgcacgtttcttttctcgtttccttctccattgtcactgacccagggttggctgatataagtgaaaaacaccaagggtgccgtctgttatctaagtcatgcaaatgctttaaaattatatgtctgtgtatgtatgaatatatgtatcaggctctgggcacatagaggtgaaatatcatgtaagcaagcacttgtataattttcttcagataacaagcttgaaaacacagcctctacttgtttccttcccttccctgtctccctttctctaccagagctttctggaccatctccaaataaactacttgctctcaaatcccagtgtcagagtctgattctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccatgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatatgcattaattctctctcagttcccaaactctccctaataaagaagaacttgagagttgactcagctgtcccccagtataaagtggtgggcatgagggagagaaatgtgaattactgatacataattttccccctattaaactttattccttggaacatctttgtgaattctgcaaattcacaaagatattcatagtcctatattcatttgaattatccaaagctccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacagtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttacagacagtctcttaaaatgtatgtgtcattcaaatttgttttgatgtgtcagtcatctccagcattcatcctgggctttggatgctacttagttgcacgactggatgtgttctaagatctgccatgcaggttatattctgatttacttgcttacagtgagctcctatttggaacatagttctgaatgccaaagaaaaccaaagacagaacacttccagctcaatttccatctataaagtggtcaaagaaaactccagtccttgaacttgtgttctagtcttttatgcactgtttagaggttctgcaggggctttatgcctgccctctgtgagagatgaagcatgttaccggctcctgatgaatggacatttaagatccaaaatgtattgaagtcgagttgtcatcacgtttttcatttgcccaagtcctatatccaaaaaaaaatgatgtttttcatcatttcatatagatgaaaaacaacattaccagcccctgtttcaaaggcaaaatgcattctgcattgtatatgagttgggtaatgtcaagtgtctgtgattgcagcgtgggagttgttttggtctgttttattttgacttaagtcaggaaacaataagtatgtttgtcattttccaaacaatatggtccaaaaccacttgtggctggtgttctttcatctccacggggcattccacccaacaatcaccatctgccagggacgcctatgaatgtcaaagttctgctaggtttctctgaagcctgcttctgctttcagcagctttgaataagctacagggccacaatttacttctattgtcatttcttcagggagatagagagaaatacatctgccactttagacaagaagcccatgggaagagtacacacacaatcagaacagccagagcaggattattcaattcagctgcaatcagaaatgggggaataagacagagaagaaaagccccatcttgttatgtgtaatgctcatttctgagccagtgtttgaagacagatcatgctttgtgagaaaaacatattttttcatcagataggatgtaatcaaccaagaattaatcattagtgagccattaaataattaattgtaaattgtaactaatttctgattattaaaatgactttttttttatacctgggctcctataattccccattttaaatagttaccaagctacgccccgataagataaagacaaaaaagttgcaataagttagctttggctatgtaacaaaccattaagacataatagattaccacaaaaagtatttattagttcactataatctgggtcaggcatttaggatgagttccgctaggcggatcttctgcttgtcttgcctggggttcctcacgcagaggcaatcagctgatggtgtcagtaggagccgattggtcttgaacggcctcactcacatttctggttttaatgctggctgctgtctgggaggtgcaagggattgggccctgtatatctccaacagagtagcccaagattgttcacatgctggtggtcaacagtgttccaagatgcagcaagacagaacaagccccagtgcagaaacatttttcaagcatctgcttatagcatgtttactatattccactggcaaaagcaagtcacttggccaggtctagggccagtatgggcaggaaatcacaagggggtgaacactgggaggggggtataaatcaaggacgttactgcaacaacctaccacagacgtatccttgaaaatgcttttatccgtatcaccagaccaaaactctagggactttgaatcatgtaagcatgtgccaaaatggatctcagctatcttcaaatccttctttggacaacttaaattcagaaaggtgacttttttgggcccaaagtcacatgactaactcaatactacattaattatgaaggtattggcaagcatctggaatcactgatatagtagtttcacttaatttttaggataggaaaatttatttataaggggaaaatctatcaggactaaagagtctagaaaatattttcagaaagaaaagacagagctcaggtgggcaggtaaacaagcagatgtaatgagggaaaaccaactgaagctcaaggtgttatgtttttcttatattattttcagattcataaggcagtacttctcaaacttcaatgtgcacatgaactgcctttccagggagaactgtcctactgcaaaaggtgtatgcccaggagacacttagctctcatccatgttgttcccagaaatcatatagaactcataggacatactctgaaacctgaattcctcctcctacagtgcaccttagggagactcgttcccttggtcgcaagacacatcctcctggaatcagtgtcttcttttcataactgcagttatccactgcagcagagaagagctgaattctcatgtctcccctccctagccagcccacttgatctaaaagtgttctgtacccaggtcaagttcctcaggcagcaccaatgtgaaagtgaggaagtgagacaggaaagggaagaaacaccataaagtgtgtgttttcaaggaaattaccagtgtgggcaactgggactcaggcttgctgagcacctctgggaaactgtggagaacatgactcagtcatccacccaatgggaagaaagttgggtgtttatccacaaactccctgtcagagaccgctggagggtgctcggggaggattagttctccagcacatcactcttccttaggcacacagctagtgagtcagagaaaagccttcaggcagagacagtattttggggtttctaaaagcagcttcaagcttgtacaggagaatgcagaaggaatatgggaaaggctagagtccttctgccttaaccatcgccggagtactaactagaaagtcaggactagcttaaatgtataatggttgtgactaaaaccaaggcaagcacatgaaaagcaacacattagtaaaacaagcaaaatgttaggcatcaaacagccctgtcggttatttctgccttttcccccttctgttgactggttgggttatgttgttgttgttatgccaaccaataatgtctcagctgccttaaataaagtatttgttttcaacattattcacccaagttactcaacaggaaagcaaagattttttccttgctttccattaggaagcaatattagttagatctggatttcattctgtccctgtcgtctctcaaaactgtgaccttggccaagttatcctccctcaacttcagtttccttatctgttaaaagacaatagcaattctgaccacataggattgcagtgacagaagtatgtaagcagcccatccatgaaaggcacacaaatgttgtcctccttcttccccactctccaatactctcctcactgctgaggattaaattcaattctacttaatcaatttatgttgaagttttactgtgtgtagactctgtcttggattacatagcaagtatagagctaataatcctttctttctaatagctttccattttggggaaagacaggcatataaagctctaacaaaatcaggtaatgataagtacttctttcaatgtgaagagcatcatgctctgatcctacagggagaaacaaattatcctctattttcttgtaatttacataacagtagttgattccataattcactctcaactgctagagtctgcaagattcccaccaactgccatcttcagcagaattgtattacacatgaaaaaacctttgactaacctctaattgattccgacattccaagaactattaaaaagagttgaaaataatctagaaactgctgacttgtatcaggcatagatttattcagacaaaacagagagacagaaggattttgaagtgagatggttttgtcaattgggcataacaaaggaagaaaaataaaaattatcgttcatgctttgaaaatctctcttgtgatgtacctctctgctacagtacctggcatttagaggtgtttaaccaatgttagggaagaaaactaacactggttaaacacctctaaatgccaagtactataacagagtactcattgatcattttattcaatcttatctactcttcaaagcccacaaaagaaacctgttgatcaagcaaagcttatcacacttcctgcaataagagagaacattgtcttaatggagaatggttttagggcctgagctgggtgatttcgaagttggtcttgcaaggcagggcacttgttgggactggaaaagtttatgaaaagtttctttgggttggtaagcatatggaggtaagggtcttgaaaggagtattgatgagtaagtcatcaatcttgataagtaagctgtttcattggtgttatgggataaactgtgcccctctaaaattcataggttgaaggcccaaccccccttcctcagaatgagactgtatttggagataggccttcaagggggtaattaaggttaaacaatgtcatatggttgagccctaatccaatatgacttatgtcttagttcatttgtgctgctataacaaaatgccattgactgaataatttatgaagaacagaaatttatttctcacagttctggaggctggtaggtctaagatcaaggccaaggccagcagttatggggtctgtcaggagcccagtctctccttccaagatggcaccttgttgctgcatctaccacagggaaggaacactgtgtcctcacatggtagaagtgatggaaggacaagaaaggtgaactctctctgatgcttcttttataagggcattaatttattcatggaagtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccgcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaacgtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctgaccatttctgggagcagagattctgtgatttccaactgccaatacctgcaactcttcatcttaggcagttcccacttggccctggttcagggcagattggaagttctgagtagtgaatgctccccaccagagaagccctcaaccaatgattgatgggagttggtggacaaataccccagttccctcctccctcacgtgggatgactctgagacatgttttctgtactattcccagaattccccaatgggattgacacctagttgtggacagtagtaacaagcctgataacataccttgtattggctgccttttctccccattgttgctttttgggattgcctcctagataaactatactcaagtctttgtcttggggtcttctggagaagctcaaatgataccaggctataaccactggctccaatctgacagtcacctcccatctccaacacctctgtatggatctctaggtttcttaagcaagaggccactttctttaacatgacctggaagagctggcatgatctggcacctacctacctattcttatcagggttcttaggtttaacaacagaagtagaatctgggtaactaatgcagaaaatgaatttattacaagggcatctctcacagaatcagattagcaagatgggaaccaggctgatttagagacgagtaaccaaggccctaccataagaaccatcgacttaggacactcctgcagaccctagcccaccttggtcctgatcaccctcttcctgctgccagattccacaacccagatactccccctactgctgaatgttcagctatcagtagcccccatggaactctctaaccagtatgtaccctcctggccctcccgaaagacttacagcctgagaaggagctgtgggcttgatatgcttaaaaagcatgctcccacagtgcatggagaaaggtctcttcccctacttcagcatctgcagaaggaaatggggatgtcccaaataatcagggtgctcaaatactgggttgccagaagacagaccccctactgcctcacagccccctcctcatcctgaagtccagccctaccaggctttgtgcagtgtcgcgaggccaccatgcttctccttgccacacagtgtgcatagaaggctcccctcttctgcccagtcaaactcctcttggctgcagaattcaggtcagccttcctcgtggaagatttcctgagaccacaaacatgtcagatcccccacaaatgcatgcacaacagctttcctttgagaaattcatctcccttgtaattgcatgtcatttgcctccctcccaagaagtcagctccctgtgggtccaggctgtctccacttttactcaccctgtgtgctcagcaccaagcagaaggtccagcacatattaggtaccaaataaatagctgttgaagagatgaataagtgaatgaacacatttataagcagctcaattttggtttttcacaaatcactacacagtttgtaaatagcaaaagacattgtccttttggcttagaggtgaggcagctcatattttcaatgagaaagatgttctctcatgacagacactaaaataacccaatggggcgtgtgatcaccttgattacatgttcccaaagaaatacttttttaataccaaatatttttcaaagtttttataaagccttccatctactcaatggtaggtcatatctcaattaactattgctacgtaacaaatgtaacaagtgtctccaaagctcagaggataaaaacaacaatcattggttattgtccattcatctagacgtgggctggggtaaactgttctagatgaggctcagcagaaagcgacaatgctccacgtgcctctcatctttcttaactactaatgggctatcccaggcatgttcttctcaagccaccagtgggctagcccaggcatgttattctcaagccaccagtgggatggcccaggcatgttcttttcaagccattagtggtatagcccaggcatgttcttctcaagccaccagtgggctaacccaggtatattcttctcaagccaccagtgggctagcccaagtatgtttttctcaagccaccaggggcctagcccaggcatattcctctcgctgcaatgacagaagcaaaagaggtcaagtggaatcacaggagtcctcttaaggcctaagcttagtcatggcccactatctcttctgcccccatgccattagccaacacaactcaacatgatcaagtccaaagtcaagagtaggttagtacctccacccacaatgggtacagcaaaggatgaaaattcaaagccaacgagcaatctacctcaatattagaggtcaggtgaatgataagaagcatttagagaagcaaacagccaaatggcaatcaagccctccatcagcgtgtatgttgtatgcctttgaaaagctgtcagagacagtacttgtcaaaactgtcaaagtcatcaaaagcaagaaaagtctgaaaattgtcacagccaagaagaacctaaggaactatgatgaataaaagtaatatggaatcctagatgagattataggtcagaaataagacattagttaaaaactaattaaatctgaataacatatgggctttaataataatatatcaacatcgtgtcattagttgtgagaaatgtaccatactaatggcagatgttaataacaggggaaattgggtaaggagtatatggcgactctgtgctttcaacatttttataaatctgaaactattccaaaataaaaataaaatggttttaacaaacacagcagtcagagatggaatgtggtttatgacagcaagaattattgcttgtctagactcaacaagttcttaaccttattacagtcttacaaatgacggatttgttatctagggaagaaaaagccctcttctgggactctgagacaaaggatttatttgtacccacctgagacgtgctcagagagggactggaggtgcatggagagggctcctgtcagaatcttcaatccgggggaggccagctgcctgggatgtggggctgcctgccctcagtccctatgcagcctccctttgggctccttccagcctcactccactgtgatcttactcttctcagtatatctgtagtcttctcatcctcccccttcttctgtctcctcatctgtgtgaaaagactggatgaattctagacccaactccaagcttctatacgtttgcagtaacacaatgtaaacaggctaacttaaaagtccacagctacaagatcatttatttttcaaaatctaattgaagtcacagctcctttcaaagaaagcactgttcacctcaaagaaggtatcctgagaccacgaacagatcagatccccgacaaatgcatgcacaacagctttcctttgagaaatccatctcccttgtaaatgctgtgtcaatcacattcctcccaagaagtctgctcccggtgggtcggggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcaccctccacgaagtcaccgagcagctgctaccgctgtgtctccgccagtgccatttctgcttcctcgaattttaaattggccaggataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgcttttatacacgcacgcgatgcccatgttgagaagaaatttgctaagcggctgtgtttgttgaatcctgagcctgcctctgcacctagaacaatcccaccatgaaatgaaatgaatgcttgcaaagatttcttacttcctcctttaaagagtggtaggaaaatgaacaaagaggataaaaggaagcaagctcatcatgcattcaccaacgttaaatttccaaacggtagttacaaagcatttttaaatttaagtttcattaaagatttggaaatatattgctttttttctctgacttctcccagaaaagtttttgggatttgggaattttatgtgtaggttttccacaatggagtttccttcccatgtatgtgtgtgtgtattttaatatatatataattatatgttacacataccatatgcaatatataaatattacctaacatatattacataattatatattatgcaattatatatattataaaattatacataattttatatattgtagaattacatataattatagaattatatgcaattttatatatattaaaatacatagacaaacataatttagtacatatttattagcagtggggatatttgtaatgcagataattacctgcagctttaaatgacagttttactgatacactgtatgtttggtgagaaagggtgctatgtatggtaaacggaagaggagaggaggacacaagttcaaagtcgaaaaaggttttggagattatcttccaatctaatgccctattttacttgcctagaagatgaggaccagaggaaaaactgacttggctaacaacacacagtcaacttgtggctgagctgtgagttaaatgatgaaactgaagcaaaatcacttggatttctgcatgggagttgtcgacagtcatgaaattacactcaaagactccagtgcattcaactaaatgtcaattagtatctaaactttgccagaacacagcaaacagcagagctaagacatcctgtgggtgatcttccctccctgcagcctggcttgatgaattagagttctttggttttcagaacgtggttgctattttcttctccagctccattagcaggttgggaatggcacactagctttttaattaaaaataataataattaaaataccaaacacagtgttgactaaaaacaaaccattattcttccttaatcacttaggcttagtaatttctctttgtatttggcaaaacttcaaaaggagtaaatcaatgttaaatccaaaatttaatgactcgagggtttttggagaaaaagaaacctagcagtacatcacaataaggcaggagccagaataagtctgggctgttttacaagatgctgtgttctaccactaaaaagagggttatcataaatattattagttatatatgagctaaccccaaaacatcttgattgccttacaagtcaccttttatttttaaacttatgaaaatgttcccaattattcagaagcaagatcattttatatagagttctactgttaaaaacaaacacattctgttttattactgcaaaccctacatgtttctccacaagctttgtctaatatttaaactgaaagacttattacacgtattgaagtgcatataatgttccaaaatagacggtcaccaagtttaaaaacttcgctctctcagctaacacgtgcatatctttaacaattgacaaattacatatgcaggattgttacacaaaatgaaaattaaaaaagaaaaacaattgacaaagcgaagcatatttgcatgtattaactcatttgttttgatcttgtcctatattcctaaaagtcacagaagataatctgttacgtaaatatatggtcagtgtggaaaattcaagaagtatatgaaggaaaaacagaaatctccctctatatcgagcccctctttcatctccacaccccggaggtaatcattattatcattagtttggtatctatctttttataacagaactggccaatagaaatgtaatgtgagccacaactgtgtacataatatgaagtagccacatttctataataaaagcaaaggaaatgagagaaattaaataataatatatttatgtaacatagtatatccaaaatattatcatttcaacatgttatcagtacaaaattataatgagatattttacattgttttcttgtactaagtcttcaaacaccagtgtgtgtttcacacttagagcacaaatcaattcagactgccaagtttcaagtactcagtagccacacagggcagtgactacctatgggacaatacagctctagaccttcctttctatgtgagagagagactgtgagatagtatatcaactaagaattcttggccgggcacagtggctcacacctgtaatcccagcactttgggaggccgaggcgggagtattaagaggtcaggagttcgagaccagcctgaccaacatggcgcaaccccgtctctactaaaaataaaaaaaaattagttgggcatggtggcgcgtgtctttaatcccagctactcaggaggctgaggcaggagaatcccttgaaccagggaggcagatgttgcagaatcagggaggcagaggttgcagtgagccaagatcgcaccactgcactccagcctgggtgacagagtgagacttcatctcaaataaaaatacataaattaaaataaaataaaataaaataaagaattattttgctgccaagaacagaagtaataatcactgaaataataaaggcttcaatcagccaatgtaacaggaagtctacaggtggccaggtctgaggctggaccagcagctaacaatccaggcctcaggatgctctctgcaattgtctcaaccatcccctgtggttgtaagatggttactgcgggtccagagagcacatcttcctactccagcttccaaaggcaggaagcagaagcatagctgagaaaatgagaaagagctctttcttcattcatgaaggggaaaaaaatctttgtcagatgccccctttatatcttttgctcagaacagatcacatggccttcccaggttacaagggaagctgggtaagcaggtgtctggctcttttagtctccacagtgagaatcagtcataggagatggggattgaaaatgtttaaaaggtaagcacccaaagaactgacatggatagatctaaaggtagcgctcctgactcaaacagcgttcctacttcagagctggatggactcttccagcccactccttgtgggctgtgctgatcacacttccttcataaagtatgtaaaagaatgtttcagcacatctgcagcacgttggacattattagattctcaaataaccccgtacagtttacactttcatgagtgtcaccttcattttacccagaagttaaataactttctgaggtcacagccaagaagaacctgagtcatgaaccatctattaaacccaggccttctgtctactaactcactgctttttccattctcagctgcaatccacctgacaagtaaagaatacttcatgaaaattgaaagtataattaaagaatctcaagttgaattttatgacaagtttgaaaacccaatgtaagacccttcccaggataagctctggcatttataaaaatccaaacagccagtctgtgactgaccaccagaaaaacagatcttggggcacttaaatgatctctctactgtgaaccactcagaattgcttttattattggagagaaggtaaaaataatgacagcaatggtggttcataatcttcaaagtatttttatgcccatcatctcatgtgattaaaaaaaaaaaaacctctgaggttggcagaagtgtgcaaccttatttgataaatggtaactaagactcagaaaagtaaagtaattgggtcaaaatcaaacctgtaggctaggaccctggtcttggatgctaggaactatgagaaagatggatatcagaagtcattagaagctcttctattatcaaaactttctcagtggtctaggcactggttataataataattatagttcacacttacagagcatttattacatgctaagcactgttctgaaccctttacatttgttaacttatttaatttcacgagaatcctataaaattgtgcatcagtgctatgtcttcataacaaactaacgaaacttgcaggtgttcacagcaatatagacagttacttctcattaacagctactaaatgactggttgaggtttggctgatctagggtggactcagcttgggatggctttgagcccaagggttgcgttaaagtttacttctgattcatacaaataataccttgcttgtaaatttcacactcaatggacctcacacacaaatactattttcttagtcctcctgagtgggagttggagtgtcttggtggaaatgggaggattctgacaagtagagaaatgccctgatagccacctctatcaaaaagccaagtggagttgaaaatagggcactggatttgataagaaagagatcactgatgaagctgtcacctgaaatctgggagggacaccatcaagcacagctttctctagggcaacagttctcaaattgtgtcccctgaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcattcgtaatcttggttgtatgcaccctgcctttattttactatatatgcaatatagtctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattgtttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctgggatattattgctcatttgttagtactaagaagtagtttaagagagcagtctctggggccacttcatgtatttatggcttcaaacagccagggttcaaattctgcctcatccactttctacctgtgtgacctcaggcaagcccctgtgtcctcatctgtaaaatagggatgataatagtaacaaggattaaataagtgtaaagggctaagaaccgtgctagcacatggaagttattcagtaagtcttcactgtgctattatttccatacatttcttccttctaagtcactgcatatatatatatatatatatatatatggcttcaaatctagatagttgtgtattcatagtatgttcacaacatgttcaattcatctggcccattctctcacttcacacctgaagaagcagagacccagaaaggttaaataacttgcccaagtaacacagcttgtcagtgttacttaccagctcaagtcacttgtgcctggaatcatttctcccagcatactctccagattggggatctgaaagagcagtggagtgggcaatctacttttccagagaaggtctttatatagaaaacagttttgcctggagggagccagaaacctcctgatgtaggaataacgcctctcactagagtcatcagagtcactggaatgagaaattaccgggtaccacaggcacactgaattgtaatttatttttcaaatgtgtggtaagttgaggacactggaaatgagcatggtacaatgagaatcagaaaacagtgggttaaaatttaccaattaacttgggtatgccacataattcccacaagccgcattctctgcatccacaaagtgcagttagtggtgcttctctctcagtgtggtgacagcgatcagagcggattcttacgggggggcaatgagtccagggccacggatggccaaaaaatgttctttgcttcaaaaaaggtgatggctgactttggggcagagaaactggtggtaaagttaaggctggggagggccaataggaaggggccatgaggggtggagaacaacacctggaagaaaatgttcctgctctgagagaagtagaagacctggaaccacaggaccagtacttctcacccacacatctattgtatgggcctgggatggaaatctgcgccaccaactgaatcttcaagcaagcacataaaatagtggtatttcatttctaattacacattctgtcagtcatgttgggtttcccctgcaattaactggctctttacaaacgcattagcatatacagccaaaggcattggtttcagactgaggcaaatctggtgtaaaaccggcaactcagaaattgtgtgactttgggcaagttactcagagtttatgaagttcaatttcttcattcgtagaatggtggacaattattcagttactattgctgtgtagcaaattaccccagagcctagagaagaaaggaaaccacagttttttggctcactattttgtggttcaggaatttgggaagggcttgcggttcccacttgggatgccatatacttgcagtcagacggcagcggagattgggggggttgtctgaagactcaacagggctggatgtccaagatgtcccatcacatggctacaggctgggagcccagctgaggatcaaccataggaccaaagctcagcctctccaggaccatagtctcagggggctcagacttctttacaggctgactggcttgccctaggccaaaacgcaagatgtccttttctgacgtattcttgtaagtcagacagcatcacagcatcactttgtgtgtgtgtgtgtgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccgagcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacgccatcctttctttaagccacagctttataaaaacctagtcactcaaacccaggctagcaactagttgaatgccattgatttcttagaggaattaaccaaataccttctctgggtccctaagatgcattgatctcctgctttcctccccagcactgtgcgaatgtcactgaatgatgggaggctgtttaaatgggtagaaatattgattttcttttctacctttttgaaagttctttgcttaccaggtgctgagcaaacatcaggcaaatggcagtccacatagaaatagatgatgtgaggagcaacaatggcagttctggcttctgaatgtgaagctggttaagcagcaggtgcccccactacacactgtggttttagattcaaaaactacacatcattgttcacacttcgtcatttgctaattgataatacagctcgcccctgtggcactaagtagcatagtggaaaatatttccaaccaatccatggaaacagctccatccgtgtctgaagagggtcgactgaaagctgagatgaactgagggccagtgacggggtaatgaggtgcatttcggaggctggggtctgcatcctaggtgtccatgtgcaaaattggttatacccttggaaatgacaacaatgttctgtcttagtctgtgtcagagatgacagataaacacaggttaagaaatttctgggtttctttgatatagaggacatccaagaaaccatgcatcaacattaggttgctattgacacccaaggaaactgatgtgtggttaacttctccgaaagaaaaagccaggggttccctcagggagccaaagggcagcagattggaaatcactcgcaattcacaccattggaaggaaaccaatgatggaggatggagaagagccctgtttccaatatgtgcttcctaaaggatacagtcccagagaacttgcctcaaagaacaacaaaggagaatccccagagagtgacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaactcaagcacttccacacctgcattccctccagactcaggttctttcttctgagaagaaaccttacattttttttgggggggggggttgtgtttttgttttttgttttttgtttttttgagacggagtctcactctgtctcccaggctggagtgcagtggttccatctcagatcactgcaacctccgcctcccaggttcaagcagttctcctgcctcagtctcctgagtagctgggattacaggtgggcaccaccaagcctgtctactttttgtatttttagtagagatggggtttcatcatgttagtcagactggtcttgaactcctgaccttttgatccacccatgtcggcctcccaaagtgctgagattaccagcgtgagccaccgtgcccagctaaccttatgtttttaaaattgttgttgttggttttgttttcaagtgaactttttgcctgttctgtcaggatcatttcaggagagtagcaaccctaaagaaaactctctttttctttgacataaaacttatttttaaaaaattaaataaatacttagtgagttcctactttgcatctggcacttccgggaactcagaaacagagtgagagaggggtcattcccagggagagggatggtactaggagatgagacaggactgggaccttcctagagctctgggtgctattgggagggcaaacaaatacatgtcattcctggaatgattaggagacactggcaattcaaagggaagacaatctcaacacactagtgcgatgggtgagtccaaattgatagcagaacttccagcaaatcgaccctccttaaaattcaagatagaactcttagaaaggatataggaatgttcacatagcatcttgtttttgaagtgattttgtggcctcatcaaggaatcccgtctagttttcattaagaacagcacacatttttagggagatttattcaacaattactataacaagaccctcccctagaaagcttcttagggatacacagcacttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaactgcccagctcccctgtcattgctgccctcggtctaaggaccagcaatggaaaagagtagagtggcctcctaactatgcatagactatgggctcagtttactgtagattacagtgaacactagcaatggacatgtcataagttaatgctttgaccttcggattttaggacctaagactcaacatttgccttttataacatccatgcaacccacccctgcctgttatgtgacgcattccccctctcaggcctaagtttatagctctctggctataaattcctaagcatggggtctaccccaaatgctggcatcactaagaacaaatgggacaagaaaacccaccctttacttctacctcctgaggctcctcagtaaggagatattgaagcttctagagtaaacacacaggcggcatggaggaagagtcatgcaggtccccatgaaaagatatctgacttgagatcactcccatttgatagcagtagcatttgctgttgagaaagcattcagaagtattcccatcccccaaactaactatagctttattgttgaatctgtttctctgctctgtgtcctacacgcctataattttccccttttgacattttaatctctttctggtaaaactgctaaaattcacctgtcattaccagtccatttctgcattgtgaattctgctctttgctgctttcaaaccagatttaatttgggttttgtgctgggcatcctcttcttgtctctatgattcttcaatttaccttttgttcctttttaccttttgtatcttttgtttaaaaaggtaaaattcttcaattttactgcttatcttgtgtttttttcctctccgtcttacggatttgggctcctattttgttacaatcttgatgtacatcctaattaatacaccaaggaatttcttctggttcttacgcttagttattttgcagtgcagtgtttttccctgaatcttcagcagaatgttcccctcccctgttccttgcatttttcattccagctctcctatgtgggcttcttttttctggcttacttatttttaaatgagataagctttacccaaacccagaattcaccaccagactcactgctgggttgtccctgatctgtccattaactaagtcacctcctgagagatagcactggaagagcatagttctttgccaaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccactgtactccagcctggaaggcagagcgggactgtctcaaaaataaataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaaccctgcagagatggaccgtcaaatgtgtttatctattcagccgcactgaatagctacactacttagcagcaattcttttgaattctagcagcagatggactatgagttctgcttttcatggcgtgtcttgagtacttcagtgagaaactcaagagcactaggcaaggagttagtatccagaagcctctttcagaaaaatgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatgaagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcataatctccgtgcactgcaccctccaccccactgaggtcaaccaatcctcctacctcagcctccctggtagctgggactacaggcatgtatcaacatgcctggctaatttgtgtattttttgcagagacggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcacaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatctgatagttaaaaagcccatcttaaatgtttgtggaaatgaatggaattggatggttttagtagcttcaatttgactcatctaagaaaatagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgatttctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattgacaaggcaccactgttgactaaggggctaacctttgaggaagattaaaaacagatgtccttgaagaagaaagaactgaggaagtgaatcttctctcctcttaactctttagttcattgtcctcatccaaaaattaaactaacacactctgaagaaggtttaaggagatcaggaattttcaagaattcatttgtattctgtagcagacagcttgtttgtttgttccccattgaaaacctacaagaaacaatactgcaacctttgttatagcaaataactggtgggtgtatccctccatgccaaacacatgccaagcataaaaaatgtgcctagaaaaacaaataactttggaaggctcttttcccagtgccttcttacttcctttgtcttagtcctcctttctgtgatggtgcccaacctaagccctggatcctttgctgttgatttcagtagcatttctccctgacttgcaggaaactgcccaaggctttcaaaattaccttttccataaactcctgttccttcctcgaaccaatctcaaccagcatctttgcaaaaagctgcctaattaatgacttcatgcacaagtgtgggtaagtgataacacctggatgtgttgcccttcccagaggacttgttttccaaatcttttcaaatagagacataatcagcctggataatgagtgctcaaaactaaagcttaacccttcatggcaggagtgtggtcagtgtgcgtgtgctcaggggaggtgatatgggtcattggaggctttctttgtgcccctcaaatcacatgatttgtactacccaaatgctgcccctgcttccactctgacgatgaaatgatttcatgaatatattgaccattataattatagccagtgacatttatagtatgcttcattattctcaacaagaaaagtttatttcatgtcatcctcaccaataagcctgtgaggtcaagaattccatcatgtccgtgctatacaccagaaatcaacaaactttctgtaaagggccagagagcaaatatttcaggctttgaggccatatggtctctgttgcaattactcaactctacggctgcagtgtgaaagcagccataggcagtgtataaacaaatgggcatagctatgttccaaaaaatttatttacaaaagcagtcagcagactagacttgccaaacccatggtctggatgaagaaagcacaacctggagaatttgaggccctacctcagaacatgcacaaatcagaagcaaaccacctcagaacccaaacccagttctttcttacttgaaattcggtgctctttcactgaaccacacggtttggggcatagtctttagcattcaggagagtcatgactttggatcaaatcaagaatactctccacccacccatctcccccgttttcatcacacacacctgtaaaggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcgacaaaatgaaggaggctttgcaagaacaaagcttttggaacctgtattcctgggtggtgctggagccattcattcctagccaggtgccatgagcactttctctgtgggccctgttggctcccctttacctctcacccccaaacgcctttccagggaggtgtagtgctgagtgcactggtcagatgtggggacactgactgttcacagctggagtgaagagggacagagacttctcctcgtccccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttacatctcaggagacactcattgagaggaacatgtcattttggccaagaacagcatttagggactttctagcttctctggaaaattgtcctgtcaagtacaccccagtctaaccattcctgccgtaatatctggcatagagcctccatcttttaatatccttttccttaatataatttcctaaatccatctcctaacattgccccaccaccctggaaacaagcatagccctggctgcaatgcacatgttccaaccaatatagaagctgagatttcactttctcggggttctcgttggctgccttggcacctcgctccacaagaaacatctttgatccctccctaattacattgatttatctcacggtataccttgtatccagagctttagatgatagatagcaatttgttaatacttgtcactaagactcaatgactggaactgtggtcagaggcatgcagccatatcctccctcctcaattgatcatctttattcttgcaagatggtccaacctctctaaatgagggcaatcaatactgtgcattcagccataatcgtggcttaacttggtattctttgaaaacttaagctgtgtaatttgcctgtaattgggctttccaaaaagtcatatctcctgctcaaggaggcaattaagccggcacactccctgtctgctgcctgctccctccctcctggcatctgactgccatgggccaagtcttccctccgcagacctctctcctctccagatccctgtttggatctcgacaaccaaagccagcagttggcggcaaagcagatgaactagaatatctgagccccttggagaggcctttttcttccataatctcccacatcacttccatcaatcgcttttgggggtttctcgcttgatgagctgtgtccagctcatcaattcaaacactgagataacacaccgcattgcaaaggcaaaggcagaaaagctagagccccaacagtgaaccctcatgtaaaccatggaccgtgggtgatgacgatgtgtcagtgtcggttcagcacgcgtaacaaatgcacgctgtgctccagcagggatgttgataataatgggaaggcagtgcatgtgaggagacagaggatatgtggaactctctgtgccttcctctcaatttgctgtgaacctaaaactgctgaaagacacatagacgaaagaaagaaagaaagaaagaaagaaagaaagaaagaaagaaagaaagaaagaaagaaagaaagaaagaaagaggagagagaaaaaagaaagaaagaaagaaagaaagaaagaaagaaagaaagaaagaaaggagagagaaaaaagagaaagaaagaaagaaagaaagaaagagaaagaaagaaagaaagaaagaggagagagaaaaaagagaaagaaagaaagagagaaaagagaaagaaagaagaaagaaagaaagaaaggaaagaaagaaagaaagaaagaaagaaagaaagaaagaaagaaagaaagaaagaaagaaaagaaaagaaagagagagagaaaagaaagaaagaaagtctaacaaaaagatgtggagacatgcccctcatgcagatggggacttgtgttgcatttaggacacacttaggaatggactccagctggcttctcttctcacatttgatttgctttgtcttcagttagctaagagcaagaagattaaagtccaggcatctgggcagctttggagtgagatgagcctagcttgaggtgttttggaacaagggaagtcactaccccactgcctttctacattacaaaaacattagcaaaattatagaagtaactgctggcatttcttgagttcacacagtgggccaggtgcttatatgcaccatcacttttgatcctcaccacaaccaaagtacacatgggagtggaggagcagcacagtacgctagagaagtacctagctagactgctggagtgtcgtgtcagtttgcgaaggctctcatatggggggccacagccagggtggcttaaagaacagaaatgtatggaggtaaaagtctcagatgaaggtgtcatcagggttggtttcatcagggccatgagggaaggacctgttccaggctctttccttggcctgtagatggccgtcttttccctgtgtcctcacaccattccctctgttggtaacagtgcctgaatatgatgacaccagttatattggatgagaccccaccctaatggctttaattaatgacctctttaaagacactatcttcaaatgcaacctcattctgaggtactgggggtaaggacttcaacatttgaacttagagggaagagagtccagcccacaacaggcatgacccgtggctctgcccttggctaaccataggaccgttaaccagccacttggtgtcttcatgccttcactcctaacctctcatgtggttgtcggggaaaataactgagataatgtacatgagtactcagggcactgcccagcgcaacagtcagccctcagtaagtgtcagccatcactagggtttatccttattttacaggtgagcaaactgagtcttaaatgggctccacagcttgctggagaccccacagccagagaacaacaggtatagcagggcctgtaactcatgtctgcctgtccccaagaccaagctctcatccacaatcctatgctgcctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctatcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccattcctagcaactctcagttccctgctctggtggttggcctgagcacagggcttttgccaccttcccaggtgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaatatatctttcaggacagcacaatccaacccatcatagtggtaaataaaataattctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttggacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgacttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaaagaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaagacgggcggatcacgagtcaggagattgagaccatcctggccaacactgtgaaaccctgtctccaaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacagaaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacagtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacacacacacacagagagctatgggaatatgctgcacaaatctctgacttcagggaaaataattgaccaaggcccccagctgctgcactctgaaatctgtcactgtgccaacaaggccacactccccccagtgactgcaagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgccgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatccagcagcacccttttatatatgtgcataatccttgagtttgtacatgttcagagactggccacaactgttgcatgataaattagtctttgtccaagtgaaagcaagtttcctgattaagacaaagcctagccattgccagaagctgcttgaactaactcagctcctaaattgcatttacatccaagagcttggggttctttctggctgtccaaaattgaaatgttgtcagtgcaaggacacaccatccatcaatttcttctcagaggttcctctctaccttctaggactttgctatggcatttgttggctctccatgctggcctcattgtttgtctgtttgttcttgtcttggggaagttttctttttcagcagattctcaaacgtgatagcactgtcaacaaattaaagactgggaagccatccagaaaaattatacatgctgttttcactctctctcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgaggttgggagttcaagaccagactgaccaacatggagaagccctgtctctactaaaaatacaaaattagctgggtgtggtggcacatgcctgtaatcccagctactcaggagcctgaagaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccccaatctctacaaaaaaatacaaaataataataataatggtaaggtgagcatgtatatgagatgaacttgcttttgccaaagaaaaaaatacacctgatatacaaatgaaatttggattcatggaaacaaattccagaagacagaatgttcagattatattcaggtaatatgtcagcattgtcattccaggtaaagatggctttgcagcaggaaggatttgaccgaaaaaagcgaggttacagagacatcaatgagatcgacatcaacatgaacgatcctctttttacaaagcagtggtatctggtgagtgtctttatgtccttttggacatttcccatcttgagactctggataaaagatgaattcctgtatcctcattattcactaggatgttagccagtatccaacccagtgaccctctctgtccccttacatatgtattgattttctgtcaccacctgtgcatctagttctctaatctgctttcttctggaactgctaagtagcccttgtctcctagggtggaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcttctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaattcgtaaatgtgaatgaagctttattttatttaagattaaaaagtgatgaacaagagagagaactaaattacagacttgtggacggctacattacaggaattcatcacaatttcccttctggggcttcagagcttgactctgacttatgctttttggcatggaagtccgaaaatccaatatgggtaattgaatgagtgtacttgtattagttaggataggctaggtttgttgcaataatgaacaaccctcggatcacagtagcttatcaaaagcaaggcttgtttctcacttttgctacacgactaatgcttcataattgctcagaaacgcaggctgaccaacctccatctgagctccattcccacactgctttcataagcccttcagcaaggaaaaggggcaaattgtagaatttttaaaagaaactcttaaagcttctgcctggatgtgaaaaaatggcacatgagatcacatgtcattggccaaaatcagtcatccgccattctaacttcagagtgggtggagaggtgtgtagtcttaacatgtctttagaagaaagagcacagtaaattttttaaagagccccaatgacaatcatacaatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggagccttaggatttatttttctgcattagaacatgcactaaaggtgagccagttttctttaattcagttcaacaaatacttttgaacaagacttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtattttgaagcctgtgcctcatttggaaataagcgtgcctttgcttgccttttgataaaagttgtattgttttggagatgctaaccagagatggaacagcaagatactgggcatgatggccacactgcactgtgcccagatcttcacctttcttccaatcagtggtcctcaaacttgaggttgcacttaacaaatattttttgaattaataaataataagctaaacaaatgaataaatgaaagctgcctatcactcaaccataatttcttactgcttacactttaccttaaaatgtcctctaaactctttatattcaccatcaatttctctagactcacactatccaatgtagtcaccactagccatatgtgcctatttaactttacattttaattaattaaagttaaataaaatgtaaaattttatttcaattcctcaatcacactagcctcaagttcttgatatccacatggggctagcagctgctgaaattcaattccattttcatcatcacagatagttacattagcgtgactctacatccataaaacagcttttcagtaacaggattggagcttggggaaatttgactttattgctgctttcagaatgaacccttgtaaagtagcctttgataaccttttattacagacatcccttacatgttattcaacctgcgtgcctaccaaagacttagcagagcttcattttctatagtttgtgatatgaaaaccaatgggcttgatgaattggcatttttccaactacacacgtccttggccctgccaagattgtggagaattgccgcctgtggtcgtttcactggggatgtgttgttgccctccatcacccatctgggtctgccagcaaaaagctctactgtgcattattgacccaattatatacaaaggctacacagagatgaaacagttgagcctttcccatctgaagatcctcaaagaacagaacactatgttccttaaagtgaggttttgaagcagaaatgacagaggaaaccaagaggagccagcctgcttaaaacctgcgttgtcttgtgtgggctcattaaatatcaacataaaaacaatgcctcaatgttttttgatgtgtgagacatttttaagtggatgtaaaaccttcctccagaggccaagggctctcacaagaagaaaggagccctgcatgagagtgtgtgtgctcagatgtcaggagtttataaatgtttcttcttttctcacacttgttcttgaaaactgttccaaaggggttcaggccagctcacccaggaaaacaatgcatcaggatttggggaaaacctacctaggagatattgtcatgaccatttctaacagcatatcctactgggtatccccagccggggatcagagaagccaccctaaaagtggcactaaagtgccaacagatgtgcattgctctgctcttaggaaacctccaagagtactgtagatgcccatttcagaatactttaactgaaagctctttgactgactcctaaagtcattggctcctgactcatttccacatgcaaaggcaagccctttagaaagtctcagcagaatttctcatttgatgttctttcttcagctgattaatggcctttgggttcccacaaaagtaaactctgccccccaattacaattcctggtttcttcttcattttagtcaattactgctgcagaacaaagaatcccaacattgagtggtttaaaaaacaaccatattattatctctcacggttctgtgggttgctggagttcagctgggcagttctgcaagttccactggagtctatcatgcaggtggagtcagaaggaagttgaccctggagtcaactagaggctccaatgggaggctgaaaaggctcagcctccctccctttccatggagtctgaggacctctcctctcacatgaggcctccagcaaggtagatggatttcttataggtggctcaggactcccaagagtaggccttccaaaagagaagaagcagaagctgccagtcctcttaaaggctagacctggaatgggcaccggtaactctgccacttatgttggatgaatggtcccagggccaatccagattcaagtggaaaggaaataaactctgaatttgtggccatttttaatgcatcacatgctattccatatgataactgaagaaaagtatccaagttcactgttgaatagcaaaatgagcacatttgggacaagggcagctccccacatggtgaggacaaggacagatgctcttgccatgtaattggccatctctgtcctcacagctagaaccgggaaggctggcaacatcagtactgcattctctctcttaacgacctgcacgcatgaatggtatggtgccatgtcccagacattttcttggcaagatattccaaaataaggttaaagacagacacagatgccaaccctgatacctaagggcaaaactaatgtcatattctatcaacattgtctctccacatgttggcctgtgtggcaaatgttcaatcatctgcgtgcagaagtttaaatttgtggacagccagttttaatcactgccctcccatctctggttgcccaactccaaactcagccatcatcccctctgctggatccagtgactcaatggatgctcaataaatatctgctgccttcacgtaggtacaaagcaatgtcatttccacatgctacatatcactaggagaggacctccatggttagctgctgtctaaaggggcagaaattatttcttaagggtctactaggacatttcacctatgtagatattagcaaggaccccatttaatgatgacaacttccgcccttttactgtaatggaattgtttagagttgggaacttgacctggaaaatggaatgtgatcatgacaagatacagggatggacaagagtcatccagcccaagagtaattcagggcagatggctggttctcaagatcacacaagatcagagaaggcatgggtcaaggcccttagccattatcagatggagccaaggaagtgagatggaaggccagcgagctaaggtcagagggagcttcaagctgaagtaagaataaacaactaacagtaaaaacgacgaacatttattgagtaatcactatgtgctagacactgcttagcattttggaaatacaaccacagttattccctaaggttggtattattataatcgccattttacagatgaagaaactgaggtttagggaggcaagaaactgcccaaagtctcacaactaattctaaccaccattcttggtacttgaaacctaatcctttgctctgccttcctggtgagactttatgaatgggagcctcattcaaaatagcattaggagatatacctaatgttaaatgacgagttaatgggtgcagcacaccaacatggcacatgtatacacatgtaattaacctgcacgttgtgcacatgtaccctaaaacttaaagtataaaaaaaaaaaaatgacaccaccaggatgtggaaattctccaggacaaaagacagttttttcaataaattcaaataaataaataaataaaagattcaaacctgaggaccacatagtcacccacacccttctgagagatttagaactctgcatcacatagaaaacagtaggaaggtccagcagggtgactgctccagttacttttgctgcataacagataatcctgtattagtccatcttcacattgctgataaagacatacccagactgggtaatttataaagaaaaagaggtttaatagactcacagttccatgtggctggggaggcctcacgatcatggcgggagatgaaaccgtgtcttacatggcagcaggcaagagagagagtgagagccaggtgaaaggagtttccccttataaaaccatcagatctcgtgagacttattcactaccacgaaaacagtatgggggaacccacccccatgatttaattatcccccaccgggtccccccaacaagatgagatctgggggaggacacagccaaaccatatccaaccccaacacttagcagcttgaagttgctatttatctttaatcatgattttgtggcacaaaatctgggaagagcctggctgggcgctgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgccttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggccccacttcaaaatactattgcaactagggattaagtttcaacatatattttagagggacacaaacactcaaatctcagcatttcaccctgcccgcaagcaccacccccccgaaaatttgtgtccttcacatacaaatacactttttctagcccagtagccccaaaagtcttgatttgttccagcaccaacatcaaagtctaaagcccagagtctcatctaaatatcatctaaatcagagatgggtgaaactcaaggtacgattcatcctgaggcaaattgctctccagctgtgaacttgtaaaatcaaacaagttacgtgtttccaaaatacaatggtgagacaggcataaaacatacattcccgttcccaaagggagaaataggaaagaagaaaggagtaacaggtctcaagtaagtccaaaatccaaaaaggcaaacaaattctgaggcttgagagtaaccttttctgactctatgtcccaccttctggacacactggggtgggagctgggcctccaaggctcctaatgaccgctcccccatggcttcactgggcacagcccatgcagcagctctcatggggtggagtctcatgcctgccattctcccacactggaatcacatgttagtgggtctgtagttctggggtctcagggcagtcccacccccacagctccactgggctttgtcttagtgggggttttctatggtagccccaccccatggcagttctctgcctgggccccgaggctctagggttagggttagggttaaagaactggagctcagagccagggttctgacatgctacgcatctcaagtgaactattaacattctacctaggaatgtgcacatggaactccttcctagttcctcgaggtctccaggactgtcaccgcttcctgagaattgggactattgtggattagactttccaagaagcttcaaattgatgataggatactaatgatttatgaaccaaattataaccaagtctttgtcatttctgtgccacatttattatgattggctggtgatcagtcggtacccccataggctgtgagccatagatagttgtacagctcaggttctacgtctaaatcacctgcggttttccaggaccgacactgtgcctggcattcactgctgagaaataaacaaaagcatgaagtataagaatgaatatgagaatattgtaagaattaaacataagccgattaggaagatgtgttcagtacctcccaccttaaaagataatcaaatatacaaaaatataaaagtactatctagttaccaaattactattttccattcttcagtccattattactttttccgaatcatgtttgttgtccttcacagtcgtatcaatcattctctttctcagaccaaagtcggtatctgttctaacttaacacttagtattcctcttaacctaatttaagatcgtttattttaattaggctaaatttatcttgttttaattctaatttccttctggtctcaaattatcttcttgctccagtattttcccttgacagagaagacactactatttattggaacatttttctccttaacagcttccattctcagaacatgaagccatgtttcaaaaattgacttcctgttggaaaatatattctctgggtgtgtctttttttacacttatttagataagttcgtttgatctagctaagtgtgaaaaaagacacacacagagaatatattttaaaatataaatatttaaaatataaattatatttttgatcatttatatttaggtataaattatcaaaatttttcacccaatgagttcacaaaatttaagctatcttaacaaatagaagcaatttaatttcaacacaatatgctgaaaccaagtggatattttttaatgtttcttttcttctgcatatgcacactactccagagatgtggtagatgttaggactaatgatgataagaaatagaatgtattaagtgtttactataagctgaagactttcaatgaattgtctctaatcttgaaaaccgctttgcaaagtaaataatagtcccatttcaaatacatggaaaccaaagctcagacagattatgtcacttggctaaagccacacaagtgttagtgtctgagcccagagtggaactggatccactgatttcaaagcctatgctcatccccaacttcaccccacagcctaaactgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattagcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttggaacgactactgggcaacaagacaggccaccattcaggagaaagcagggctcctgctgagacattcaagcctcaggcttcctggaaagccacattctgaggagacaagcctcagctcccaaccagcaacacctcactggaaaccatttgccctttacctaatggcttttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctctgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcacacacacacacacacaggagtacagctgctggaacatatgcacgcacacatggaggaacacacacaaacaggaacatacacacacatgcataagcacaaaagatgcacacgtactcataggcacacatgcatgcacacacagacagccacatgggcagccacactggaactgtccatcccattggagccacagctcaggccacaagcaaatggacaaggcatgtggcctggcagcaggcaaaggcagtggctttgagagaagaaagaaacctgacatctgaaagagcagagtgccaagaaagtaggtacagggagggggaagaagagagagacttggcaaggtttaaatcaactctacctgatgatattgaattgaagggtggaaatgagccatttgggttcttgttggacaaaaccaaaggcaaaaagccaaaaactgcagtgactcacattgcagccccagctttatgaaagtaagagcgttatcttttttgattatttgtgtcacttatgaccactccactgactttcccccataacattgagaattactatcccttgacaaacaagcaatgttagcagagaatcaccaaaagccctgctgggctagaaccacacactctaacttttgactcagcaattcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctatgttgcacaaagaaagtgggaatattccatgtgtttcatgcactgggcaagaagaaacaaggcattcaagggatcttataaatctagaagagcataaattgagaggagcatcttttttaatattaggaaaaactattaaatgaatcattggcagagtccagccaatgtggccccagagagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctccccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaagcattgatattctccacagttccctccatctccaggacccagtgcctcacagggcagccacgtggagttctgctcactttcccaaaccatacttggggaaacaatcatcttgtcacttggaggacttcaaggtggggtggtacccattgggctggagagctgagggcacatggcctgtctcctgtgcatagcataaccccacaaaggcctaagacatggagaccgacctctgcatccttcccttctccctgcctagcccaggcagttcctgtcaggctgctcccaactccagctgccagattcgaaaaagatagtcattcattgggggcaagaatcctctggggttccagtgagctgcaggtacaatgttagtggatggtgtgatccatctgccaaaaccttcatctgaaattggaatgtgaaacctccatattgagccgtgccagctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgttattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggtttttaatggcacagtgtctctctcaccctgtgtagagttcagagtggcaacttcggagctactaaccacactaatcttctttatttttaattaaaaattttacactatcattaacacaatgaggacagcaaatagagtagaccagcccaggagagcaatgaaaccagtagacagtgataggctcgaaaattgtttgagcagagaattagcaggcagcttcacacctcgttaagtgacctaatggcttggagggatgagccagcctggtgccccttgagagagaggtacttggtggagtctttgcttgggtttccctagaagcagactctgaagcaagggtttgagtacaagtaggttatttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtgtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacggccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctctagagaagtcggcaggtcagtaaagatgcaagcatgtgagacatgactgtcaggtgaggggtaggcagacagggaggttcgttgtctctttactctgagctcccaatccagtgaggattgcaggctgggttcacagtacgggcccaagctcaggggttctgttaggtctatggaacaaagggagacttcttcaagaacatgtggagtgtgacttaggtggcagctttcagggcatggaggtgggtggggtagaacgtctcctgctttgtagctttgctgaagctacaaaggtgaagaaaaggctggtgggtctgtagaatccaaggagagccttcttgctgtgtgctgggttttctcagaagcagaccctgagacaaggatttgaaagcaagtcattcatttgagaggagatcccaggaagcaccagctgggaaggaggaaattgatgccagaaagggagagtggcccagagagcaaattaccccctagggcaatgggagctcaatctccctggggaactctgggaaacagtgtggaccgagtgggcctcagagttacccacaaactcctgtcaaccactgggtgaaggccactacccaggagtagagatgaggtggggagatagaaggattcattctagacaagaaaaatagggccctgcagacagagtcttcagcagagttgcatgtgctgacagttggaaaacagccagcttgcaagggtagggttctgacagttggcagtagtggaaactgagtcaaagctgagatgactcctggctccctacctcatgatgcagccttagaggagcatatcaaacatctttgaaccttaattttttcatccgtgaaatgggcaaaatggatgtcttgtcaggtttgttgcaaggtatccttgagataatatgcgtatcaggcctggcacataatagatgctcaataagcattcatttccttctgtctcagaagagttgaggttacaacgttgcacaatttcgggttgtcctgatggagaagcaggggtgtgcctcaagaaaccagtgcagttgttcattggacctcccagtgagcttagggtcattaaaagaagaaagggcaactgatccaggctaagtataagattgtgagggttgcaaagttaagggcaaaaatcagaggataccaacataaatctcaaaggctttgaaaaacaacatccaagaaaagagaaggtaaaggcagggagaagacccattgctcgtggccagggatgtaatgaaggatgcccccgaggaagcggcatttctgacctgcatcttcttccctgtcacataccttagaactagatgaatattcaaggatagtcataagggagggttaatccctaaggtgggcaaagggattataaggtagcaactaccccaagtgaggttttctccgagccagggaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtgtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaaatcaccaaacctcagccaacccacagaaacaagcaagccagccaagctcagcagagctgcctagctgagcccagcccagagcacctagctgccagctgaactgtggactcgtaagctatctaaacacctgctgttatatgctgctgacatattatggccgtttttgtgtagtaactgttacagctgcccatgctagacccccttctccatcctcctacagtacttgaggtgtaccccagtctggagagaatattggcttctaggcctatcctagacctactgaatcaaaatctttagggacaagcctcatagtgtgtatttcttttagaatattggcttctaggcctatcctagacctactgaatcaaaatctttagggataagcctcatagtgtgtatttcttttgaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcctccatgataaaagggcgacagcaagaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatgcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggggggttcacatgtaagtatataattacattataatatgcttagtgctagcctggaaataaaacaccacccatataggaatgcaatagctagaaaaagcaagtcagccctaaaaaattagagaaagaaagatacttaaatgcatttaaagaatgcagctcaccacatgggggatgaacttgttttcttgggtcgatacagcatatgaattcatctagaagcttcatcaatacgatactagacaaatgggtaattggatttcatctggagatttgcttccacctagaagcctagacttaaaaagtagcccacatcatttccttaccccaaattccctaaagcccttcgacagattctcatctctttgactaaatttaactggcttaaagaccagggtaatgtcttccaactcttttactcatgagagaatgaaccagcggcctcattccccacagagatcattaagagagacttcataaataaaagactgaattatggatggatggacggatggatggatggatggatggatggatggatggaatggatggatggatgattggatggatggatggttagatggatggatagatggatggatagttggatggaacggatggatgaaaagatgggaggatgctaatgagactattgggattttattccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgcttctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtctgatccatcatccaattacagttttctgaagcagcaacaaagaccaagaaacaatgcccaggcctcaattaagaaggatcagactctgaagccatggagtcttctaaaatatgatagaagataaattttgtggttgtgtcaaagaatcatgagtactataactgtcattttggctagagccccattcttacctttaaaagctcttaatcatttttccttgaagacaaagacttgatggtaggcagaattgtaaaatgcccccctaagatttccaccctctgctgtaagcactctgtatagtccctctcttgagtatggcaggacctgtgaatatgatgagatatcactcttacaattaggttattagattgcattatatggcagagttagagatttttttcagatgtcatcaaggcgcctaatcagttgactttaagctaatcaaaggaaagactatcctgggtgggcctgaactaatcaggtgagccctttaaaaggtaatctacaagtcagagaaggaaggagtcagagagattctaagcagtggaggctttcacctgttggccttgaagatgccactgccataatgtgaacagggccacatggcaaggaatggcggactccctgggagctgaggcctcactcctacaaccacaaacaactgaatgaacttgaaagaggaccccaagccctagatgagacagctccagtgacaccttgatttcagccaggtgagaccttgagcaaaagccccagttaacccacgtccagaaactctgagataaatttgtgttgttttaagccactatgtttgtaataatttgctatacagcaataaaaaaactaatacaaccttcttgattatagtggatatttgagcacaaactgaatgacttgctgtctctctgaattaataaaaatagaccactcctcagtttttactttttcttaatatgtttgcttttatctcaaaaataagtatactctgcctattgccacatggggccctttcataaataataattctgctgcaatgagaggctcagagaaatttagtgaggaagttaagaagagctcttgggccagcctcgctgaattcaaatctcacgtccaactgcttcttaactatgtgccctaggcaagttaatctctctgtgtctcaatttcctcatctgtaaaatgggttaataataatactgatcttaccggtgattgtgataattcaattcagtagtgcacacaaggcccttagaactgcctctggctcataagacaccctcaataagcattcgatgttgttaagtcccctgcccaagattgcacagctagaattcagcagggaagaacacaagcctaaggtggtcagacctcaaagtctgttctcttagcctccccctcccttcctgccttaaggacacatatgaatttgcagaaagcattttttaaatgaaattaaaaggggcaattagtgcgttattctaagttttctttccactttcctgctaacaactagtgtgttattctaagttttctttccactttcttgcttccccagccctccctgtcctgcctcccagaatactttactggtttcccctgggagcacatccttaataaatcacttgcctacaagctttcatcacagggttggctcccaggaatcctgatcttacattagagcggtctggagctttaggcaaagcagaattttccatcctacatggccaaggcggagagaatctctgacatagaaataagattagcttctccaccatggtaaccctgctgctgactcccaacctacgggaaattatttttcacaaagaaagaatctttaattactaaccaataattaaaacctgaagccaagaacaggaagccagactttggctcttagcaatgttccttaacatcaccgggagtattatggtgaggtctgcactttccatgtggcatgcacacaacctctccacaatgagtgctctgctaggcagaagaataagatgtattacagtgtgtaggagatgttttcattaagctatggaaagagatggattatgttttataactcaagcattgccaattttttaaataaggagttcagtgtaagtctaagctattcaaagagcactagttcacagactcccattgaggtactgcaagccaaaaaaaaaatgcgttgtttgatctttatggccctcagtttccccatctataattgtcatccccaacaagattctcattgtctccagaatcaaaagagtataatgattattcatatggctgatatgaacactgggtctttgttgatcaatcaaaaaatagaaattaaatggaacttctgagaatgttcaaggcgttgaagctattctggtatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgatttgccttagctcacacagacagtgagtagcaaaatgtgaagttcaccatctgtcatgctgccttcatttaacctggccccctccagtctcccacatcttaccaaatggcatcgccatggtcacaatgactaaggtgctaaacgttaccatccttgactgctgctcccttctttttcccctcagccaccctatctgccagttctgctaggcaatacacctgcctctctgttcccaccactggcatcctggaccaagccagcatcacttccctcctggaccccacaaaagtttcctgcttccactcttaccctctgcaatgcattctccccaaaacaagcagaaaggtcgttacaaagaacaaagtagtggaagccatatcacttccatgcttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttgttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttctttagtaacttctggggagaaatactatatttcttcatagctacaaccaaaaaacagaaagcctctctatccaagactgccttgtccatcccaagaaaacagagaactacagaaagcagcaggaatgattcccttgatgcttttaattcattcatttgtgttatatgcaattaacaataggccaactgatttctcaaagcatgcaatttcaagctgaaaaattaacctaggttattttccactcagttaagtatcaaaaagattttgaaaaataaaaaaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccaggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatcaatcaacaatttgagtcttaaaaattaaaatatttttcataggctgaacacagcggcccatccctataatcccagcactttgggagactagggtgggagtattgcttgagccaggggtttgagaccagcctgagtaacatggcaacaccctgtcgctacaaaaaaattaaaaatttgctgggaatggtggtgcatctgtagtcccacctactcaggaggttgagacgggaggatctattgagcctaagtcgaagctacggtgagccacaatcacaccactgcactccagcctgggtgacagaacgcaaccctgactcaaaaaaataagaaaaagtatttctcttaaatgcaaaggcaaagaggacctttctttgtctcttctgtacctaacgtaagggttggctaactacacagattctggccacctgtttttgtaaataaagttttatcggaacgcagccatgctcacttttttacttgatatctatggttgcctgcatgctctaagggaagggtggagtagttgtgacaaagtccatatggcctgcaaagcctaaaatttttactatttgatcctttaagaataggtctgctgaaatcccctggtctaatcagttgtgtgtcaagatgtaggaaaatggttttgttagaaacttaagtccagagagcttcaaaacaggctccagtgacagctgtagcaccttctagcagtgtgacatctggaaaactgctgaatatcttgggggcatagcaccctcatttgagagctgagaaaattgaactcttgtctgttgtaactctaaaatcttatgaaactctcctcccttccaataaaatccctgattaagaaacaaaagctgaattagttttgttaaggaaatggaatcgtcaagtagtttgaatctagttaatttgcttttgagaatgacagacattaagtcaaagtgatgctccttttccatgcatgatgctgtatacactaatcactggggctgagtgatttcaaagagttttgcattcatttactgtcttagctgggattcctccaaaagctgactgtgagacatggatccacaaaccagcattttatttggaatttggtgccaggaagcacaggtaggggagcaggggagtgaaaaagtgaaggaagtcaatacagggtgtgcacaagtgtgtcctactgtgggcaacaggagctcagttctgctaagcacccctagaacatgagttagaacacatgaaggagaaagagtacaagtatgaacacaccaactcttatccatcattggttgatgattaatatcaggatggagagaggaacaatttcctatacttctaagctgccatatcattggtgaatttgactccagagataaagagataaaatgctgacagatggaagttgtgtcaatgtgcactgatatgctcaaagcaaggagttattatggatggggcatctaatagcatctaggacacttacaaaatcagaggtctccaatcacacatccctatttgtaaaacaattttaactaggctctcctaatacatgtatagctatttattcagacagtatatgtatgtactactatcaatgggctatgtacattataaagcatatccaagaaagaaaattttaaaggataaaatataaataaatattaaaagttaaaatgcacactcatgttcatggtaacattattcacaatagccaagaagtataagcaacccaaatatcaatcaatcaatcgatgaatggagaagcaaaatgtattacatacatataatggaatattattcagcctttttatcaccttaagatcctaaggtcctaagattatttattcagaatttcaggaaggaaattctgttacttgcagcaacagggatgaactttgaggacattacactaaatgaaataagctagtcataaaaagacaaatattctgatcccacttatatgaggtatctagagtaatcaaactcatagagacaaaaggtggaaaggtagttgccagggtctgggttgagggggaaaatagggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccctcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatcaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaagcagaaggaacagcttgtgcaaagaccctgaggcaggaacatgctcagccctttcaaggatctgaagaaggccagtgtgtgtgtgctgggggaaagaagtatatcagtacgggaaggaaaaatatggcatgagatgacattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaacgggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtcttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggacttactgcctggggtaaggaccagggctcatttatcttatctctctaatctggggagctgtgaggactagaatgggtaagggttcagtgcagggtttacagctgctgaaaggtccctgtagcatttcctttatggaaaatcctatggatatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtggaatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcatgcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcatggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcccttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagacaaatggaagggagcctcttctgcccaccaagcttcaacttaaatgctgagtcatgagctactagtggaggctggaaggccaagacctgggctagtgctgggaaaaggaagtagctcttattctcccaaatgtgtgctgggtgctcagaaacagagacagtgggaccccatctctacaaaaataaaaatttaaacattagctatgtatggtgacatatgggtgcctgtagtcccagctactcaggagactgaggtaagaggattagttgagtccaggagatcaaggctgcagtgagctatgattacaccactgcactccagcctgagtgacagagtgataccatgtgaaagaaagaaaaaaagaaagagagagagaaagagagagaggaaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagcactcagcatcttgctgacaagtcaggaagaactcacaacctgcccagtggtcattttagtcaattttggggggaaacagttcttttgaataggtcccctaaaaaaggcttgaaagaagaattagtacattccaaagcagtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttatacaaatggaatcatacagtatacagcctttgagtctggctttttcaagcatttattctttatcaatgtggttgcatatatcaataacatgttcttttttattgttgcgtagcattcccttgtgtgatgtaccacaatgtgtttatctgttttccagtctgggaacatttggataactttcagtttggacgattataaataaaatcgttatatacatctacacacagatttttgtatagaatttagatgtcctctgtcttgggattgaggggctgtatggtaaaccaactgctctttaatgtctagaaaatgtgacagtcctcagagtcatggagcctagaaaacagtgcggttgtccctggagttcagaatgctttactctgtaaatatcattcttacttggatagccttggtctgtgagtaaatgtgctatgataggcgttgtgtagccgttcatcccagctctgtccccagaatcagataaggactcatgctgtgaactctgatgccttcagtccaatgagaccagaacatcacttgcccgtttttattttaggtctcgtgtcaagctaagctaagatacttcattcctttttcttttcccatcaaattttgtatcttaaaagtttcaaaaaaatttataagcaagtatatctcaagatttttaactgaatgaaataaatttaaataaaattctgagtatttttccatttgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgacaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatattgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattgcttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtggcctcaacctcgccagccattcaaaggcaagcagaactctcacagaggaggcaagggcggagaagctttgagcatctctacaacatcagagaacacccagtcaaaagagagggaaacacaaattgacttgtacctcatcaccttgacaacacaaatttagactctggctgctacattatcttctggttccttttccggagctgctctccttgagctgatttacacggttgctattgtagacccttgactgtacacccagtctttgtggaactccaagaatcaggcttcaattgtactttgagccagctacactgggccccttcaaccctcagccttctctccaggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatgcggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatactttgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacctttcaatctttactattagagattaacttgtttcaatgcccattctcttctgttaaagcagataatattgggaaaggcaatgtctgaatgtatttctgccaagatgtcgatggtttatcaaaatcaatttcttcctgtggaagagtttaggtgcaaggggaggagagaaagtgagagaagattataacagggaggctatggatgcagaaaggaaaagcggggaatcaaaggcaaacctgccacccatttcacaaataaaagaatcagtgtgggctggatgcagtgtctcatgcctgcaatcccaatactttaggaggccaaggtgggagggtcgcttgaggccaggaatttgagaccagcctgggcaacacagtgaaactctgtctttacaatttttttttaattagccaggcatgatggcacacgcctgtagtttcagctactctggagactgaggtgggaagatcacttgagcccaggagttggaggctgcagtgagggatgattgtgccactgcattctagcctgggttacagagtgagatcctgtctcaaaaaaaaaaaaaaaaaaaaaaatgcagattcagtcagtctgggctggggcctgagattctggatttctgacaagttctcaggtaatgtcagtgctgctagtacacagatcacattttaagccacaagaaggctaggatatgaggtatgaacaaaggtgttagctcagtggttctcaacctggactatacatcagaaccaccaaaagaggttctgttgggtttgttggaggtttgtttttttttttaagctcctgatgctcaagccccaccccagattaattaaatcagaatctaggaattgctcaagtatttgtatttctaaaagctctccaggtgattctcttgtgcagcttgagttaggaaccactgttagttgataactgaaggtgctattaaaaattccataatatatgagctcatgaaggctaatgagacaccccagctaagggcatcttcctctgcaacagcaatttgctattgtacaatgggggcaaacagttggtgctcaataaatttgttcaatgaaaaaaaataagtgattggctgaatgcatgaatgaatggaaatgtttgaagtcaacagtctatggaatgaaaaggattacagtcctattatcaaaatgacaagtggcaggatgggtattttaagacagatcatcttttccatcactctttcaaataccccatagaagtacttaaatcttggcccacttttaagcctgactttgttaataactggaggagtcaaagccacaaattttccacaccattactttattccagtgtttgccaaaccaaccaacagtcactatacacttttgctactggtgttattatttacctagtatgtttctttaaattgacttactttttaacataaacaaatgtattttaaagggaaactataaatcactatttcaaatagaaaagcaactaatattccatgacatcagtagaattgacagtcaaaataaatgcaacgtaagcaactgaagcagggtgtttctgcctgccaatgcttgcctctgtcagataagaagaaggattaacaagtatagggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccgttgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtttcatatctcattctttgccagagctgcagagttttgcatcatatgggtgcaccagaatttctttaactcatccccagtgttggagatttaggttgtttctaatatttcactattacagtcactgccagaatgaatatatttaaatatacatctttcattcatatggaagaatatctttagggtagagtcttagaggtggaattgctgggtcaaacagtccattcatgtttattttgatagatattgccaaatttctcttcaaagagattgtgccaacttccataccaaccaaccacatacagaagcacctgtgtcccctcattctcaaaataatattttaaatacattaacaagatatacaaggtaatcaagttttttagtctgtttgagctgatataacaaaatatcttagactgagtaatttataagcaacagaaatctattggctacagttctggagaccagaattccaagaccaaggtgccagcagatgtggtgtctggtgaaggcctgttcctcatacacaaggacttcctgccacatcttcacatagtggaaatgttaaacaggctccctcaggcctcttttataagggcactaatcccgttcatgagggctccaccctcatgacctaattacctcccaaggaccccacctcttaatacaaacacacagggggttatatgtcaacatatgaattttggagggacaccaacattcagactatggcaccaaggaatgctattatatggaagcagttatcaaaagattgaaattacacatctgtgaaatgctaacatatgtcctttattaatgcatcaaataacaaaatctagtggcaggtaggggtgtgctgaaaagatactttttagcataccggcaacaaccctaatgtggaatgaagatacatgttgatgatatgctcacaggtactgctaataatactgttgtttgtacttcccattcgtaattgaaggaaatgcttgatttgaggtggtggctagtgcaaataacaatgtaaatttttccacccaagttttagagcctatcttggagccagctcttagagcctcattccaatgaatggcagcttatttttaatacatcaggtcagctccaggaatgtacgcttttagggaagctcttaaaattcatgtgtgggaatcagcctccatctagcctaatacatgcttcactggccttctaaaatagcaagccgagcaagaagacatagacaggcaaaggccactctaaagacaccctccggaggtgtctgcctcggctgttacttagagcaactgtttgctccttcctgcaatacagctgcactcctccaccacagggttttggaaaatatcaattaaataatatattttaaacaactttgaaaaagataaaggcatctttttaatttggggcaccctattagccattaagaattaatgttattatctcctcatctgtttagtgtttagaacctctcccaagtctgctgataatggtggcaatgagggccaaaggatggagctgcttagctctggtaaatactggccaggcacagaggctcatgcctgtaatcccagcactttgggaggctgaggcaggcagatcacttgacgtctggagttcgagaccagcctggcctggccaacatggcaaaaccccgtctctactaaaaattagccaggcatggtggcacacctgtaatcccagctactcaggaggctgaggcaggagaatcacttgaaccctagggacagaggttgcagtgagctgagattatgcccccgcactcaagcctgggcaacagagcaagactctgtctcaaaaaaaaaaaaaaaaaaggcatggtggctcatgcctgtaatcccagcactttgggaggccaaggcgggtggatcacgaggttaggagatcaagaccatcctggctaatatagtgaaccccgtctctactaaaagtacaaaaacaaaattagccaggcgtggtggtgggctcctgtagtcccagctactcgggaggctgaggcgggagaatggcatgaacctgggaggcggagcttgcagtgagccaagatcacgccactgcactccagcctgggcgacagagcgagactccgtctcaaaaaaaaaaagaaaagaaaagaagaaaagaaaacataaaatgtccagccacccaggacacaactgtgtggcctgaccgttcagttgtatcactcctcttatctggaaagtgctccagtgactacagaagttgctagaatttccaaaagcaagaagaaagtgatgggaaaatgtgtcaaatccacaatgggagaacactgtgtcactagaaaattatatgaccctggcaaccttaggagtatggaagaaagatttcaaacaagtttctgactatgtatctttttctaaatttttttgaatgctgaagaaatgttaaatttcattaagttttacagccagatttaatatagacataaatccctttaatgttcgtttcagtcaaaagtgagcggaacattatcgttaaaccagtgcatgtgggagaattacttgaggaaaatcaaaataggcacagttgggaacattaagccgtggccatattagacgcaagtaggcgcaatagcaaaattctttaggctctaatggactgggctattttgcttctcagtttccatacagatgagctttgttctggggcaatatggttgcagtttgagagtctatctgaaggagctcatttctctttcattagtccatgagcacagtgcaatttcagctaatactgttacacagctcctagctgggttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaattgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttggaccacagagtttgcccctcagtactctaaaaatatctgttcaatcacatcagtggatgtccatattaaatacattggtcttctttcttatggcaagtaactgccactctctgccaagggcagtgttctaaccttggaaacaaacaggacactcgtaggttgagaaacagaagaactagaggacggtgactcctaggggcttgaccagtggtgggcagtggagtggtggaaaccacggtggcacctcttcaccatcgcaatgtaatgctctcctcagcctccatcattacctggtgagctggggctcagtatctgcctgataacccaccttcagctagcatgagacacaggaggagcaagcttcaaactcccaacaaggtagtcagcctagttcataccagattcagtggctgtagcccaggagagaacgaggtatggggcacgtatgtctcagagcagagagatctgcctagaaagacaaagactgagtgagaagctatagtgtgggctatcagagggcagcctgggagcccaagaggcctcagacattggtcagggattggcaaactctttccgataaaaggccactttgtaaatactttaggctttgtggggttttgtcacaacgacttatctctgctgttagagtgcaaaagcagcgactggcaattcataaacaaatggatgtggctgtgttccgatacaactttacttacaaaaacaggccatgggctgatttagctggtgggccatattttgtgacctttgctgtcggtgatcaaagaaagaggacacaacaggagaagtcaggtgaggcattgcccatactgcgtggggcaacgtgcttgccagcttacattccttgtttcattttatcctcacagcaaccaactagtaacagttttaccacctacattttgaagatgaggaaactacagtttctaaaaaataggaaaatttccagggtcaaaaacagcctcatttcaaaaccaagtctgtttgacttgaatgtctctcttccttcccctacatcaagctggtacctgcagacgtatttgtctagggcagcccagccagggaagcccattgatcacagaggcattaaattccagatttgaaggtatggatggcagtgccagggccaggtgcaatctcaggagcctcagaagcttctctgtggatgtaaaagcaatgggcacagccaccattgactgcaggagctctcacctctctcatcaccagccattcagatagacaagccccaaatccgaaaggtgtcatctgtgggcctgcgtctttgatagccaggcaattacagcacctcatatataaaaagccagaggaatctgtgaatataataagtgactgtcctttcttagcgtggtgcaggccatctgtttgaaaagtacacactgcaaacaatgccaagttgtaattattaaactttctagctaagagcgagtctcatctttcttcctaattatgcattcaaatattcagaaattaagccttagaattattatataccagggatgggtttttttcccctgtgcattaaacttttagaagagaacatgagccatcatcagaagtttctcccagaaataactcccagagaagccctgaggtcagcttggaatcaacccaaccttctcactttcggtgtgatggtacaatgataattcaagttcttaatgatgactctgaatcatctcgatcctgaatcatcagagattaaattattttcaccaaacagctagtattttctaaagcaggaaaatcgattaaaggatttcagtaaaaagttagagaagtccaaacaaagcaagcatctggcaagcctcggtgaccagaacattaaattcaccaaacaccacctgctccaaatgtccatgttaatggcaattatagaagactccagtagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactctctagttttccctcactgacttcatttccctctgccagcctggtagaaacatggtctcagtccgctcaggttttgcccctgtcctccctgtctccagaagcgccctcaagcttcaaaagattcatacagccttccagagagggagacggggacctagtgctggttttcatcatctgtccactctggcttctgcagtaacaccattcccattggcctcggtggtcagttcacccagatcctgcctaaaccctggatgcttattgtcctgaccacccgaatgtcctaggccagctagttctcagcgtcacatcctcaccaacctccgctccctgctctccactggggatcaagggaatgcaggatggagctgccccaagcctgtagctcagatgcctcacaggggcatttctgatctgcaacactatgtccctgttgtgagctgagtcccaggcctctctgaggttggacatcccagcgtgcctcttcccactccaacagcacacctcagaaggaagaggcagcctcaggggcccgctgagtggccactcgtgctggatttccacccacctcaccttagggaattttaattttttctaaagagaaacaaaccagattgggcagatactcttccaaatctactgcttaagtttcaatctcagctttgaagcccagaaaaaaaagtattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcaacttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaactcaagtgtgtcacaaaacttgtgtgttatcttatgataaagcacagttcctaaatatgtctcaggacccataacatcaagaaatgccaaagctggaatgtgcctctaacccagtgtttcctggcccagtgtatactgtgaaccaagaagccatctggggtcttcatttcagacccccaaaacaaaggagaggagaatgagatgaggaaaaaggaacttgagagagagcagcttctccaagcaagcagagaagggaatggggaaggaatgggttattcactaaacaatggtggatcatctcccattacagaccagaataaaaggcaaaccaactaaagacctaaatgttaaagaaaaaaaaaacccacaaaattgcttagacagttttagtggctacataattattttatgtggggaaagattctcagtgggaaaaaggaaggtgctggatgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccagcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacaccttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacattctctaaagtgaaatttttaatattacaatcttcctctagaataatcttttgactgttttgttctgctaacttgaaattatttgctactttaatccattaaagagaaaagaaaatagaaataagaagttctttctcaacccattacaaggtgatttaaaacatgctgattttgctttatgtgttgaaactgtcgtagagaagtattttgccccatgggtctatgtgtttttgaaaagcattctgtacgctttctgctataaccccataacagctcatggagtccctttcaacaaaacagtaagtgtgattggcagaggtttgaagtattgcttgggacaaagatcctatgatgtcaaactacccaaacagtccatccaagagaataattttccttcagcttgttttgccactaaacatggaaatgtggtctcttttttcttcaagtaaacatttttcttaaatggttaattacatataagagatatgaagaaataaagatgtgcggtttgctcaatgaaagaatactgtaatttttaaacctagtgtttccctgttattgacgtccttgggtgaagttcataaaaacatatgaacttcaattagttgtataaaaatatatgatgtgcagagcactttatccatttttttttttatttctcatggcactctaagtagcacataaaacaaatgttgtcatttttagtttagtgataaggaaacaggctcagaagggttgaagggcttccttggtcaaacagttaaaattcaagtcaaagccaagattagccccatgcttcaaattatttccaaatccacatttgtactattctttgctgagtatcatttctattatttgatacaggcagcatgatgaccagaatatgttcaagggtagagcctcagtggacaggaagcttagattctgtctctaaagttagcaagttgacctgagacccctcagtctcatcaagggttgacacagggtacacaggttctgagtacaaatgcagaaaataagaaaaaagaaaatgaaatttaattttgtaatattttgtaaagatcattgctgatgtcggatagcacaattcattctctatccacatcacctgcaacctgaaaatgacatacaatgcttggaggtgtgtgtttagaggatgagaatgtataaaaaaggtctgaaaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtctttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttccctttcctagccaaaggaagccgtgacagactgtacctggaaaaatgggacacttctgcccaaatactgtgcttttcccatggtcttagcaaacagcagaccaggagattctctcccatgtctgggttggcaggtcccacgcccatggagctttgctcactgctagtgcagcagtctgagattgatctgcaaggcagcagcctgatggagggaggctgagacttgagtaggtaaaaaaaagcggccaggaagctcagactgggcagagcccaccacagctcagcaaggtctactgcctctatagactccacctctgtgggcagggcatagctggaaaaaaggagcagaagcttctgcagacttaaacgcccctgtctgacagatctgaagagggcagtggttctcccagcatggcatttgagctctgagaatggacagactgcctcctcaagtgggtcccttacccccatgtagcctaactaggagacacctcccagtaggggccaacagacagctcacaaaggtgggtgcccctctaggacaaagcttcaagaggaaagatcaggcagcaatatttgctgttctgcaatatttgctgttctgcagcctctgctggtgatacccaggcaaacagggtctggagtgggcctccaacagcctgcagctgagggacctgactgttagaaggaaaactaacaaacagaaaggaatagcatcaacatcaacaaaaaggacatccacacgaaaaccccatttgtagatcaccaacatcaaagaccaaaggtagataaaaccacaaatatggggagaaaccagagcagaaaagctgaaaattctaaaaaacgagtgcctcttctcctccaaaggaccgcagctcctcgacagcaacagaacaaagctggatggaaaatgactttgatgagttgacagaagtaggcttcagaagctcagtaataacaaacttgtccaagctaaaggagcatattctaacccattgcaaggaagctaaaaaccttgaaaaaaggttagatgaatggctaaccagaataaacagtgtagagaagactttaaatgacctgatggagctgaaaaccatggcacgagaacttcgtgacgcatgcaaaagcttcaatagccgatttgatcaagtggaagaaagggtaacagtgattgaagatcaaattaatgaaataaagtgagaagacaaggttagagaaaaaagagtaaaaagaaatgaaaaaaccctccaagaaatatgggactatgtgaaaagatcaaatctacgtttgattagtgtacttgaaactgacagggagaatggaaccaagttggaaaacactcttcaggatattatccaggagaacttccccaacctagcaaggcaggccaacattcagattcaggaaatacagagaacaccacaaagatactcctcaagaagaggaactccaagacacatacttgtcagattcaccaaagttgaaatgaaggaaaaaatgttaagggtagccagagagaaaggtcgggttacccacaaagggaagcccatcagactaacagcagatctctcagcagaaaccctacaagccagaggagagtggggaccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacaccccaaattgcaaagaccatcaatgctaggaagaaactgcatcaactaacgggcaaaataaccagctaacatcataatgacagaatcaaattcacacataacaatattaaccttaaatgtaaatgggctaaatgccccaattaaaagacacagacaggcaaattggataaagagtcaagacccatcagtgtgctgtattcaggagacccatctcacgtgcggagacacatataggctcaaaattaagggatggaggaagatctaccaagcaaatggaaaacaaaaaaaacacaagggttgcaattctagtctctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtccttagagacctacaaagagacttagagtcccacacaataataaggggagactttaacaccccactgtcaatattagacagatcaacgagacagaaggttaacaaggatatccaggcttgaactcagctctggaccaagtggacctaatagacatctacagaattctccaccccaaatcaacagaatatacattcttctcagcatcacatcgcacttattccaaaattgaccgcataattggaagtaaagcactcctcagcaaatgtaaaagaaaagaaatcacaacaaactgtctctcagaccacagtgcaatcaaattagaactcaggattaagaaactcactcaaaaccacacaactacatggaaactgaacaacctgctcctgaatgactactgggtacataacgaaatgaaggcagaaataaagacattctttgaaaccaatgagaacaaagacaaaacataccagaatctctgggacacatttaaagcaatgtgtagagggaaatttatagcactaaatgcccacaagagaaagcaggaaagatctaaaatcgacaccctaacatcacaattaaaagaactagagaagcgacagtgaacaaattcaaaagctagcagaaggcaagaaataactaagatcagagcagaactgaaggagctagagacacaaaaaacccttcaaaaaaaatcgatgaatccaggagctggttttttgaaaagatcaacaaaagtgatagatcactagcaagactaataaagatgaaaagagagaaaaatcaaatagacgcattcaaaaatgataaaggggatatcaccaccgatcccacagaaatacaaactaccatcagagaatactataaacacctctacacaaataaactagaaaatctagaagaaatggataaattcctgaacacaaacaccctcccaagactaaaccaggaagaagttgaatctctgaatagaccaataacaggctctgaaattgaggcaataattaatagcctaccaaccaaaaaaagtccaggaccagacggattcacagccaaattctaccagaggtacaaagaggagcggttaccgttccttgtgaaactattccagtcaacagaaaaagagggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccaaatccagcagcacatcaaaaagcttatccgccacgatcaagtcagcttcatccctggaatgcaaggctggttcaacatatgcaaatcagtaaacgtaatccatcacataaacagaaccaatgacaaaaaccacatgattatctcaacagatgcagaaaaggcctttgacaaaattcaacagcccttcatgctaaaaactctcaataaactagatattgatgaaatgtatctcaaaataataagagctatttatgacaaaaccacagccaatatcatactgaatgggcaaaaactggaagcattccctttgaaaaccagcacaagacgaggatgccctctgtcaccactcctattcaacatagtgttggaagttctggccagggcaatcaggcaagagaaagaaataacggtattcaaataggaaaaaaggaagtcaaattgtccctgtttgcagatgacatgattgtatatctagaaaaccccatcgtctcagcccaaaatctccttaagctgagaagcaacttcagcaaagtctcaggatacaaaaatcaatgtgcaaaaatcacaagcatttctatacaccaataacagacaaacagaaagtcaaatcataagtgaactcccattcacaattgctacaaagagaataaaatacctaggaatccaacttacaagggatgtgaaggacctcttcaaggagaacaataaactgctgctcaacaaaagaggacacaaacaaatggaagaacattccatgctcatggataggaagaatgaatatcatggaaatggccatactgcccaaggtaatttgtagattcaatgccatccccatcaagctaccaatgactttcttcacagaattggaaaaaaactactttaaagttcatattgaaccaaaaaagagcccgcattgccaaaacaatcctatgccaaaagaacaaagctggaggcatcacgctacctgacttcaaaccataatacaaggctacagtaaccaaaacagcatggcactggtaccaaaacagatatatagaacagaacagaggcctcagaaataacaccacacatctacaactgcctgatctttgacaaacctgacaaacacaataaatggggaaaggattccctatttaataaatggtgctggcaaaactggctagccacatgtagaaagctgaaactcgatcccttccttataccttatacaaaaattaattcaagatggattaaagacttaaatgttagacctaaaaccatcaaaaccctagaagaaaacctaggcaataccactcaggacataggcatggacaaggacttcatgactaaaacaccaaaagcaatggcaacaaaagccaaaatagacaaatgggatctaattaaacttaagagcttctgcacggcagaagaaactaccatcagagtgaacaggcagcctgcagaatgggagaaaatttttgcaatctacccatctgacaaagggctaatatccagaatctacaaagaacttaaacaaatttacaagaaaaagacaaccccatcaaaaagtgggtgaaggatatgaacagacacttctcaaaagaagacatttatgcagccaacagacacatgaaaaaatgctcatcatcattggtcatcagagaaatgcaaatcaaaaccacaatgagataccatctcacaccagttagaatggtgatcattaaaaagtcaggaaacaacaaatgctggagaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactgtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggagggatagcattaggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccaattacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctgaagatgattcctgcttgagtgaaggagaatttgaataaagcgtcccttccatgagtgtacgatatgtttatttcaaaacccctctgggatgaaatgatattatgcctgatgttttcttcagtattacttatggcttgtggcaggagggaagagaatgactgaagtatagaggcaataaaattggttatgggttaatcattgttaaagctctgtgatgagtacatgggattttactctatttttgtatgtttttgatttttttctaataacaagaagtaaatttaactagcatacggcataaaaagaggtaataacaaaactaggacttcagtttggtatcatgaaactgttttggtgtgcaagcttccaaggagcttgcaatgtcaaatgattgggcaacagatgcccaagttactacaatgcaaaaatgtagcccagactaaaataacacaaggacagctaatgcaagttgaacagttactgtatttaaggcactgttctgtgttttgcatgtattcattcaactaattctcgtagtaaccctctgaaataggtattatgattttccccttttggaaactgaggcacagagaggttaagttacttgtgcaaggttacagggctaataagaagtggaggcaggatttgatgccagtgggtcattggtctaggattttatctaaggcaataggtagagttgggagtagggaacgaatgtatcccagggcaaggatataatctggacaaagataggctggcggggaggtgcaggatatgttcaggaggtggtctggataactgctgtgggatttggaggctggtgcaggaggcagcattctaagaaggatccgcaagtgaggtggagcataaaagggttgaaaaagttgctaggagaaagaaataaattctgtggttgggtcagaaactgggccaggggcatagatgaggctcattctctcattacactcaagataatgctgctactctcagaagccccaatagcctggagcctggcacttgttgttggctggcataggacccagcatgagcctcccaccagctgtgcagacaccaaggcatcccacaggttcttcaggtgttttctgggcataggcaccaaatccgatgccccatctctgttcagcagagttggggctcttgagaaaggctggtgtcagcatgccctgaaactccagtatagggctgacatgctgagcagcgataggcttgttgctattaactattccagccacactgactgccacaaaggctagttacaatgcaggagcaattgcttcacaggaaaaggcagcggctgtccagcacgagattctcactgctgtgaaaatagaaaataaaatgcactataggggacactcaaagaagtaaaatgttccccttggttgggagactgagttcaatagcaacacatctctcctaggttttcctgacactttaaaccatcatctcataccctctgcatttactcattgttttcctttattaaactccacgccaagggtgctttaggaaaacaaacttcatacatatgcagaactgcttttagggaatgtgtatattagaatagcttgccttgtgctcgatttgcttttgttggattattcctgtttaagcagagcaagcgtatttattctactgtgaaccatttaataattacatgcagtatctgagctccagggatgtacttgaaatacagttaagacattttcaaaaagagtataattttctcttagcttgcaatgagcaaaatacatttgaccaaacaaaataataataatagtaactcaaattgtaaaaaggtagaaaatacacatttaatcagcatcagtaatgtgcaaaacagatataactgatttgctgagagctatcaggatttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaatctctcttgcatagcatttctttgacaggtgttcactactgaaatgtcatccctgccattgacgatatttatgaagcattggggacgcagcatactctatctattaaaccctaaacagtgagagattctaggttagatgcaattcttggctgcagaaagtttactataaattcaggaagagagaagacatttattactcaagcaaacaaaatggagggaaggaagatggataaatggaggctgaagaacatttatctctttgtgagccaatgtgattgatagcattagttaaaccttcaaataagaaaggttttctgggattaacttttattttcttattaaaagtcatacttcattctgaagaaccccaagcaacaggccacaaaaaagtgtgagaaaaaaggccctctctggttggctattttcacactgatgtaagctgataccttaccctggtgatacttaatggtttgggagtagatgaacatctttcccttatgtctttatgaactaattctgaaacacctcctggataataaaatgcaaactgttttcaaagacatagtctttttcatgtgagctttaagactacctcatcagtcgatattagctcaaaggttactgcttgtaaccaaccctttctacatccaaaccagagcacagtgaaatccaacagcatttaatttttaaatttctagtcccctacctggattagaaaagtatttattatttaaatttttccttcagctaaaaggagtagatgtaatatagatttaggggttatggagaaaattataaagatggtaaaagaaagacctatatttgggtataattagttctactttgtaagctaatgtgtacatgccatatagagattttatggtactcagacggcaatcaataactcttttcttaagagagagaaatacagcacattatgtagacaaatgtaatattatgttaattgcttggtatggaatgagtgatccctgaatcagttcccttatctataaacagggactaaagctcccaccttgaaggcttgtactgcggattcaagacaggtatagagtgcttggtacagagcatggcacatggtaagcactccctaaccgacaaccaatagagttgtgaaattcagcaaagagatttctacaggagctaagtcaaagattattcaacgacaaagaaaagtaggagaatttatgctacaggagtaaatgtagcattcacccacctttctcagacatctgctctctcatttaagcttttgacagaaactggataacagtcagctcaaggttaaactctctgtcaagattctagtgcctgtgtttctgcattgctgattgaaaaaggagttatagccaaagataccttgtatgcatgaaacaaagttgatctattaggaaatttgaaatgtctagcatctggcctcagaaagatgaggagtctgctcacttctccagaaagcaatgggtgcttgccagcagactcagggacttccccagaggcagctttgctcattctcacctgtcacctattctaacctattctgcctgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatttgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacatacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagctgatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagaggaagagaatgaagataaagaagaagaagatgaggttgaagttcagcaacaacagaacaacagcaagatgggaagctttgccgaccggataccaaaacattacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttatgatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgagttattacctaaagacctggaatcaatagaaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatgatcaatgttgaaaaggattgagcaacaggattgctcacaccttgaaggaggtagtacatagccatataacctgttttaaatcctacaagaagacctcagagaaactattccttatgggtacatggaaataataaacaagaatgtttcttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttagcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctatatgagagtcatcatactattcactgaaattgtctatatttttttaaatatttcataatttcacatatttaaataataagcctgagccaaaatggaaaccccaaagtgtcagacaggcccattcaccattaaaagacccacttctacacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcatgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacatacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagatctgatggttttataagcatctggcatttcccctgctggcactcatttactccttcctgccaccctgtgaagaggtgccttccaccatgattttaagtttcctaaggcctcccaagcaatgctgaactgtaagtcaattaaccctctttcctttataaattacccagtctctggtatttcttcatagcagtgtgaaaacagactaatatgggtattagcaaatgactgaactaagaaaccagcaaaagcagatttaattacttagttactttttgttttagtcatggttctccagagaacagaaccagtaggatgtgtatacatataaaaagaggttcattataaggaattggctcacctaagtctggagactggcaagtccaaaatctgcagggtgagccagcaggctggagaccctgagagccaatggtccagcttgagtctgaaggtagcctgctatagaaccaggaagatccaacgttacaggtgaagtccaaagacagtcttccagagaattctctcttctcagagaaggccagatcttttgtctatttaaaccttcaagtgattggatgaggcccacgcacattatggaggacaagctgctctagtcaatgtccacaaattgaaatgtgagtctcatccaaaatacccttgcagcaacacctagaataatgtctgactgaatgtctggatacctcgtggcccagccatattgacaaatgaaattaaccgttacaattttaatctgcatgtttctaataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaatacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtgtattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccgaggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactttaacacaagggctgacctcttcagtgacacagggtttacttgtatatgatacgcagatttcatttttgttccaaagagaattttgagcccatgagagatctagccaaattcgtttcactgcatatctaatgtgtctttatatttttccaaagccacgggacccgatgtgcaggagaagtttctgctgccgccaacaacaatatctgtggagttggagtagcatacaactccaaggttgcaggtaagccatccctgccaaacagaggcccccactaggtatcacactgatctcaaggctgactgtggcccagcaaaaaatcccactggtgcagaaaagctaggatccacagatttggcacaagtgaaaaaaatttttttcttttaacctgcataacaatatcaatagttttaaatttttaatttaagcataatataaattcaaaaaagttaacaaatcataaataagctaatgacttttcccaaactggccatacccatacagtgatcaggaaacaaaatgtaaccagcaccccaaacatgtccccttccagttactactctgacacccaagaataatcatgatcttgttttttaacagcaaaaaaaaaatggttattgccagtttttgaaatttatataaatagaattgtcagtcactactcttctgtgtcagtgtcaataacattttaatgagtctcaaatatagactatagaatacaaggtggtgtgtataaattatttgtaaacatactcagagctcttcaaaatgttttgcacaatggaactcatctttaaaaagagaaattctgcctagaacctttttcttacatttcattgggtaggatatttaagaatttcctattgatggagcctttagaaataagagtggcaagtcactggaaatttagaacccaatatccctcccctctcagaaaaaaaaagagagagagacacagacagagacagagactgagagattcataagctttcaacgagatgtctgagaatggagtggcaccagtctttttccaagttttgcatcaaattgattcttaatttattcaggctgagtcacccaaccttgtttttcttttttcttttcttttttgtttacaactgtcctgatattttcttttcctggcaatttaatggaaccataaacctactttctgctgacactccatttccatggaactaaataaagcaaaggtaacctatacaaacccactattaacctcttttcaacactgtttgctaagaggcttgcctgaactgggtgctgaatgtcacaaaagaatacatctggaggtttctaaaatgtaaatagaggaggcttagcccctgggtttcagctctctttactttgtgcacatccaaaatgctggcattaaaatgtcaggagccattatgagctcaggggaaagaatatcactcggttaatattttataagccaggctcagacctgggatggaatctaagggaggcgggttctctactcacaggacagaactggaagcaactgaaaaattcaaacctgaatttcttgttcacacacccaaggtaactggtttttggaacaaagtaaaatgaccacctgcaaaagttaaaagagttagggggagctcacagctttctggaggttcctgggagcttctttttccatctccttcttttccttttttcctcttctcttattatttgcactctgaaaacacctgagcattgagtgctcatcaaatgtatctaattctcctgctgtcttagtttgctcttcctaaaagcaaaacctgagacaaggattccgggcaagcagttaatgtgggaggtggtccccggaagccagagtgagggagttggggaagaagacaggaaaggaatggaggccaacgaagtgagtctcatggacaacaggggccccgtcctgcaggtaattctctgaggaagtgtggagaacacccctcagaattgaccccgctaatgtgaggaggctgcggcattaatctgccagttcccatctttcattgttcgggggtgccgtcgggcctgtccagcctgcccagctcgcttgaactgagtggagctccttgagcagaggacacccccaggcaaaaagccagggagcaggccagaggacccggtgggtgcagcagcctctgcctcgcctgctgaatgcagcctgacacctcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattacaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaagttaaaatgtggttgaatcttaacccagggattcaaaaaagaagagtggagattgtaaattgagtcctctgaacagaagagagcattgagcatctctgcatctacctgagttcctcttctgttcataaatttttctcatttttccatcaaggctcctgtctttttcttgttgatttgtaggcattcttggtgtgtcccaaaggttagcccctaacccattttaatcaatgcaaagatcttctccttcatttctcttcgcgtccgtcttcatttcaaactccgtgacatgtagacccgcacatacgggatgtcccaaaagtcatcctgcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccaaatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggctctacagttcctcactgttctggatttctgcagagactctcagagcagccctaagagggggccaggccaggtgggtttggtcctattcaccttcctttttaaaccaaagcacacagatttacacactgggcttcgggatgagatcacctttgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgagcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcattgttagggatgtgaagacacagactcctagctcctttgatttctctctctctctctctctctctctctccccccacttccttccctcctcctcctcccccccttcctccctctctccctctctctcttcctcccctcctcctcccccccccttcctacttctctccctttcctctctctttccctctcctctccctctctctctaccttctctctcctacactctccctctctccctctcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatctcggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaagaatgctaactgataactgggtgtttgttgtcaaaaatggtgattacacttatgggttaatagtagaagatggataagcagagcctgttattcattcttctggacctgttatttgtgttggggagaaaatcaactaaataaggtaataatgccagatatttattcaccaaatatttgtcaagcttaaaataaataccaagcatcatgttgatcctcaaggacatggaagtgaacaaaatagacacatgccctatactcaaagaccatgccatctggtggtatatgaaacacgcaaataagtagttgcgatagaaggttaaaggtacacaagaagagggctatgagcactgaagaggaaagtgagatcctcgagtctcctgaggactgaaagtagtagtccctcaggaaagaaagcaatttcatgtccatttcagctgcctggcaaggacctgggtggcttttaattcgattgacgtgctcgccatgttagagagtgaggcttgtgaaatagtgtccttcaggcacaacatcctttggccaccggggacaaggaaggagttttggggcccagattttgactgtgcatggcccaaccccttcattccataatcgcagtgggtggaaagactcaggtcagcttcactagcactctaagctccatgccacagaattgtgaacccactgacccatccagatgacaaagcctggagagaggcatgtgaccccgtcagcgaagttttgagggtagtgatggagagacagcacacccaacccaatggcggctactgagatccccctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccggggggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgcctgtaaaacggtgataatgaggggtcactatgatgtataaatgagataaagatgcaactgctcggcactgagaagtgcctgcaaagagtcagaatttgtcccagtctcgactgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctgcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgataccatgcccagctaactttttgtagacatgtttcaccatgttgcccaggctagtttcaaactccgggactcaagagatcctcccaccttggcctcccgaggtgggattacaagcatgcaccactgcacccggcctcttccaccccatttttctccatctcttcaccactcacagcctccaaaatcatcccttagcttctgtccctgtgtccgtgtttgtattcctagtgagtctaagcctctgaatgctaggcaatgtaaaatttgtaaaagaattgatgaaatgagctcagtctgattagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacattctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctgagtcagtgcttctcaaagtgtggccacagcccacctgggagagtgaaaaatgcaaaacctcagcgcctcctcccctcccacagatgccgcattttaacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggaggggcttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccaggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaacaaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttggttgttactttggtcctttggttgtggtccttctgtagcagccctggcaaactaatgcaccttccagtcttagaatggatcatcaaaaaggaggtttggcagtgcgggaatgacctgctcactgttcaaggtcaccttgatgtcacctggccctctgctttacagccaagatggtcaatagttgatccaattacgacttttttcttctagttcaggaccttgagaagtctccctccctcccttctctgatgtagcttcctcgaaggaatgagcgtgtgaaaatgctcacgatgcagtcctaggagagaaacatgtttccaagttagggagagtgctgtgctgaaatgctcccaataacgtcacactgggagcttgaaattcaacatggaaattgacgaacactaaaaataaagcccttttacgcccccttcagggagctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttatgtttccccaaaatgacaagtttcccaaccagagtcctaagttaccccaagactgtggaggacaacttttctaagtcaaggaaagatctcacactttaaggaattcaccacttttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcatttaggatgaaatttttgatgcacagacagcctgtttccttattgcattattcattgtgtgactggagagaaattgttacacatccaagccccagaccaggtgacagcaggtgcccaggggaacagttggcagattccccctttcctcagcagacatggattttcactgagaggcactttttttgacacctgaggccaaaagagagtcgggaaggtaggagatgtgtgccctctgtccagactgacagtgcagatggtggcagcgctccacatccctgggtgcccctgtcattttccacggacttctgcacttctccactgcctctcgaagcaggatatttctctctcctccatctgtagcctccctggctgcaggtgaaaaggccctttcaagtgtgattgtcctgcaaagcatgccgagcccgctgaagcttaagagaaaaattgttatgactgatcttcagatgacagcaagtacatcttttagaaagtggagtgagtatgatgaaaaatacattatttcacatttgacttttccccaagaaatgggaataaatttccccaagcaatgggaataaatttccccaagcagtgggaataaatctttccttgtttcaaggtgacattttttggacaacattgtagcattttggaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgatggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagtttattgggaaggtgaagagaataccagtgatgaatgggaggtgtggcaggaaagagacagggccagttaagggtatgttatcctgccagtcatcgctgtcagcaactggagcttaatgccactgggaaacttcagaaaaccacaccaaaacttgagaacacaccccaaaggtatcccaccctgtgggaaaggagctggaataaaacccattgatgaggtttgttcccaaaaccttgtaaatgccccagtgctttcagcctgaggacagatgcacagagcagcctttcagcctcttgggaggaagcccttagacaaaaagatgcatatgctgacatttggaaactcccaggcacagggaattctaaagcccaagggatatgggctcacacacaactcccaaagtgcagcttaagcaaaacctaacctgagacttcgagtcatcactctctggataaataaagcactggcaaggtgatgtgtttactgttcaggaaaaggatgtagcccttgcaaagagggagctacaaaaaccagccattatgggacacagcatcttattttgctctgacaaccagaaggggaattcgggtgacgctagaaggtcttgaaagtgacaactgattcatgaacgtctttccacaacttgaggaaatgcagccacccagggcaaccctggcacaccttttgctggctctgatgactacatcccaacttcttcttaatcactcttcagagttgctgctggagggaatattttaggaatatttaaagacaaggctacaaaaattctctaaggtacagatgagacagcgcattgattgtttactccctaaggggctgcaaagggcaaagcacagaactcaggtcttcttccagctggaatgtatggacagggaccacttacaagaaaaccaccatccaggaaagcaggggacagagagctgcctggggagacagtgattaatcaggcatgggcgaggggaggccacagtgcctcctgctgaaatttaatcagagccacgggtcgtacaccatggcggcgagtgccagggcctctggcagacgatgaatgcctcctgccaaggagctctcacgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggcgctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagtgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatttttcatgaactacgagtgcagaaaggcaatattcataaatcaatacattgtttcatgtgcaatttaaaatgtgtttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtcattaaccctggtggctacccattggttagggtggagggactgactcactttagccacaagtttctcagagtgggatttccacctcctcaaatgtaggcaatgcgctggggacacagcaagccactgcaccagtctctagctggaatgtcaccttagctgacggtaagcaatttgtaacattctttttatattatgagcaaaataaaaaaattgcttgaatgtttcagaaattttgggcttgtgagaggctacttaaggccatgcccagcaagttccaactcactgctctcactgagcagggtttctcagcctgggcatatggacattctgggcaaaatactgttttgtcggtggtgaggaggttgtcctttgcatagaagtttagtagtctccctggcctttatggactagatgctagtaaaacacacatggttgtgatcaccaaaaatgtctccatcactgcatcctggagaaaaagtccacactagttgagaaccagggtggttaagtacactccatagtacctaggttaaaagtttccatttggtaaaaacttttgagaaacactgtaatcccactaaactccaaaagactggcagaattcaaagtggagttgcaccactcacttaatttcacctaaatgcacttgcctttttttttttttttttttcctttcacccaggctggagtgcagtggtgtgattatagctcactgcagactccagctcctcaaactcctgggctcctcccgagtagctaagactataggtgtgcctcaccacgccaagctaattttttcttttgtacagatgggggtgagtgggcctctcgctactttgcccaggctggtctcaaactcttggcctcaagtgctcctcctgcctcaaggctccacttcccagagcactgggattacaggcatgagccatcaggctggcctacttgcctcaggcagctgacagccattccactcactgagcatgagctgcaggattagggtggagaccccgccccccagcagacagccccacccacagtgctggctcttgggtcatggcctccctttgtccttcagctccagggccaccctctaatccatgggtgaattcccatttcccttttgggttttaggctttcctttaacacctattccctggataaaattccctctgttgacctgccaagtgtggcaatatttgcctggctgaatttcaattgatatattgtatatttattgggataatgttacatatatataaatatacatatatatatgtatgtatgtatatatatatatgtatatttgagactgagttttactcttgttgcccaggctggagtgcaatagcgcgatctcagctcaccgcaacctccgcctcctgggttcaagcaattctgactcagcctcccgagtagctgggactacaggcatgcaccaccacgctcagctaattttgtatttttaatagagacgaggtttctccatgttggtcaggctggtctcagactcccgacctcaggggatccacctgcctcagcctcccaaagtgctgggattacaggcgtgagccactgcacctggcacatttatatattaacatagggaaaattgacatctctgtgatcctgtctttctattcgagaatatggccaatatctttccatgggatcaaatcttcatcttcgtccctccttccatagagttcagagaggttcaaagccttatttagcacttccttagcttttttttttttaagtttgttgaatttcttcccttttttttttttttttttttttttttttttgtgacggagtctcactgtcgcctaggctggagtgcagtggcgcgatctcggctcactgcgggctccgccccctggggttcacgccattctcttgcctcagcctcccgagtagctgggactacaggcgcccgccacctcgcccggctaattttttgtatttttagtagagacggggtttcactgtgttagccaggatggtctcgatctcctgacctcgtgatccgcccacctcggcctcccaaagtgctgggattacaggcatgagacaccgcgcccggctcttcctaagtattttatcctttatgtggccagtgtaaatggggctgcctgtagggtggctgtgaagactgaataggataatatgtgaagtacttaacaagtccctggcatgtagtaagtgctatggaaatgcttgctgtgatagtcaacctttgttttctgcacttcttcctctaacgggttatggtttagatgtgagccatagttgttctgtctcgatttctgcctagctcctgttcaggtgaagctgagaggcagaaatggatcaagccttaagcagatgcccaagatcaaggcactggcaggttcagtgtcttgcaaaggctcactctctgcttctaagatggtgccttgttgctgtatctcatagaggggacaaacactgggtcttcccatggtggaagggccaaaaggggcctagctatttccctggagcccttttataagggcagtaatcccattcatgaggaccaaactctcatgacttaattacctcctaaaggtcccacctcttaagactatcatgttgtgtctcaggttctaatatatgaatttgggggggacatataagttcaaaccaaagtagggtggcatgccagcaacagccccatcccataaccagctctcagtcctcttatggaggtcccttccccactcatttctgcccccagaactagagaattttcctcactggcccatcttccccagaagccagagactttttggtgctaaaacccaatcaccagaagcaaggacacaattattattgcttcatgtgtcctatctagcttaagaaaacaaagtttaatattcctagaaaacgaagcattcttgtgggcaagtctcatggtttaaaacaaaattaacgtttgctgtttactgttcacggttcagaaacaggctgacaattgctctctgtgtaacagtgagctggctgcataacaaactgccccaaaactcagtagcttaaaataacaatcatttaattttgctcttgggtctacaggtcagctgcgttgttctgctgatctgcaccaggctaggctaatctcaggagagtgagttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaaggcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatgatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagcgattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccacaggtgaacactaagcagccccaagccccattgccttggggtaagaaagtgggaagcaagaaactaatggtccaatcctgggttgtttaggtagagaggaaaatcctcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcattttcactaaaaaatgtctgatacataaagagatgtaagaatgagataataattacctctagagagttgttttttattttcctttccatacagttagacttttcattgtgagcatgtaccacctttctagcttttttaaaaagcagtttatttgtaaattttaagacagttcttccaattttcttacctcattatccccagcttaaattgtaaattcagttgacttttttagattgaattcttcctggaaaaaaaaagtttcccacaatgccctgccagaaggatatggtgtccaacccagtttaaaaagtgcacccagtctttaggttcaactgctgaagaagcccaacccctgggctggagacctcccctgccccctcgcagcccaggctgtgggtagcggcagcgtctcccctgctctccccagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggtgagcacgtccccttctgtccttgtttccttagggccactgcacctctgtgtcagggtgggatgctgggacactggcttgctcccctcctgtcccctccctcagagcctgaactaaggctctgaagggaagaccccttttctctatgcccagtcctgctttctaacaaagcacagacctcccatctgcgagctagtagcatgatcggtgaggactcctttctggatcgttttccatagattttcttgtttattgtttctggcttacaagtaatgatgaagtctggtttaccaatcagttgccccattccatcacttacaagaataactaactcattgtaagaaccaaggcatcacactgtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcatctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggacgcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcctgtgagtactataattttgctcaatagatgcccttaaacctccctggtaatttcttcctcaaaataataagctctcttgaggatcctacagacagaggaagaattcccgtcgtttatacatgattttaatgaacaccctggctctcacaaacattgaaaatgaggtttttcactttgtgaaagtcctttaaaaatctgtttaccagtctcccctctaaataagagttgtggaggtgatacccacatattgggttgtcttgactcaacacatctcagaatctctccgtggattttagatgtagagaaacatgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaataaataaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgagaggccatgaatagtcagggccaatgaactctgctgtgcatttctaagtggcccatgtgcccaccagcacacgtgcgtgtgcatacacacacacacgcacacaccataaaaccacattcctgggagcacacaacacccagcagcacgtattagcaacttactcagatacccagtgaaggcacagagatatttctttcttcatcaaatttacccctctatcctctgtgtatccctgggctcttctactccagtgatattcacaatcagctacttgaagacaaatcaaattgccaagctggtgtttcagaacatgtggcaaacaaagtggtcccactcaagatttgttaatttgtgaagtggattcactttttaacactgaaacaagataggcaaagtcacgcagtgtagaccaagatatgggctttcctgggagaccttccaagctgaaggtaagaggagaccatctcctatgtcctcaccatcctatggagaggccacatattgctactgctggacacaccttggatttgagtagcagtggaggtacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaataaaaaaagaaagaaagaaaagaaagaaggaaaccagctgagtcagccatgttgaaggggttttccaaggagccccacccagtggcttctgcttatttctcattggctagaactgtcacatgaccaccgccacacttcaagggaggctgggaaatgtaattttatagctgaatgcattgctgttctgaataaaactgaagttttcttaataaggaaggagaaaagatagatatggagggaaatacaactgctaatgtcttctggcatctaagtggacaatcactcatctctggatctctattgtcttatcaacaaaaggtagcaagttagatcatcaataaggttccaatgacttcctggaatattttagctctgcttctgaaatattgtttttttagggaagttaatattttaattggatgtctggtgatttttaaggttgaatatgccttaaagctgaaaaacgttcatttacatacttttaaatattgaggtcaatacttaggaaatagtaatctaatttactttaacttctgatatatgtgatatatgttatcattaataataataaagtctttttattcagtgtccagcactgtgctaggtactttacatacataatttacatttacatcctgcaacaaacctataaggccttatgcccattttaaagatgtaaaggctagagctcgaattgttaaagtaacttatccgagttcacacagttggctttaagcattaggatgcctgttccactgggctctcggtggaacatagaaaaggccctgccactgtcttgcctgtggggctcaccactcatcctgccatggcaatgggttgcagtgaatgagttagctcttcctcaaacatgatgcacaaaatcaggtttcactttctttgagatgagattttccacaccacaactacaccagggagtcatgaaaactgaatttcctctcacgtccttataggacgtgagcaaacaaaggctatggagaaaataccagcttgactcacaaatgcattatttttctcagactggaaataatccaacctttgaaattattttttaatcctatcaaaatttagaggatagactcagaattttaaaaatgaaagaaaatgaatggatcttttacgactccaaacatctcttatgatgaagagaacgagacccagagaagtgaaacaacttgctccaggtcacacagtttacattgtcagataaagatcagatccaacaagtaaagggattaaaattctcctgttgacttctagaatttaccagatgttaggagaagtgattcctccaaccttaagactacagcatcatctttaaaacatttccattttcaatttctctaaagatgcatgtgctgactttaaattacttttgctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaagtcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgagcctggacatcatttttttaaccatccccaggtgattccaatgtgcagacaaggttgagaaccactgtcccagactaccaatgttctcaaacatcactgtacagaagaatcatttggattaaatgcaaattctcaggcccacaatctccaagatgctgattcaggacaggtggaaattcacatatgtcactaatggtcctgacacagggggattgaggatcacagtgagaactcctgactaggataacacagaggctccactgatgcctccctcagcatcctgagctcccccatcatgacagccctcacattttcaatactgagttgtccctctgtccccctaggctatcagctggtggggacagggacatccgtctgacatgcccagagttagcacgatgcctgaatgtggtagacactcaacagacatccatacaatcacttcattgcgcagtaccttctcatatatctgcatcttattttcccgactcatataaaacatttgagaacagggaagaacatgtcacatttcttgtcctacagtctccaaaacagtgacctgtatatcgcagatactccataaatttattttttaattatttaataactatcacctgtaattcttgggctgctatggtacaattaaagcaggttgatgaaataaatacctactttacagaatattgtagtctgtcaattcctaaatcattcagaagggatactagaaggaacctggttttactcttcagacatatgcaaatagcaggtcaaacagtgtcatagactcagttacactggagagtgaactatgctgtggtttatctcaaaagtgaaaagttccttgttctgaaacattatttctctctctctcatgctctctctctttctaaaatgcaccccatgagaataaatctgcagagaaacatttaagggagcccttctccaggcatcagaagtacagcccattttcatggcaaagatgagaaatgagaaacctgctagccagccctctggtcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcactcccagagattctgatttacttggtctgggatgaggccctaggcatgagatcttcaatgcccctaggagaaaattttcatgggcagtcccaacaacctgtgcgataacctggcccaaaaacaaatcatgatttgcaatttgaaaaacatagacaatgtgtagtaatagacactaatttccaaaaacaataacatttacaagaagactagtttattcactgaacaatgtgccaaggaccatcctggacactaaggatataaatatgctaaatataatttctctacccttgaagaactggtaccctccttttcaaaaatggaacacacccacatgccagttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctatcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagtaagtgggggtagtggtccctctgctgcatgtggaaagtgcccctgagatggctccatggcattggcataatatcacattccctcttcatgtttgggtcaactgtattttttgtttgtttgtttgtttttttgagacagggcctcactttgtcacccaggctggagtgcagtggcgtgatcacagctcactgcagccttgaacttctggtctcaataatcctcctgcctcagacttccaagtagctagggccacaggcatgcgccaccacaccctgctaattttttttattttttgtagagacaaagcctcactatgttgtccaagctggtctcaaactcctgggttcaagtgatccttctgccctggcctcccaaagtactgggattacaggtgtgagccacaatcctcggcctggatttgactcagggacaaccagtttccaagcagagctgcaggtttgcataaatccaggaggcaccatttacatagaacacagaacccctgcttttggttgtgagccttaactgtttcagtgatgtatgccattatttctaagggcacaaatcaaccactataaacatcacccagctcaataaggagaacatgactaacacccccaaaggccccccgccgtgaccactgccattaacatccccatgccagcgtagccatattcttacttctaactccatagcttaacttgcctgttccatacttactagaatcatacactatgtcctgttttacaactagattatttcgcttggagttatgtttgtgagatccagtcatgtttaatgtgtacttacagcttttctcattgctgaagagtgttccagtgtatgactataacacaattcgtttattcattctacctgtgggacaatctaaggacttgattttccgctgagtgaggtggattttgccacttggagggatttgtgtatggggttccctacacagaaaccacagcgttagtcaactgcacccacttcccttccaactgccccaccttggcaagtggattggtcagtaaggatacttcttaatttctctctgtcctccttgatgcattagtaaaatggagatagtaatttttattattatcactgaggtattatttacatgtcatcaaatacacagaacttaagtgtatcatttgagtgttgataaatgtatacaccctggtaactaccactgaatcaagagatgaggcattccatcaacccaggaagattcgtcatacctgcttccagctcgtccacacgctccacaggcaccctttgtttttgcttctctctctgtagattcgtttcaccagttttcagactggactgtgtccagtttctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttgtcagcacattaagtaaaaagctctagtggcaagtctaatggccacaataatttcagagcagcagtgatgactaattgctgctgcaggatccatgcagtggctgtggtgggacacgaaaatctgccagctctttgatgacaaagtccgaggaggagctaatgccactctgctttgtggcctgcattcataatcgaaagagaagaaaagtttctgttataatctagtgaaaattaaaatgtggaattttttccattgaaattattagaccccctgaattctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatgtcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccataggccagcatcattccacaggccagcatcctgccgtagacaggcagcctaccataggtcagcatcctccacgggccagcgtcctgttgtagacaggcagcctaccataggccagcatcctccacgggccagcgtcctgttgtagacaggcagcctaccataggtcagcatcctcccacgggccagcgtcctgctgtagacaggcagcctaccataggtcagcatcctcccacgggccagcgtcctgctgtaggcgggcagcctaccataggtcagcatcctcccacaggccagcgtcctgctgtagacgggcagcctaccataggtcagctcctccacgggccagtgtcctcccgtagaagggtagcccactataggtgagcatcctcccatgggccagtgtcctcctgtagacgggcagcccaccataggtcagcaccctccatgggccagtgtcctgctgtagacaggcagcccaccataggtcagcatcctcccacagaccagcatcctgctatagacgggcagcccaccataggtcagcatcctcccaagggccagcatcctcccatggacaagcatcttcccatgagtgagcatcctcattgtttactcactgaacccctagaaagtggcaccaagtggattactgccaagctgagtattttttttccatgaaacagtccatgatttaagaaggcctcactctaatcagcaccacatggaaaaaataaagcttcagcccaagccctataataatctaaaaacacagagctgcccaagtcccaagtgatgttacaaatgtcctataataaaaatagctactctgcacagttcctcaccattttccaaagcttctgtgtccacacatcatttctgttcactcccgtatccctcctcttggcaggacagacttctctgagctctaaacaagttgattgacacagtcaagcccacagaggctgtaaatgtgagactggaagtcacttttattgagtgccaactgcatgctatgtgctttcatacacgtaagcttcacagccaccctattgttgagggtgtgccttatactcgcacagtcgaggtgggagcaggggtgaatattttgcagccttaacaacaaactggtcccatgctgggtgtcagggagaaacaccaactaggtgtggtatatgctaggcccatttacattactgtatttaatccttgtaagcccaggaggtgtgtcctatcattattactttttatacacaaggaagctgagatccagaaaggataaaaaaaaaaaaatgtgctcagagtcacaaagggcagagcaggacttgaagcaaagcccatctaaacccaaaccccaggctcttttcactacatgaccttgaccttaatcagctcccgtgcatacaggtcctacattaggccgtatgtgagagcagccctactgtgagctcacagtgccattactgatgacaggaggttgggaaaggtcaagggcatgctaaatgtcatccagctactaagcagccaaactgggatctgagcccagtcactttgacccctcacggtgggctctcaggtatctcagtgactccccctggagaaggtgaggcttgggtaggggagggagtttcagtaaacattcccctggggattctgaaacacccacctagtgggtgctcccatctcccaaaccccatcactggcattccagaggcccttttcactggtctacaatgccaaggtctgccgtgtcttttgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcggccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaactttatgcaagatcaatgcagtgttttcaatgaagagaaatgggaaagcactatatttcagcactaactcagttggggcctcccaatggactgggccctcgtctgtcatattcatggtgtaaccctagtgcctacaatagtgctgggcatatagtagacaggtgataaatattttttaaatgaatgagggaatgaaaatattcagccagcagcagccggacacaagggaaatgtctgactgctggcaataggaccggcgggccagcaaggcaaatgtgggaaggaggctctgccttggttggaagggctctgcctcctctcagtgccctccggtccctcgtccacccccacaccagaacttgttctcagatgcagatgagttaggtctagggcaaatacacttgttgaagaatgcagaggctccacagggagatttggagagcagccccagggctggctgtgccgcttgacagaggaggcccttgtgaccacgaagcacactcgaggagcggtggggtacaggaatcaacagccgtggcaatcgccactctccataatgtgcagggctgcacagaaacagcttccaaggtggagtgagtggtgattgtcaggtttgtgggtttccttggcattaatcttcccggagatggagtcaatttgaaaagcaattttctaaagaggctttatcaagagagtcagtgaaggatgctcagctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatgcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccgtggtgctaaaaaagccagactcctcagccaacgtgaaaagagttgttctagtgctgggatgatctcttatgatggaaggagagaaatacagattggaccaaacctgagatgaccttcaggcacaccatggctaagggggtttcagtagatggtgacagtgcctcttgttcaggtccccttcactgggctatgcaccaccccagctactgtgggcattggctgctaactgtggtcttctgcctgtgtctctgaagaatcaccctcaggggctatggaaacctggctgaaataagaatacataaaacccatgctcctgcctccaagcaggacaactgtgtggtggcgtagatgctccaaagccagcatggcctgtgacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcagtggcctgtgttctagtttccccttctcagcctcgctgtcattttccctcccttagtcttagtcgctaaggccttccccatgagcgtggggctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgagggtgactgagcccacagatggaatgaggcccatattctgtatcaccaacgatgacataaatatagtcaatagtcctcagacactgtgcagagggatgtggtaatcagtttccaattgctcttctccagagacagataacacctgttttaggttgggttgctcggaagcagagcctgagattgggtttgagtacatgtgctttattgagggagggcttttcagggagaactgtaggagagtgagggatttgggaggggcagaagtagccaagaaaggatgtggaaccaggtatgtgcatgtggcctgacccaccgggggctttggagcatcaacgccaccacacagttgtcccgcttgggggcaggagcattggttttatgtattcttatttcagccaggtttccatagctcctgagggtgattcttcagagacacaagcagaagaccacagttagcagccaatgtccacagtagctggggtggtgcacagcccagggaaggggatctgaatgaggcactatcactatctaccaaaacacccttagctgtggtatgcctgaaggtcatctcaggtttagtctaatccatatttctctccttccatcataagaagtcatctcagcactagaacaactcttttcacgtagcgaaggaccttatagttaattcacagaaacttcatgtatggtgggctgtggtcttatttctagcaaaagtggctgtctcatctctgattcttagccaattgaagaaatattttcagttttccacaaggcaagcaatgccatttttctgccagagtttctacaaattgacttgtaaagggtctgtcactatgactccagtccacaagggtcctgggtgcaaattgggacagaaaacaaattttcttagaattcagctggtgttctgaattcttaagataatagtgactactgcacttgacaaatgattagtgatgttttataatatctataatgattgccactcagttacagtctttggttgttggcttgtgaatttccttcttgaaacttttcaagaagccctagactacaggaaagaaaagagagctcaaattcaacacagaactcagagccagggtctctcttcctgttatcattctctgcttcctgcaactgtgcttctcaaagactcccaaagcccctctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcccgtgagccgggaaaaaactgaatgcccttgaaacagaaggccaagagactctctgcctgttgttgttgttcttatcagattcaaattcaacatacataaacaatttagacccgcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctagtctagacatttgtaaatatactatgtatatgagtatacatgtatatacacatatagacacgttatatatatgtgcatatataatgtatatgtaggataatttatcttgccagcaactgttcagggcaggaattaatagctcagatcatgcaaatacttgcccacaactggactcgtactctgagactctttgtgctaccctacacagctgtccactgctgggctagagcccaatctttagttattcatcaccttacctgttttgtttctgatcttgttctgaataaatagcaccatctttgagaaatccaggttatggccctcattaccccgacccgcaaagttggcttaatgcctgctttccaccaaatggatggtttccccagatcctgggaacagaaagaccaaccccaccatcactggatccccatagctgatggacactccatacatgattcagcatcagtatccgggggtgggagaggggaatacagcagtactccatgaaaccgtttaagtctatatttgtaaagttcctccagagagtattaatgaactgcactgtatgtttcagcaagccctcccaggttcatggccttggttcctagggcaatgcagaaccaaggcttgactccaactgggcacatgaccactgtctttttgtaaatgtgctttacaagatgtgtgtttaaaaatattttacttatactccaaaataaaagccatattgaggaaggatatttgcataggcaatgggccagtacatgtgccaagcattgtgcctggtattttattttattttattttatttatttatttatttatttttcagcacaggaagataatatttattatattttaactagaaacagaacagatagcaagttcacgaggtatgaatatttttttcttaaatcaggcttaaacaacaataataaaaaacaagtctgcatatatatgttggtcactattataatcttcaagggcacaaaagccagcagcataaagaaacatgaataatgactgagaagttttgatgtgccaaaaacaaagatcactgcgttgaactcctttattttgttaatattattattaaacatttaacaggtattaattattgttatttggcaaaatatccaacatgcacatggtattcctacaagaatcttgccttaatattgttaatattaacactaagtttattcctctccaaaattcaatgagttatgattccactctctgtaagtgttagtgttagtggtaatatgcaaaactgattttgtgtgcagggttaagtagcagattgacttcgcatttggtggccagctgtgtaccctaatttttatctattttcttaataaatttaattacatttcataagccctgagataacctgctaatgattgtatacttttaatctatactttattccactcaatttgaaccccacataataagtcttcaaaattatttacagatggttgtaattaaagcaatgacaaaatttactacttgtatagataagactgataataaggcctttaactaagagttgcatattttacatgcacttttaacttgctaggagcaactcttaaaattacatctatcattctgtcagaaagcagttaagtgcttttcattttgcttacttctatatgtgtaaccagactcacttttttcctcccgtgtaaaacaactgttttttttccttccccaaatattaatacttgtcttccaactgaacaattgctaaaaggaacttagcatttacacagcacattgataactatagtgctcagcagagacatatgcccataataggcatctgataaatgtttgttccacatggaatgaattgtaaggcagctgtttgagtcatatactgttcatcatatactgcaactaattttgtttaactaggaaattcagtttaccagatttaattcaccctcaagtataaatccaaaaattttaaattaaaaaaaatcgatttactaatcctcagaaaaagtaaacaagttaatcatagttgttactatgctattagttgatagaaaatttttaaaaattactttccactaaatattgtgtacaactaagtgaggggaagaaagttttaaaaaatgaaaagatattagctaattctcatcattttctccacatttatccttgcagcttatttgttcatatatttattcctgttaacttctctagctgaaagagaattttattatctgaatggagttccccatcaccttacgtacaaaatattagtgaaaagctagtgtaaatgtaagattgtattttcatgtcatgccatatttctgcatttattttttgctagcattaaatttttcgtatttaaatgatgctgtatagaatatgagataatctgccaattgctatgatattgcttgcttacaatattcagtttttgttgatagctttaaagtatattgcacacttgtcatctagcacactaataaataactatttttgaaaggatacactgacaaattcttaagttaatggctttaacccaacatttttagtcagttaaagaacagcaatggcaaaaacattgacaatacagttcatggtccagttctcccatcttacggtacaggttccatcagatgtggtatcccaaaaacaggagctgctgtgcgaaagccatatgcgctcttctggaccactgcacatttcacaatacatttataagcttttcccagcttaggcagatgtgttaacgataattccactatgcttgcggtccactggttgatgttgttgtaattataatcttcaccacctaaaaccccgtctgcacattctttgacaatattgtgggcttcctcagcattgaggccaacctcgtcgcagtggcgatggtactcctccatggtagcgcctgttctccctgggggcggagctacgcctgtgcctggtatttcatacatggtcttatttaaccacacaagaatcatacggccgggcgcggtggctcacgcctgtaatctcagcactttgggaggccgaggcaggcggatcacaaggtcaggagatcgagaccatcatggctaacacggtgaaactccgtctttactaaaaatataaataattacccgggcacagtggagggcgcctgtagtcccagctactcgagaggctgaggcaggaatggcgtgaacccgggaggcggagcttgcagtgagccgagatggcgccactgcactccagcctgggcgacagagcaagactccgtctcaaaaaaaaaaaaaaaaaaaaaaaaagaactatccacaatgacagtgaaacttcgagtgcttaaataacctgcccaagctctcatgagcagtaaacatagaagcagaattctaatccaaatgggtttattctcaaagtctggagtcttgatgttacaccacgcaatcctcaaatgcggtttccttttttccttctttctactgcaagaacctttgagcttctcccactccaagaaggccatctccagaaaggagattgcctgtaaggacagcctagagagtacttgggcttaacctcgctccaactctcgccaaagactcccccaaagtctcctgatcattcattggactgcctttcactggaattaatttacccattttcagcttttctttttttttttttttttttttttgaggcagagtctcgctctgtcacccaggctggagtgcagtggcgcgatctcggctcactgcaagctccgcctcccgggttcaagccattttcccgcctcagcctcccaagtagctgggactacaggcgcccaccaccaagcccggctaatttttcgtatttttagtagagacagggtttcgccatgttagccatgatggtctcgatctcctgacctcatgatccgcccgcctcggcctcccaaagtgctgggattacaggcgtgagccactgcgcccggcccagcttttcttaatggtagtaatggcagtcatattagcaacagcttctatttatcaaagcacttagcactttgaaagaaagacattatgagttcctgcctcagtctgggttgtcccagaagtccaacctgagacaagacttgggtgctgacagttttttgagaaatgatcccaggtaacacaagtgaggaattggagatgtaaaataaggaaggggagaaaagccaatgaagagtgcattaatgagcgagttgccaccgtgggcagctgagctcagtcccactagggacactgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatg

SEQ ID NO: 16436 - DNA, 33125 bp, Human
cctcccgggttcaagcgatactcctgcctcagcctccctaatagctgggattacaggcatgcgccaccacactgggctaatttttttgtaattttagtagagacggggtttcgccatgttggccaggctggtctcgaactcctgacctcaggtgatctgcccccccctcaggctctcaaagtgctgggattacaggcgtgagtcactggacctggctcatcctcagtcttaattgtgagtctgctactgtgtgactttggtcactacgtatcttcaggcctcagcttccattctgaataatagacataacaatcctttcttccttcaatgtcattgggagtatccaacaagattaagcaggtacactgtaaaagtccagcgtggcgatgagaaatgaatgttgacttctgtgtggtaaggaagagaccacagctgggctgggcacagtggctcacgcctgtaatcccagcactttgggaggcccaggcgcgcggatcacgaggtcaggagatcaagaccatcctgactaacacggtgaaatcccgtgtctactaaaagtataaaaaaaattagccaggcgtggtggtgggcacctatagtcccagctacgcaggaggctgaggcaggagaatggcgtgaacccaggaggtggagcttgcagtgagccgagatcgcgccactgcactccagcctgggcaacagagcgagaccacgtctcaaaaaaaaaaaaaaaaagaagagaccacagctgaagggatagcaaattcatcatcaagatgtagaaaatgagttgttaggagcctgtggggaaacataatcgtttcattacacactcttaactaaaggtccaaagaggcccttggagctggatgaaactttcacacaccaaaaagctgtagaaattatttccctatccaagagggtcatctcttttgagaaaaactatcttttcctgactttaaaaggttaacgtttttcttaatataaaggtaaaacttgttttaaacttaagtttttaaacttattaagaatttaccatagaactttaaaaaatctattaaaatatacaaaggagaggtgctcctctaatcacactacacagcggtctacacttgtaataaacaaaatcgggattttttggggggggagtgggacggagtttcactcttgttgcccaggctggagtgtaatggctcaatcttggctcactgtaacctccgcctcctgggttcaagcagttctcctgcctcagcctcccaagtagctgggattacaggcatatgccaccactcccagctaattttgtattttcagtagagatggggtttcatcatgttggtcaggctggtctcgaacttctgacctcaggtaatccgctcgccatggtctcccaaagtgtggggattacaggcgtgagccaccgcgtccggccaaaattcggattttgttgtaactgcaattttgtatctcgctttgctaacattttcccgcatgattaaattatcttatacaacaggggtattccaggatacaaattggttgcaatttatttaaccaatctcttattgttggacatttggagtattgcctttattttatggtttttctcgggcttttgggctaagtgttgcaattaacaactttgttacacgaatctttactcatatccttgattttatccattgaattcgtggaagtggaattgctggaccaaagggtatttgaaacatattactaatttgtcttctaagagtgattttacccatttaaactcccacgcgcaatttaataggatttcaatgttgttgctggtgtcgtcaactgtcaaatgccgaagtataccttccggcctgacctcctgtcctccttcgcgttttcccgcccactccgcacacccgccacccttagtacatgctggcccgccccttccttatcccgcaccaattctgtccaatcaaaagcaaagttcctcagtatcgccgtgcagttggtaaggtgaagagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggtgagcggcaggactgggcttggcggcggagcctgctgaactccaaggtcaaggcggccggagatctagaagccctggacctgcccggagcgggccggggactaaggcctgcggggaacgctggccggggtctcggttctggtggggcatttcggagagggtccaaattggaggtcggggcagtctgagttaggattggagtgcccgagggattcagtgttgaagtgttgggttagggaatgtgagggctgattaattccactaagggtctagagactggaaaggtttgaggggtagagtgagccctgggccgaggcatctagattacaggctgaatggaggcaattagctttatggcccaggttacctgcgagttggaggtgaattgtccagaatcagggttacattccaggcactggaggtcgggagattttgataatgatttatgacttagggggaggggaggagaagcatctccaacacgtggggcagagtgagaggtgacatgtgctgtgtgagccagttgaattgagatgggaggaaacctaaggctctccctgtttgaaagttgggggtgaatgtgtagaactggtttatagcctggagacccatgagtcgcaacctttgagtagtgtccacaataagggttgggagtgctcatgggacctggcttggagttaggacctgaggctactgaaggctaagcagcttgggatgacgcaaatgattttagatgaaaaggaacttgaatttttttttattttgtttttattatttttgtttgtttgtatcttccttccctttggtttttatttattttttcctttttttattttgttgttgtttatagggaacttgaaattttaactttatcaatcaacaggttaaaaaacaggcccagaaaggtcaggtggctttcccaaattagtgaaatgagtttcatgagcctgagacctcaggaaccatggagttagagtctgaagttaccatctgccctagcaggcaacaggggcctcacttgggatctgggccccttctagatctgggacataatggggccatagattagggttgggatcgatgatctcatttcggatttggaagcccgcaggttggattattgatgtccccttcttgcttggggtctggcattgcacctggggccctaagcctctggctcttgcctgttgttaggcttcaaagagggaagtctgagctcccaaatgaaagggaatctgaggactgccctgtgcccgcttttctcttcctagcacttgccaagttttaaaaatcttggcaaacagaccatcttactcattcttggtaccccttgtggcacctagcacattacttggcccttgatggggttagtggaagtggatgaatgtcacagattaatgtgggtgataaagaaagaagttctggaacactccattcattcctgtgacctgggcactaagtcagaaaatacagctttcttttctctccacagactgagatgattcttctttggagcttacctgtacctgatccctttatcctttatcctcagcgttgttgacatctctttcctgttgctgccacactcatttattgggtaatctgcagcttagggaagtttaatcttagactctgcagacttttgctgtgagtgatcaagtataaacagtagctcaaatgcttcattgtttttctttttctttttcttttttttgagacagggtctcactctgttgcccaggttggagcgcagtggtgtgagctcaagcaatcctcccacctcaccctcccaggtagctgggagtacaggcacatgctaccatgcccagctaatttttaaacaattttttgtagagacagggtcttgctatgttgcccaggctggtattgaactcctggacacaggcgatcatcctgccttgacctcccaaagtgcagggattataggcacaagccactatgccctgagatttttttcttaactcatattgaagttaataatttcagtaattatggaatggacaacctatactagtatagtactgggacaagggttttataatttagctagctatgtaacttccgagcctcagtgttcttacctgaaaaatggggataatacctaccttgctcattcagcatttcatgagcacctaacattggggatataaagcattgggcaagactgataaagttcttgccctcatcaactaaacattcacaatgatactggaaaattatgatatatgtgtgtgtgtgtgtgtgtgtgtgtgtgtgtgtgtgtgtatcaagcacccacaacctagatgacagcctgctatatagtaggtactcaataaattttgactcccttttatcttagtaacacatctcccttcccctccttcaacttggatgtttcagtgtaagacatgatttattcaggaagtttagaagaacattatactaatgagttgattgataagggtgcatgaagatgagagttggtcagagaaggctttgtagaaatagaggagatgtgattagagctgggagttgaaaggataagatttacacaagtcatttaacctctgtacactttccagagttgtaacaataggaatactggtgattgtatgtatttttgtggagtttaaaaaaaagttcaagcctgggcaacatggcgaaaccccatctctacaaaaaaatgcaaaaattagccaggcatggtggtgtgtgcctgtagtcccagctattcaggaggctgaggtgggaggatcacttgagccttggaggcagagtttgtagtgagctgggatctcaccattgcgccccagcctgggcaacagagtgagactttgtctcaaaaaaaaaagatcttaaatcagactttacaaatggtagcctacaataacatttagcctgcagagacatctcatacaccttaactttttattatgaagaattttgaatacacaaaagaagacaggatggcataatgagcccttacccagccccaaccattaactggtggccttcgctcctctagccattctcccttcacaaattattataaagcacctcccaggcatcataacatttcatttgtaaataatattagtatgtattgctaaaagataatttttaaaaacataagcataatatcctttaaaaaatcaacaatttttattcaaattttcttttgtgttaccaatgtgataattttaagtttcttttatttatttatttttttacagacaaagtcttgctcagttgcccaagctggagtgtagtagcccaatcatagctcacggcagcctcagtcctcccacctcagcttcctgaatagctgggattacaggtgcatgccaccatgcctggctaacttttctagtgttttaaagatgggggtcctgccatgttgctcaggctggtcttgaactaccgggctcctccctcagccacccaagtagctgggactacaggcatgtgccactgtgcccatcctttcttttaatttataagttccccttctctttttttcctggggttttgccgaagaaattggattatttttctttttttttttttttgagacagagtctcgctctgttgcccaggctggagtgcagtggtgtgatcttggctcactgcaagctctgcttcccggattcacgccattctgcctcagtctcccgagtagctgggactacaggtgcctgccaccacacccggctaattttttgtatctttagtagagacggggtttcactgtgttagccaggatggtctcgatctcctgacctcatgatccgcccaccttggcctcccaaagtgttgggattatagccgtgagccatcatgtccagccccagaaattggattatttttcctgggagtattataccactctctgggaattttcagttgtattcccctggtgtacttaacatcttcctctgccctctctatttcctgtaaattggtggtttatacttaattagtatatacttaattcaatttaggttcaattttttggcccaactacttcacaggtggtgggtgctgtgctctccctgaggaggcacatggtatttccttgtctctggtgtttatagtcatgctgttcagtgtctaggttcagtaattcgttatggatggtgaaatggtggtattctaattatattgttccctggtcatttattagctgaaatatttctataaagagaaacttcccctcatctactgtttcgttaccccgtgatatggttggtatagaaaagtcaggataaatgcttgatttattctctttgtcagctttcaaaatagtaggttgaccacagagcgttttcggttatgcaatttctcttaaaaatccagagctccagtttctcttgagaaaccagaagacctggcagtgatgcctccattccagtgtggcagcagtcacttgcagttgtgtggcattgctgctttggatggtctgtgtgtcttcctgtcccctgcacggtcctcttcactgcccattgcttacatttgactcatttcatacagttgcattgcctgcttggctcccactggcagatgtttgcaatcttacatgtaaaatccctaacctggggttagtgcctagtgcctgctcagtaatgtttgttttcttcctgctatactttgttatacctgcgtaactcagtattttatgtgctttatgttgcatgactgaaataatgtttccttttaaaactcctcacttttaactaaagtagttaaatatttcaaaactactcgcttttgcatcaatgtaatgttttaaaacatctataatacctgggtttgttattttatttaaataactttatttccttgcctcccttttggggttggatgctccttcggtgtggtcaaaaccaaaggtatgtttcttggtttttttgccaacccctcctcatttcttccatgtgtcaaacttatgcccaattcttcgaggccaggcacgcttaggcagtcttatgggtcagatgcatcagttatgtcattgcagtgatacttgcaacatctctgagacccacactcttatttccccttttacagttggagaaactgaagtttgaatggcttgttctctaggctacatagcaagtaatttacagagcttgcatctgaatgactccaaagctcctgctctttctgctgctatctactgccccaggttagatttttctcctaccgtgtgcatgtcaggagggtgtaataattacaacatagtcacccattgctcagttatgtgacagacccccaagctaaagattttacatgtatcatctgatttaatcctataacactaggagataggtcctttttactgacagagaaactgagctcagaggctttatcttgcctcaggacacacatgtagtaagtagcaaaggtaggatttgaactcatgtctgtctgactcttgagtagtcattaatttacattgttgctgtgtaatctagatgaagaggcagaaatgaatatgaatggaaaaatacatacaagtgcagggtgccaggtgggaagcatcagatgagtgactttgaatgttgggttagttcagggatagaacaagaactacaatttgctgaagttctcctgttcatcctcctgtccacccagtgaggttggtaatgatttcctcagtaagttaagagacatctgaaatgcaaacacagatttctgtgattaaaaaaaaaacaacttaagctataagatacctagaaaaagtgaacagcttgatttattttacaatgtgaacagatttgtgtagcttacacccattatcaagaaacagaatattgccagcactttgaaatcctccttgtgctcccttccaggaggatagccactaaggctctttgggttgtttgtcttaaagccttatagtgtcatggctaagagctagggcttggtaatctggcctgttgccagttcttttactagctctgtgatcttgggcaacttagcccctgagtttcatctgtaaaatgcagttaaaaatagttcctacctcatgggtttattatgtattatacatactaagtaccgtaaaacaatgcatggaaaactgcttggcatgatgcacatgctcaaagttagctaatgttaatatgaatcctcagcggaagaaggggtagttggggaggtgtttttgttttaggagacagggtctcactctgtcactcaggctggagtgcaatggcacggtcatagttcattgaagcctcgaactcctgggctcaaatggtcctcccacctcagcctcctaagtagctggactataagtacctgccaccatgcccagctaattaaaaaaaaaaatgtagaaatggggtcttgctgtgttgcccggactggtctcaaacttttggcctcaagtgatcctcccaaagtgctgggattacagatgtgagccactgcttccagcccagttaggcttttgatgggagaaatgtactcagaagtatactacagaaaaggcttagaccaatattggagcagagagggcattcctgtggagtgaggagcttgtgttgaggtccttggagaggcatttatgccgcgtatttgggaaccatgcgtaagagcagtttgtctgcagtggtgcaggacgtaaacacagggcacttgtggaagtaagttgggagggcttggcaggttttagaagttgattgtggagggcagctgagtgccaggctaagatatttggactcttcctctattgtaccacagagatgttgaaggcttcggaatgtgtatgttttggagggtaggtagcatatccaacagtgttttaagatatgattctagctgcatgtgtaggaacattgacagcaggagtgacaaagactggaggcacaaaggtaattgtgccaggcacagtgatatgcgcccatagtcccaactactccggaagctgtggtgggaggattgcttgggcacaggagtttggggctatagtgtgctatgctgatcaggtgtctgcactaaattcagcatcaggccaggcactgtggcttgtgcctataattccagcactttgagaggctgaggtaggcagctcgcttgagctcaggagttggagaccagcctgggcaacatgacgaaaccccatctctacaaaaaatacaataattagccgggcatggtactgcatgcctgagtcccagctacctgggagactaaggcaggaagattgcttgagcccgggagtttgaggccacagtgaactatgaacatgtcactgcactccagcctgggcaatagagtgagaccctatctcaaaaaaaaaaaaaaaaaaaaaagttcaacatcaatatggtgacctcccaggagcaggagaccactaggttgcctaaggagaggtaaatcggcccaggtcagaaaaagagcaggccaaaattcccatgccgatgtgtagtgggctaacacttgtgaagccactgtgctccaccctgggcaacatagcaagacctcatttctaaaaaaacataagaagaagatgatggttacaaggtgagaagactggtgaatttgggattaaaccaaatctctaggactgatagtttccctttatttcctagttgtcaggccctatgctggatgtctttgcatacgtaatcttattaaatccccacaacagttcagcagatagacactgttttctgttctatggataaagaaaacgagaccttagaaaaggtaatgtaatttgttcaggatgacacagtgaataaacggtagagcccgtttcctaacccagatctataccactacaaaacccagtctctgccactacatcagggcttcacatactgtacccatcagaacctgaggtgctgcttgagagccactcaatcataaactttaaaggtgggcctaggaaatgccctagatgattgataatacactgaaatttgagaaccactcagcccaccatgctgtctctctagtggttttagcattcccataattaccccagagtcctccaccccacagagttttcatagaggtgatgagcctgtttcttgggctcagcaacagtttttggctgacagcaacagactatgactgagtgtgggcttcagacccctgctcttcaaagtgtagtttagagcccagccactcatccaggccgggaagcttgcttaaaatgcaggtacttaggccctaccctattgaactagaatctgcatttttttttttttttcttgagacggagtttcactcttgttgcccaggctggagtgtagcggcacgatctcaatcccagctcaccacaacctctgcctcccagttttaagcgattcttctgcctctgcctccctagtaactgggattatgccaccacgcccagctaattttgtattttcagtagagacggggtttctccatgttggtcatgctggtcttgaactcccgacctcagatgatccgcctgcttcggcctcctagagtgctgggattacaggcgtgagccaccgcgcccagccggaatctgcattttaacagcattcctccagtgatttagagtctgtgaatggctgctctaaagcataagtttgaagtgtgaggggactataataaagttatttcattaggtttctgcagcctgtaaataaagactaatgcaaagaagaaagaccatggaaggaagccttttatttattgaatgcctgctgcgtgtctgatgtttttggtactttatttcatttatcctcataagaaccctgtgaagtagtcattatccccattaaactgatgaggaaactgacactctgagaagttaagtacttagcccaagatcacacggctactgagtgccttagctaggaatcaagtgtaaatctgtctgacttcaaaacccatgcgtgctctttacagcctaccacattgactcccaggcagccagcaggaaatgaaggaattcgttttctttttttctttttctttttttttttttttttgagacaagagtcttgctctgtcacccaggctggagtacagtggcgcgatctccgctcactgcaacctccacctcacgggttcaagcagttctctgccacagcctcctgagtagctgggattacaagcacccaccaccacgcctggctaatttttgtatttttagtagagacggggtttcaccatcttggccaggctggtcttgaagtcttgaactcctgacctcgtgatccacccgccttagcctcccaaagttctgggattacaggcgtgagccaccatacccagccaggaattagttttcttccctattggtgtgtgttctttcatctagctgtagaatccaatcacctggaacagtgcataagagtcctgcagtttgggagtgataaaaatagaacaggttctgtgctaacagctcttctctgtggtgttttggtcagcctttccacttgagcaagcctgacctccaaattgtttacccaggttaatttcaacagcaatgagaaagattggcagaaagcactctctagatgtacggccacagtgccagcctggtttttcattgtcagggctcctgacattcactggttttgcaaagtacagaattttggttttttgggtttgtttgtttgtttgagacgtagtcttgcttcttcgcccgggctggatctcggctcgccgcaacttccaccttctgggttcaagcaattctcctgcctcagcctcccaagtagctgggattacaggcacgtgccagcacgcccagctaatttttgtattcttagtagagatggggtttcaccatgttggccaggctagtctcgaactcctgacttccggtgatccacccgcctcggcctcccaaagtgctgggattacaggtgtgagccactgcgcccaacccagagtacagagtttttttttgttgctgtttttttgtgagatggagtcttgctctgtctccaggctggagtgcaatggcgcagtctcagctcactgcaacctccaactcctgggttcaagcgattcccctgcctcagcctcctgagtagctgggactacaggcatgcgccaccatgcccggctaatttttttatattttagtagagacggggtttcaccatgttggccaggatggtctcaatctcctgaccttgtgatccacccgccttggcctcccaaagtgctgggattacaggcgtgagccactgcacccggccaagtacagtttttaatgccttctcactagattccattttgctatgaagtcatttctttgctttaactgaattggtccatgaatcacaaaccagccctatctatgtaccttttattgtgtgcacctaagcatgcacctaagaaaactcccaattacataaaaattagccaggcacgtggcttgtgcctgcaatcccagctactgggaggctgaggcaggagaatcacctgagcccagggagttcgtggctgcagtgagccgtgatcgtgccactgcactccagcctgggtgatagagtgagactctgtctcaaaaaaaaagaaagaaagaaagaaaagaaaactcccagtgaactgatttgttggaatcgggatctaaacctgcttagtttataaaacaattgaacggaaaaagctaaaattgagctccttgaactgattatattccttgtaaattctgcattctttttttcccactgcaaagccagtgttgagctgtctagggtctcttcctgttctaattctgcattctcatgtataattcaccaaatataagctctttaagtacatagtctatgccttttattcatctgtttcccaggctcccgacagggttcttgggaaaggcattagtaaatgttttctttttgtatgaatgaatataggattaggacaggggttatggtaacagccagtgcccactgagcgcttactatatgccagggcctgcatatactgaattctgtataatcttctcatcaacccagtgatacagatactattaccatctccattttacttagaggaaatttgaaacctagaaaggtgaagtgacatcttaagtcaattttacataatggttagtggacctggagtctgcaaaccagcagtttaactctcaagcctgtgctcttgaccaaaacactataatgcctcctaaaactagtatgtaagtgcttattatttgccaagtgctctttgtatatatctcagctaatcctcacagctaccttctgagatggagccttttttgccttcattttaaacagataaggaaactgaaaagtgaggtggccaccatagtacagctacttagtgacagggaaggaggaaaacccagttctgcctgggggcaaactgctcctagttgcctccctgacccagtagctgtagtacatgacaattgtacattcatccctttggcaaatgtttattcagcacatgttatgtgccaggtgttgtaccaagtgcattatatacatgatctcatttaaacctcacagcaaccatgtgaagtgttggtactatttttattctcttttttttttttttttttttttgagacgaagtctcactgtcacccaggctggagctggagtgctgtggtgcaatctcagctcactgcagcctctgcctaccagattcaaataattctcctacctcagcctcctgagtagctgcaattccaggcaagcgccaccacacccagctaatttttgtatttttagtagagacggggtttccccatgttggtcaggctggtctcgaacttctgacctcgtgatccgcccacctcagcctcccaaagtgctggggttataggcgtgagccaccatgcccagcaagtcttcccatttataatggggaaactgaaacttatgtgtcactagtgtgttgagtggaaatagtgataattaatatttatgactccttcctgtgtgctagttgtactgttttaagtgctttacatatattatttcatgtaattcttaccataaccctataatcagtatatgttagaatgtaatataaggtacttttatccccattacaggtaaggaagtaggcatttgcccatgtttacatagccagtaagtggcagggccaggttcacacctaggcagtctgactccacagcctgtaatgtaattgaatcttggtttttgtcttcctctctgtaggcacccagattggctgaaaacttctgtgtctgccatttagctactggggacatgctgagggccatggtggcttctggctcagagctaggaaaaaagctgaaggcaactatggatgctgggaaactggtaggtttggtggtaccaatgagtgttgatattcctcagaatctagatctgcactgtccaatatggtagccaccagccacaggtggctatttagattaatttaattaatgtaaaaatcagttcctcagttgcactagccatatttcaagtatttaccagccaacgctgatacagaactttccatcatcaaacaaaattctgttgaacaaccatgtgctagagggtgttttaacaaactggcagattataggaaattttttttcttttttttttgacaaagtctcgctctgtcgcccaggctggagtgcagtggcgcagtcttggctcactgcaacctccacctcctgggttcaagcgattcttgtacctcagcctcccgagtagctaggattacaggcacctgccaccatgcctggctaatttttatgtttttagtagagatggggtttcaccatgttggccaggctggtctcaaactcctgacctcaggtgatccaccctccttggcctcccaaagtgctgggattacaggcgtgagccaccgcacttggccttgtaagactttttagagtgcaagttattttgtttgttctgaatttatggcactcattcatagtattcttgaagtttttctgtgctggtgtgttttgttatatacctaaattttagagccagaaatgaaactgctgtccctaggccagaactcagagatgtattcaagagaggatttaggaagtcacagaagtgttttttaacctgctttatggctctgtgtgctgtttctgtaacaaagcaattacttcgcagttgtgacaaaggtaatccttcttatctggggacgataattgcattttctctctttttttttgttctgagacccaggctggtgtgcagtggtgcaatcatggcttactacagcctcgacctcctgggctcaagtgatcctcccacttcggcctgatgagtagctagggttacaggcacacacctccatgccctgctacttttgttgttgttgttgttgttgttgttgttgttgtagagatggagtctcactgtgttgcccacactggttttgaactgagctaaacccaggagcagtcctcctgccccagcctctctaagtgctgggattacaggtgtgagctgccatgcccagccacattttctccttctttaggccagttgacctgattggacaaatacaatctattattttctggcactaatcaaagattgctagattaattataactgagttattctggaacttggcctctgagaatcaccttcagaagtcattttgtgcttggtcttctggtctttttttatcttagaatgttggttggggaaggagctggactttgctttaatcctcaagttaccttctgttaggctttgagattctgtagctgtatcaaatgatacctctgcctgcccatttctatctagttttcccttcatgtaattgaatctctgagtcaaaccagaaagctagatattttggactttgagttttgacagaagactctgtactaagaaaaaattgagatgtggcaatgagattgcttatctccaaccttcacttagttgcagagtgtgtactttgtccccaagttcacagttagcaccaagaaataaaagcattagctgccaagatgggcaggcttcactacaggctggagacttttctttctataacagcccaagagaaaaaccagtttctgaaaactgggagaagtccttattggggttttagagagactcagaagtatattggcttagggctggacatggtggctcactcctgtaatactaacactttgggaggctgagacaggcagatcacttgaggtcaccagttcgagaccagcctggccaacatggtgaaaccccgtctctattaaaaatacaaaaaattagctgggcatggtcgtgtgcgcctgtagtcccagctgtttgggaggctgaggcacttgaatcacctgaacctggaaggtggaggttgcagtgaggggagattgtgccactgtactccagcctgggcaacagaatgagactgtctcaaaaaaaaaaaaaaaaaaaaaaaagtgagggaagagtgttggcttggctcttcagttccttggttctgacccaatcttgccaattcagtgaacttctctgtttcctcatgtccaggatggcccagatgtgtaaccaagtacacacatcagtcacgttactgttagcctaatgacagctgtggaacagggaaagctgatgcctgtgttttggtcaaccccattctctcctggcactctctcaggtggtctgtcagccatttgtcctcacatttcctgtgccttgaggatcactgattgctgataagctgttatctgacagtttggactctggactctagtggcaggagggaccttcaggacctaagatacaaagctctcctggtgaagtaacaagtaatggaatctgtcttccctcacccagatttttgggatacaggagaatttcaagagacgagagtgtgtatttggcaaccacagagataaaattatgaaactggatcttccaaatggagccatttcacgtttgcttttatttttgcttctttgggtccaagaaaacttgctgtttagtaataaggttatatacacaaacttttggctgtggagttgggctaatgtcagtcacctaggtaatggatttaaacccaaggctattttgttcctaacttccaggtgagtgatgaaatggtagtggagctcattgagaagaatttggagacccccttgtgcaaaaatggttttcttctggatggcttccctcggactgtgaggcaggcagaaatggtgggtagcttagtttttatattactactgcatgaaaccaaattcttgtcctttgtctttcttaattcctttgaaggagatgggtctaaccaagctctggtagcttaggtgggccacacattcttttacagctcgatgacctcatggagaagaggaaagagaagcttgattctgtgattgaattcagcatcccagactctctgctgatccgaagaatcacaggaaggtatttgtcccttgaaggtcccttttcatgcttctcagagctttctcaaactctgagaattgctcttgcctaatcccggccatgaagcttagtgccatttcaacatggattgattttatttggtgacatccgctgaagtggtgagatgggatcgggatatggaaagaagagcaagggatttgaagtcagacagcatctcattcttgtcactttttttttttagatgggagtctaactctgtcgcccaggctggagtgcagtggcgcagtctcggctcactgcaacctccacttcctgggttcaagcagttctcctacctcaacctcccaagtagctgggattataggtgtctgccaccagggctggctaatttttttgtatttttagtagagatggagtttcaccatgttggcccggctggttttgaactgacctcaagtgatccgcctgcctcggcctcccaaagtgctaggattacacgcttgagccactgtgcctggctcttattgcttttttttttttgagacagagtcttactctgtcacccaggctggagtgcagtggcgcgatcttggctcactgcaacctctgcctccccggttcaagtaattctcctgtctcagcctcccgagtaactcggactacaggcatgtaccaccacgcccagctaatttttgtagttttagtagagacaggtcttcaccatgttggccatgctggtctcaaacttctgacctcaagcaatccacctgccttggcctcccaaagtgctgggattacaggcttgagccactgtgcctggcctcttgtcactttttaactgtgaccctaggcacatttcttaacctctctgaggctgtttccttatatgtagaagggggttgataacacctgctttgagaagctatttcacgtgttaggtaacataaaatgcatagttcaaagccttgcctatattaggtgcttaagaaatgttaatgtctttacatgtgtatctcctccattttagtgctccttaaatctgatttcagctggagttgccatactttgctgtagactttttattgtaaaaataatataaccatctgtacaaagtttagaaaatggaggaagaatttgctcatagtacagccactttgtgtgtgtgtgtgtgtgtgtgtgtgtgtgtgtgtgtgtgtgtgtgttttaacatgtttgtttctctgtaatagcattgaacacagaaatgcctctgcttctggacacgtttgttctgacagaccaacactgctttagcctacagttgtctctaccctgtttcactaatcactgccatctgctttgtgccttccagaagtatgacagaagctttcaactgcaaatggaccctccattcccttctttattgtgggctgtagcttttttatgtctttgtcattttaatggtgtctcaggaaagtggtcagccaaccatcttgaaccagacatccatgaccattacttttaattgctgtgtaatatttcacagtaggttaaccattgtttacttatttccttattgttgtacatttatgtttcttccagttagccactgttaaaatgatactatggccatcataatgcatgtaaatttttggattagggaaaaaatgttttcttatttcagacattattactttgatttcctaatgaggttgaacatcttttccatgtgtttgtagtccataccttcaagaagagacaaacatgtgaatagacagcacagggttagcactattatcctggaaagcgatatgaaatacagtggactctaccttatattcattttcttttcaaatgtccaggttacatgtctccggctattccataggctcctttaatgcaggaacttctgtttctttgtatccccactgggcacagagtagacaaagttgatgtaggtcgagaagcagtagggttaacagtaaagacatcactaggcctggggtctcttaggcactaagcacgtattagcagaatcaggtgatactggagacctttgattctatgggcccagcttcctgagtacctgcttcctgcatagcacagtactagaccctgggagcagaggaccacgagaggctctaggataaccatatagtgatgcccatctctgacctcagagagtcatatatgaaacttgggctgttcagtgtagtaggaagtccaagaagaaagcctggggacagggaagaaaggctgcctaggatagagataacattaaactcttcctcgatgaagagtatttcagagagcctttcccagaagggaggagaagccggaatgattatgggttggactttcgctgaggctagtagcagacgtgtctgcccagtggtctggggggcaggaaggtagaaggaatgctgttgagaagagctttactggggagatctgccaaaccaaagagggtagacttgacggagttcaggactcatgagatagtcttgagccactgggtattgtggcaaaaacagtattctaagaacattagcttggtcctggtgtacaaggtaaattacggcaaggagaaacagataaggataccatctaggagcctgtttatgatccacatgatgtggtggagatttctaactgaggttgggtgggagagaacagagagattctgaagaacaaacagcaggattgctgtaaagggtgaaagagagaagattcattccctccatttggaagtaggtggttagtgtgacttcctcacagagagaaggacccccgtcctcacagagcatgtcactgctgaaggtgtttttccaagtttacccaacagatgagtggcagggttagccctggaagcctgctttctgcctcgtagtccaaaatgttgatggttagaagaaaatgaggcaggaaccagtcagtttaatatggatctttttcttttctgtttttttttgttgttgtcattgttgttgtttttgagacagagtctcactctgttgcccaggttggtcacagatgtcggctgtttgaagatgctggggaatgcaccccggacctcacacaggatctttttcaagtctgagatgatatggacccattgtaacaatcttctgaattagctctgacctcacttctagtaattttgagtcattgttctgtttcttgaatatgaatagttggtggttgtggtttttgtttttaacttattcaatattggctctctcaaatcctaattatcctaccagttggctctccggtattatcttaatacctggtaccatcccaattttgtggatgagaaaacaagtgtttaaagtgtcgcactgaatgttgggcgcagtggttcatgcctgtgatcccagcatttggtagggacctaaacaggaggattacttgaggccaggagtttcagaccagcttgagcaacatagcaagacctcgtctctactataaagcaaaaaaaaagttagccaggtgtggcagtgtgcacctgcggtggtggtcccagctacttgggagtctgaggtgggaggcctgcttgagctagggaggtcgaggctgcactgagccatgattaggccactggactccagcctgggtgacaaagcaaaaccctatctcaaaaaaataaaaataaagtatcacactcacggtagcagtgattgtagattcccagtcctgatgatacctccaagccacgctcagtggctcatggagctattttggttggtacttgagagcaatcccattttgagaacttggagagtggggtttctttcatttaccttctgtggaatgagccttgtattgttttaaaaagtggtatttgtgaatggcaaaagagcagtgtgtgggagtcatatttgttgcagcctggctgctatgtgccctgtgctctctagaaggtaaaaaaatatcctggtccgtatctcatgcccctagcccctcccaaagttgctgcagctgagcccagcagcctgctctctcctttccctgggtctcccagtggatgccatttctgaatgaatgcatcagaggaatccttccaggcactcaaataatggaaggtgcaacctcacagtacatgactgcagtcacaggaacctttactcctctgtccagttggccttccatatccatggttccctcatctacggattcaagcatttgtggattaaaaatattcagaacaaaaccaccaataaatataacccaggaaagctgaagaaaagaaaaaataatacaaattttaaaattcagtatatcaattctttacatggcatttacattgtattaggtatacataatctagaggtgatttaaagtatgcaagacaaccagcctgggcaacatagtgagacctcatctctacaaaaaattaaaaaactagaccgggcgcggtggctcacacctgtaatcctaacactttgggaggccgaggtgggtggatcacgaggtcaggagttcgagaccagcctggccaacatggtgaaaccccgtctctactaaaaatacaaaaaattagccgggcgtggtggcaggcatctgtaatcccagctactcaggaggctgaggcaggagaattgcttgaacctgggaggcagaggttgcagtgagccgagaccatgacactgcactccagcctgggcaacagaatgagactctgtctcaaaaaataataataaaataaaataaattaattaaataaaataaaagaattagccaggcatggtggcgcatgcttgtagtcagctactccagagactgaggcgggagggtcacttgagcccagtagtttgtggttacagtgaactatggtcattgccattgcactccagcctggacaacagagcaagaccatgtctcaaaaaataaaataaatagaccaggcgcagtggctcacacctgtaatcccagcacttcggaaggctgaggcaggtggatcacgaggtcaggagatcgagaccatcctggctaacacggtgaaaccccgtttctactaaatatacaaaaaattagccaggcttggtggtgggcgcctgtagtcccagctacttgggaggctgaggcaggagaatggcgtgaacccaggaggcggagcttgcagtgagcagagaccgcgccactgtattccaacctgggtgacagagggagactctgtctcaaaaataaaataaaaataaaagtacacaggaggatatgcataggttatatggaaatgctgtaccattttatatcagggacttgagcatctatggattttggtatccacagagggggctcctggaaccaatccccccatggataccaagggatgactctatagcttattttctctactgtcacctccctcctgcccataacccagtgccactttatgccaaatggaccatcttgtccccccaaaatatgctgtgattaacaaaaaagaaagtagcacattttacagaggtgctacttcaatagtctaaatagaattgaatagaatttttatttattttatttttttgagacagtcttgctctgtcactcaggctggagtgcagtggtatgatctcggttcactgcaacctccacccccaggttcaagcgatcctcctgcctcagcctcccaagtagctgggattacaggtgcctgccacccagctaaatttttcatatttttagtagaaacggggtttcgccacgttggtcaggctggtctcgaactcctgacctcaggtgatctgcccccctcagcctcccaaagtgttgggatcacaggcataagctgctgggcccggcccaaatattgctatgcctgccaaatggtgaaaaatattagggagctctagtctaatagaccttcatgagaaaagcaaccattagttaaataagcaaacaaacacttggttggcagagaattgagaaaccacagaagtgaagcaaggcctggctgctgagcagagcttggcctgcctcctttccttaggtttctaggctcctgtggtgtggccattcccagtcaggaacatgggcttgttgtctgtagggactcagcacagatgcagctgcccactatacattcagtgccaaataaatgcctgttcttgagctctatattccatgacttgtttaataagtcatttttcccgattacttgaatattgctccataagggttaggctatcttttatctgtgtgattgaaaagatgtgttccattatctggcagtgtttgcatccatgggaattatttttcctgttagtaccttcctggttttgtaaccaaactaggttagaaaatagagttcatttctttgtcctctgtcccccatagcactttgtacaaatctctgttaaaggattatcacgtttgttatttatttccacatttgtctctcccactaagcactacttgtgagcagggatcattactcattgctttgtagcttctgaattcagcttaaggcttgaatggaatacttattaatgtttgttaagtaaatgggtgaacagaatggatggctgtgtgagaccagcaccagagttccttctctcaagtcctgaattaggtagttatgccagcagtttgctcttcagccagatactcataataatgtttggtcaaaatagaaaatatactctgccgctggcataagctctcctggaagcccagttatttagctggattttctgctgggtgctgggtccttgcatccagcgtccctatctctgcttgtcattctggagccccctagagtggagtgcaggcgcgtactgtcagttaacctaactcatattcatttgctgtctttcaggctgattcaccccaagagtggccgttcctaccacgaggagttcaaccctccaaaagagcccatgaaagatgacgtatgtaaactcaggacaaaaaatttccttttctttccttcccctttcttcactgtttttctttttcctttattctttccatcttccttttatttctaccaatattactaacttagtcatgaaaaataacactatcaagtaaatcacatggcctgtgtcagatctattcagtgtctcctcaggtggtttattgcttggcctcaaggttgcttccagtggtgctagctttttgcagtgcccagattgtacctgtcttctgtcgagagcagccccttttctggcatcatggccacctaagtgatcagctaatcaggagaagctttcttaaaagcctacaattggagagtgggaagagtgtggcactgaagagaagtttgatgaccagtcctccagaaaaatattctttttatagttattgctgctgtactgtgtcctggggtttcatacatggtcactgcaccatttgccataaagagtctatatggtttgttttaaagcatgcaggcaacagtaagaatttcctgggtttacctttgtcctatgaaacaagttcatcaggtcattcaggttctataaatacaggttccagagccgttatggcaacttagtcacattttgcaaagttgctaattctaccattgaaagttcttattttacttgccacttttagaatgttgatgggtgacactctagtaaatacactaaatatttaagcaactaagattacaattgctaatgtatctttgattttgatgtattctggtcttaggggcctttttgacttccttacttttgaccctagaagtgtttatcttggaagctgaatcgcctgagcacaaagatgagaaagtcattgcctatcttcccctcatgagcccctttcctcacagttggtgtttctgacaaactctctgacttctgttcaccagctgctctgctcctgggagtagcaaagttcttcactggagagggtctggattgcctgtctttgtctctgatgggctttgggaacagacagcatcctgggcagaatggtcccatctcaaatctgcatctggcatggaataagaaaaccttgctaacagtcccagcctttcattgctgtcttcctgttctcagatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaacccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttcagcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactctcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgtggaggtaagtattgctattatctctatggtatgtctgtagactttgagattcagacatctgataatggcagaaccagagcctgagtccaagtctggctccacaccccagcctcttaacactgtgccaattgctttgacactttgctggggagagatgaaatgatctcaaaggcactcatgatacagaaaaggctatgagccatggatccaaacaaaaggagaaactcaagtaggtttgctctgttacagtgaaggacctgccacaggtaagacctttttctattttgccatcctccgttgtttccttattgttggtactaaagttccaatgtgctggatttgcatagctcctggaatcacccgtattccagaaaggctggaggggtgagttatgttgggggaaggagccggttcccatctcttgtcctccacgattatctcctggttctggataaggtggccaggagagggtgtgtatgtaggctgttgagtcacaggcagccgtctcagattgcagctctgtgtagctgatggtgttgcattattcataactccagggggagcagtgtgcttctgatgttttgggaatgcagcagctttgggtttagagtcatccatggcagtgtgatgatgagctgctctcacagagggccccttccaggtgcccagtccagattgaggtgcccccagcagaaaacaggtggaaatggaaagacagagcatcagagggcaagacaacatgggcctagatcctgtgcaggtagccctcaagccaataagccaaacagatctgcactttgggggtaaagttgctatggagcaaataatttgattgtgtggtgttctgtaagggttttgcagacaaattcctctgagcttagctaggagttcattatgcttcctgtttagctggtcttctttcttctactaaataagaaatgcttcatttttggccgagcacggtggctcatgcctgtaatctcagcactttgggaggccggggcatgcggatcacaaggtcaggagtttgagaccagcctggccaacgtggtgaaaccccgtctctactaaagatacaaaaaaatcagctgggcatggtggcgcccacctgtaatcgcaactatttgggagttcgaggcaggagaattgcttgaacccgggaggcggaggttgcagtgagccgagatcgcgccattgcactccagcctgggcaacagggtaaggctccgtctcaagaaaaaaaaaagaaagaaagaaatgcttcactttctactgtcttccttcttgccctggctgtgaggaaactcaaaactacgtcttgtgttcagttgttaatcattcctcagccatggtttcttaataaaatttcaacgccagcccaattttagttctgtgtttagcatttttgtgctcatgtgtgttgtaaactgccttgagtctattttggaagagaagcagagtgtaaaggaagggctaattatgcagtacaggaggtcagactgcagagaagaaggtagctttgtgaaggaagtgggatctgggtgactccatgcagagggtggcagcattccagctgagggcacagcacaagggagggtacagcggccactggtgctctgggctgctttaacctcaagcaggggtccccaacccccaggccatgactaccaccagcaggaggtgagcgacaggcaagtgagcattaccgcctaagctccacctcctgtcagatcagcagtagcattagattctcataggagcacaaaccctattgtgaactatgcatgcgagtaatgtaggttgcccgctccttgtgagaatctaattaatgcctgattatctgaggtggaacagtttcatcctggtctgtggaaaaattgtcttccacgaaactagtccctggtgccaaaaatcttggagactgctgacctagagaacccctaccagagttcttgggaaatctgtatctgattagagataagtttttcaaacaaagcacagtgaccgtagaagggaagtttttcagctcatgaataatgtcaagaatgcagaagagcaaaagacaaggatacgta

SEQ ID NO: 16437 - DNA, 33125 bp, Human; identical to SEQ ID NO: 16436

SEQ ID NO: 16438 - DNA, 42373 bp, Human
  misc_feature (1)...(42373): n = A,T,C or G
ctaattctatttcttagttcctctacaccccatcctttctgtgaccccattctgtccttccacatctctctcacctgtccacccccttcttcacacttcagtttaccaccccctctctgttctcgaacctcctggttgcaacctcagaaactggttccctttctatttttatctcacctcagaaaacctactgccttcgagcacaaagccttactttattgaggccactaaaactgcaacaccagatgcaagcccacatcctctttcaagctctaaagtcaagaccattaccaagcagggtctgacaggtacagccaagagcagagattatttccagtggacaagacttccccctggcctttgatttccaacctttcccaaatgcaatacatgtgaagcacacagcacgaaacgcactcagcaggctttatcactccataaaaaataggcacaacatttacaaaaaatcaaaaagaactgaaattatctgtaacagttttgcaaattccttcgaagtaactaaaaacactgcaggacggaaaaaacaacccagggctgcaaatctttgctttaggtaacatttcactagatgagggtgccaggattctcctcccacatggacacagagaacagatgcgctaagctgcagcaacaggtttcttttcaaaaagaaaatgtgctttaaaacacttcaggcaggtctggtagagcttggagtccctaataaatacacaaaacaccggagatcaggttagggcaggccgtgggcaattcaaccacttctaggacctttccagggcccactgaggtaataactgctttccctcttgccctggaagtaactggtgacgccgcctccagcccttgaggagccggagaaagggtggcccaggcccaacctttggaggatactgccttggctctctctcacaaatgcaacggcccgggacggtgtcgccttccaggaagggcctttgcgtctccctcccccggggacaccgcgaattcccgcctcccggcggaaagcgggagaagcgagagttttctccccgcccctcccccagtaggggcaaacccgcccctcagcaggcctgtgctgtgcgctcctctcccggggaccaccgtcctcagatctccccagggaatgggtcgtcctcttcctgcccccacccgcgagacgcggcagaaaagcccgcggctatcttcccgccagcaacagcctcccgccgagccggccgggacagaggcggcccccacccccactgggcaggggactgcagacggcgctccccgactctcaagacgaccagggagcttcccttttcctcagcggggtgaggggcatctgtcgcccgccgacttggaggtggaggggcagggacattccctcgccatcacctcaggagctagaacgcgcccttctcgcagcagggcgtgggcctcccaatccctccaaggggcggacggcgtgcgcaaccccctggagaagcaacaggcgcccccatccccctccaagccgggtaacgccgaccccctcgtccctcccgctcttcacctccggaagccgggccaaagcctgggcgaacgactgcgcctcactccgccccctgcgccattttatcgccccctccccgacctcccctaccccgagtcagccgggccaacaccagggggagggcaaaccagcagtgattggcaggaaaccgtcccgcctctaggagggttgtgccccgctcaggcgcctcagccccgccctccgcaccgcccaccgtgcccactggctccaccttttcccgtctcatcgacctgctcgactctctgctgctcctcactttttccggccgctgccggaggggtccaggccgagtaagcggagcgccgagcccagctgatgcaacctggctggactcgcgtgacagttcccggcacgcggcggcgacggtgacccaggaaggggctctggtgccgggctgagcgggggaagcaggggtagcggagccatgggggacgctcccagccctgaagagaaactgcaccttatcacccggaacctgcaggtcaggcctgggggttggaaatgcgccgttggggattaggagcccgaggttcagtgattttgagccccattacggggttctaagtatgtggggccggggactcggcgctggcgcagctctgagagagcctgtagatctcactgctggtcggtcagtcaatcaagcagcccttccctgggttccccagaaatcacagtgggctcacctcttgcgtccagttgtcttgtgttggagccaaactttgaatccaggactcccattccacccccctattaagtgccagacgtggtgcttagtcgctggggatacgtcaagggcctgccagagcttgtctgaaggggatcagacgttaaaaatgacccattacggttcaagtaagtactggaagatgctatactgggagctttaaagggaaagagagaagggaaggcttccctgaggaagtgacctccaaactgcgccttgaaggaaatggatccccccccctcactccacaaatgttccgtttgttaccaagaactacaggagtagaagtgaaccagaggaagaatggaagaataaggagggagagcatttcagatggaggaaacagaaattgtggcaaatttagctggagtggagtgagcaaagttatgaggaagcacttaaatatttatattgcttaccccttaactttttcaggcttctgactgttgtcaccttatcagcgacgcatgatttccgaccactttatttaaataacaaaccctctggcaccagaactgccccataccttgctctgccttttttttgttattgtttctacatagtatacattttatttatttgtttaagagaggtaggcagggaccaagtcacgggagccttgcaggccttattctgttcaattttaaattgggcttccttctaagagtagtgataaatcagttgggccacacagcctgttctgttttttctttttagagatgtacttcacatactataaaattcacccttttaaagtgcacaattcagtgggttttagtatgttcacaaggttgtgcaaccatcacactatctttttttttttttttttttttgaggcggagtctcgctctgtcgcccaggctggagtgcagtggcccaatctcggctcattgcaacctccgcctcccaggttcacgccattctcctgcctcagcctcccgagtagctgggactacaggtgaccgcccccacgcccggctaattttttgtatttttagtagagacggggtttcaccgtgttagccagggtggtctcgatctcctgacctcgtgatccaccctccttggcctcccagagtgctgggattacaggcgtgagccacggctcccggccacaaccatcacactatctaataaaacttgcacccgttagcagacgctacctattacccactactcctagccttagagaaacactaatctactctctgtctccaggtatttgcgtattctgggcatttcctgtaactagaatcatacaatatgtttgttgtgtctgactttttgcacttagcataatgttttcaaagttcatgcatgtatttgcacctagcagaacgtcattcctttttatggttgaatgatactctgttgtatggatatacattttgtttatccgttcatcagttgatggacatttgggttgttccatttacaacttagtcttaaccaaaggtttttgcacgcttcccctagctagattctttgtttcctattctctctccataaaatagtgctggttggagactaaaaatacacaaaactattagaattgactcaattgggttttttgttttggggattttttttctggaacggagtttatctcttgtcggccaggctggagtgcaatggcacaatctcagctcactgcaacctctgcctcctgggctcaagtgattctcctgcctcagcctcctgagtagctgggattacagacgtgcaccaccacgccgggctaatttttgtatttttagtagagacggggtttcaccatgctggccaggctggtctcaaattcctgacctcaagttatccgccaaattcggcgtcccaaagtgctgggattacagagtgagccacagtgcccggcctcactcaggttttaaaggctaagtaatgtgacatcttcttggatggtgagaaccctccaagtgtccacgttgtcaggggtgctcttgagcatgcgggatcagctgccaaaagacttggagcacaggagtttaacaagtcctggtaaaacatgattcaaaccagcagtctatcatggtttctgacagcctcccaaaaccgtaacttgaggaaacactacaacctcttatcggggtacactggcctgttagaatttttccaatactgtcataggacaaaaagaaatcattaaaggtttgtaaaaaggaaaatgagttttaaagaagtttttgagttttaaaagactgtctctggctaccttttagaacatggattggaggggccaagcgcagtggctcatgccggtaatcccaacactttgggaggcccacacgggcagatcacttgaggttgggagttcaagaccagcctggccaacatagtgaaaccccatctctactaaaaatacaaaaatttctctggcctggtggcgggcacctgtaattccagctatttgggagactgaagcaggagaatcgtttgaacccgggagcagaggttgcagtgactcaggattgcatcactgcactccagcttgggtgacagagcaagactccgtctcaaaaaaataaaaaagaacttggattggagggagtaagagtagatttgggagacctgttaggagaatgttacggtaatcctggtgtgatctgatagggcctggatttgggtggtgatgtagaggcagagagaaataggagggttgaagagcagttttggagtccttgaacaactctaaatgatggtaccatttactgtagtaggagtgaaactatcagtgaaaaagatggttggggagtgaagtaagaagtcaagagcatgagttttattttgaacacgttgagtttgaatgattgggttgataacaagaacacggttctgtgtatgggcgtaagcaggagatttgggagttactggctcatagtagtaattgaagcaactgaaggggatcagttaaggagactgtagagtaagaagacaaaagaccagagccccaaagattgctaatatttaatgactaggaaaaataagaacagttgcaaagaaagctaagcaggcagagacgaggaaaactaagagaataaaataaaggagaccaaaagaggagaatgcttctgggagggagtgaggactaaaaaatactcactgaatttagcaacgtgaaggtcttctgtgatcttagcaagattatgtgtgatgtgatatggaatttagtagtatgatgtagtatggaattaaaattggaatgggagattaggaaatggagcccaaaagaagagacaactgttacaagaaattggctatgaaaggaaggagagtgagttagaggcatgtaaaccaaaaagtatctgaggccaggtgtggtggcccacacctataatcccagccctttgggaggctgaggcaggtggatcatttgaggtcaggagtttgagaccaacctgaccaacatggtgaaaccccatctctactaaaaatacaaacaattagctgagtatggtgttggacgcctgtaatctcagctactctggaagctgaggcaggagaatcacttgaaccctggaggcggaggttgcagtaagcggagatcacagaactgtgctccagcctgggcaacagagtgagactccatcttgaaaaaacaaaaagtatctgagacaagtctcaattaatttagaggtttattttgctaaggttaaagaccatggcacctgacacagcctcaggaagttctgagaacatgcgtccaaggtggttgggttacagcttcgttttatacattttggggagacagaagttacaggcaaaaacataaatcaatacaagtaaggtatacattggtttgcccagaaagggggtgggggttctaggttctaggtggattcaaagatttcctgactggcaattgattgaaagagttaaactctgcctgaagaattgaagtcagcttgagttaagataaggagggttgtggaagccaaggtttttttttttttttttttggagacagagtgtcgttcttgttgcccaggctggagtgcaatggtgcaatattggctcactgcaacctccaccttccaggttcaagcgattctcctgcctcagcctcccgagtagctgggattacaggcgcctgccaccatgccctgctaatttttgtatttttagtagagatggtttcaccatgttggccaggctggtctcgacccctgatctgatgatctgcccgccttggcctcccaaagtgctgggattacaggcgtgaggtgctgcacccagctgaagctaaggttcttgtcatgtagatgaagcctccaggtagctggcttcagagagaattgatggtgaatgtctgttatctgaccttaaaaggtgtcagactttccagaaaagacttagtgtggggaagagatttctctacagaatgcaaatttccccccacaagagagttttgcagggccatttcaaaatatgtcaaagaaatatcttttggggtaaaatactttgatttcctttagggcctgctatctgtcatatggtgctataccagaatcagtttggaatttggtatcttattgctacagagagtttgttttgtcagtcttactatctgtgttttaatgttcatgctggtcagttgtgtctaaactccagaggatcaccaggtggggtggctcacgcctataatcccagcactttgggagactaaggccagaggatcacttgaggccaagagttcgagaccagcctgggcaacatagtgagacttctctactaaactgaaaaaactagccaggcatacatgtgctggtagccccaagctacttggaaggctgaagtgggaggattgttgagcctggaggtcaaggctgcagtgagctgtgtttgcacaaccggactcctgccagggcagcatagcaagaccttgtctcaaaaaaaaaatgaataaatatactccaaagggagaagggtataatgaggcatgtcagacccttccttcctgccttggcctgaactagttttttaagtttctttgggatcctgttggccaaaatgtggggtccattccgacagttggggggcttaaagtttagttttggtttacgggtagctgctgcaggcaaagatgcagttaggggcatgtccccactccccaacatcaagggtgatactagcagcagcaccaactttacattggctctccgcgttgtaaccgagcgagttatagagaaacgccacactctgagatgaattcaggagtcctttattagccagcgaccgagagatggctagtgctcaaaattctctccgccccgaagaaggtgctagattttcttttatactttggtttagaaaggggaggaggagcctagctgaagcaatcttacagaagtaaaacaggcaaaaaagttagaaagacaaatggttacgggaaaacaaacagttccgggcgcaggggctttaaatccatcacaaggtgatagacgcggaggctttgggtaccatcaaccagacacaaatgctggggcttagggtaatatcaactgggcaaattcctgggaactgcggctatagctttccacaatatcttatcagttatttgcgttctttgatgtgctgggagtcagcttgcacaagttaagtccttgaggaaggggggtgggtaagaggctgcaaggggctacaagtgaaggagccaaaatggagtttgtctggctctctcagctaagggagagtcaattcagattaaaacaaggtagggtatcacatctgcactgagaacatggctggacctccttgatggctctgagcctggatctccactgacacatgctgttgttttccttgtcacatggtaaaggatgagcaaggtgaggcactgacattaaactaactcttctgcttccacaataggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaagaactaatgctataagcccttggggaatgacccaagggagacccaagagagacttaacaaggacagggtggggctggaggagataggttggaggtaattggacaaattcacattttggtggccccttatctcttgtccaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaagtaagtgcttgatcatccaccctccttgtggctctggtgcttctagctaattacaggcctgtggagtccaggcattctttacatttagattagaagctgtctggcgtgacctattaagaaccatttaaaactttgtccattaaaacctcattgtccttgtaattcatccatcagaagtgtactgactagtaaatgccttaatactgtcctatttgctggaaatataaacgtaaccaaaacaaagtccttggccttgcagaactcacagcatatgggagagtgatggtgaacaattcagcctccctttctcttccagcctcagcaaataataataaaagaaatgtgaaagaaaaatatttcacttatttctcaccgccccaacaattgttattgctttttatctttgtgagttttgttcatatttggaatgttagcatagatatttcgtgtcctaatgtttaacttactctttttttttttttttgaggtggagttttgctcttgttgcccaggctggagtgcaatggcgcgatcttgactcactgcaccctctgcctcctgggttcaagagattctcctccctcagcctcctgagtacctgggattacaggcatgcgccaccacacccggctaatttttgtatttttagtagagacagagtttcaccatgttacccaggctgacctctaactcctgagctcaggtgatccgcccacctcggtctcccaaagtgctgggattataggcataagccactgcgcccagcctaacttactctttcttaacctcagatatgcatttataagtacatagcgctctattagtcacttttgcatttaaacccttagaacaactttttaaagtaagcattattttgctaaggaaattaattcagatttaactttcctgagtttatacatctagtaagtagatgagtcaggatgtgaacccagatctcttgcttactagtaactttctctttttactgcatctaatataattttctttaccattcctcactgttgatacaattagggctttaaataaagcatataggctgggcagggtggctcacatctgtaatctgagcactttgggaggccaagctgggagaattgcttgaggccaagagttcaagactgccctggccaacatggcaagtcctcatctctaaaaaaaaagaaaagaaagaaagaaaaatagggccagccatggtggctcacacctgtaatcccaatgctttggaaggctgaggtgggcacatcacttgaggccaggcgtttgagaccagtctagccaacatggcgaaaccccatctctactaaaaatacaaaaatttacctgggcgtggtggcatacacctgtaatcacggctactcgggaggctgaggcatgagaatcacttgaacccaggaggtggaggttgcggtgagtggagatcataccactgcactccagcctgggcaacagagtgagactccatctcaaaaaaaaaagaaaagaaagaaaaagaaatgaataaataaagcatatgaacatctttgaatctacagccttcgtagagtacctgaaattttattcatttttacacttaatctacagatctttatggaacccctggtatatgataagcactgttctagatactggatatgcaaaagtaagccaaaacaaaagtccctatcttaatggggcttacattccagcaaggaaatacagacagtaaataatgagttatatgtgtatcagatggcgatagctgaaacaaagcaggcaggccagggtagcgaaagttttcaggaagcggggggtttcaatttgaatgagttggttagggaagccctctctactaaaatgacattaggcagaaacctgaataaggtgagggagtgagtcttgcaaatatatattgaattcttgctatgtgcgagacactagtctaggcactggagttatacctgtgaagaacacaggcatggtttttattctccaagaacttaagaaaatttgggatatgggaaggtgggataaataaagttatcttgcttcaaagtcacttgatacttttctatatacaaaaatgactttagggccaggcatggtggctcacgcctgtaatctcagcactttgggaggctgaggtcaggagttcaagaccagcctggccaacatggtgaaaccccatctctactaaaaatacaaaaattagccaggtgtggtggtgcacgcctgtaatcccagtactcaggaggctgaggcaggataatcgcttgaacccacggggcagaggttgtggtgagccgagatcgcaccactgcactccagcctgggcaacagagcgagactctgtttcaaaaaaaaaaaaaaaatggtgggggagtgggggttgctggatgcagtggctcatgcctgtaatcccagcactttgggaggccaaggcaggagaatcacttgagctcaggaattcgagaccagagtgggcgtagcgagacctcatctctactaaaaatcaaaaaaattagctaggcatcatggcatgcacctgtaatcccagctacttgagaggctgaggtgggaggatcacttgagctgagatcaaagcttcagtgactatgattgtgccattatactgcaacctgggcaacagagcaagatcctgtctcaaaaacaaaaaaacatggaaatagattgggaaattttgatatcagttgaaaaggcattccaaatgaagagactgaaggagaatggcagagaagcagtgtttcaagagataatggcagaacgttttccagaagtgaagaaaaatactaattgaagccctcttttaaaaagaaaaacaagcccgctactgtggcttgttttcccagcactttggtaggctggggtgggcagattgctcgagcccagcagttccagaccagcctgggcaatggggggaaaccacgtctctacaaaaaatagaaaaattagccaggtgtggtggcacatgcctatagtcctagttcctttggaggttgaggtgggaggatcacctgagcccagggagattgaggctgcaatgagctgtgatcacaccactgtgttccagcccaggtgacagagtgagaccctgtctcaaaaaaaaaaataaaaggaaaaacataaaaataaagtaatattttagatgagaagataggtctatcacattttagaagctaccaggcagtgctctgtttgaatgtcctaatgtaactggacccaggtttggctgcccggccacttgaaagcccgacacaagagatatgggttggtaggaggaaaagcaggtttgatcagaaagccaacaaaccgagaagatggtgaactagtgttctaaagtactatcttaaattctaaatgttaccatagtgtttttaaagggagacttggtgtgggagacatgcaggagtggtgagaatgcagggtctgtctgtctttgttctgatggctgtcttgcataattgcctgtcaggaggtatggttggtgttatcttgacttcagactgatggtgatggactaatcgttccagactccctctgagcaggaggattctgcagtctgggctccatgcctagtttgtttcaagattagcttctgtgatttctttttttccaacttttattttagattcaaggggtgcatgtgcaggtttgttacatgtcacaggagtttggtgtacagacaattttgtcacccaggtaatcagcacaatacccaataggtagtttttgaatcctcaccctcctctctgaaatttcttaagcaagaacataattaaataagcatgcattgccagaagggagggaaagaagaagaaagttggtgattaaaatatatttttaaaaccgagatccctggttacactaaggttagggaagtaaattaatgtgctttagatttcctaggaaactgaggcctaggcccaggtttacagctgtcccctcttcctttcctcttcagagagtacacactagatgtgtacagactctcctccgtggtcacacagcacgattccaagaaggctggagctgaggtggtaaagcaggtggagcaccctttgctgagtggcctcttataccccggactgcaggtacttaagggggatggagtggcccgatgaccttttctgctctggtttgatgacaggcatatcttattgcactttgctttactgcactacgcagatattgtgttttttacaaattgaaggtgtgtggcaaccctgtgtacagcaagtccaccagcaccatttttccaacagcatgtgctcacttcgtgtctctgtgctacattttggtaattctcacagtatttcaagctttttcattattatcatatctgcatggtgatatgcgatctgttacctttgatgttaaatattgtaattgttttggggcaccacaaactgtgcccgtataagacaacgaacttaataagtattgtgtgtgttctgactactctaccatccagccatttcctcactctcctggcctcctcatttcctaaaacacaacaatattgaaattaggctaattaataaccctacaatggcctctaagtgttgaaagggagagtcacacatagctcactttatttatttatttatttttgagacggaatctcgctgtgtcgcccaggctggagtgcagtggcgaaatctcggctcactgcaacctccgcctcccgggttcaagcaattctctgcctcagcctcccgagtagctgggattacaggcgcctgccaccatgcccggctgattttttttgtatttttagtagagatggggtttcaccatcttggccaggctggtcttgaactcttgacctcatgatccacccaccttggcctcccacagtgctgggattatagacgtgagctaccgtgcccggccgcacatctgtcactttaaatctacacctagaaatgattaagcttagtgaagaaggaatgtcaaaagcggaggcaggcggaaagctcggcctcttgcaccaaatagccaggttgtgaatccatagggaaagttcttgaaggaaattcaaagtgctactccagtgaacacctgaaaaatagaaacagacataagtttcacttatgctgatatagagaagattgtagtgctctggatagaagatgaaaccagccacaatgttaccttaatctaaagcctactctagagaaaggccctgtcttcagttttatgaaggctgagagattggttcatgacatttaaagggaaaaaagccatctccataacataaaagtgcaaggtggctctccctctctccctctctccctctctccctctccccctctccccctctccccctctccccctctccccctctcccctttccaccgtctccctctgatgccgagccgaggctggactgtactgccgccatcttggctcactgcaacctccctgcctgattctcctgcctcagcctgccgagtgcctgggattgcaggcgcgtgccgccacgcctgcaatttgtattttttggtggagacggggtttcgctgtgttggccgggctggtctccagctcctgaccgcgagtgatctacccgcctcggcgtcccgaggtgccgggattgcagacggagtctcgctcactcagtgctcaatgttgcccaggctggagtgcagtggcgtgatctcagctcgctacaacctccacctcccagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggtgaggagcgtctttgcccagccgccccgtctgagaagtgaggagcccctccgcctggcagccgccccgtctgggaagtgaggagcgtctccgcccggcagccgccccgtccgggaggtggggggcagcccccgcccggccagccgccctgtccaggagggaggtggggggcagcccccgcccggccagccaccccgtccgggagggaggttgggggtgcctctgaccggccgccccgtctgggaagtgaggagcccctctgcccggcggccaccccgtctgggaggagtacccaacagctcgttgagaacgggccatgatgacgatggcggttttgtcgaatagaaaagggggaaatgtggggaaaagaaagagagatcagattgttactgtgtctgtgtggaaagaggtagacatgggagactccattttgttctgtactaagaaaaattcttctgccttgggatgctgttaatctataaccttacccccaaccccgtgctctctgaaacatgtgctgtgtccactcagggttaaatggataaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactattaaaaaaaaaaagtgcaaggtgaagcagcaagccctgatgtagaagttgcagcaagttacccagaagatctagctaagatcattgatgaaggtggctacactcaacaatggattttcaaggtagatgaaatagccttttttcggaagaagatgccatctcggactttcgtagctagagagaagttgattcctggcttcaaatcttcaaaggacaggctgactctcttgttaggagctaatgcagctggtgacttgaagttgaagccaatgctcatttacattccaaaaatcctagtgcctttaagaattatgctaaataggccgggcatggtggctcatgcctgtaatcccagcactttgggatgccgaggtgagcaaatcacttgaggccaggagttcgagaccagcctgaccaacatggtgaaacccggtctctactaaaactacaaaaaaaaaaaaaaaaagaagaattaggccaggcatgatggctcacacctgtaactcagcactttgggaggccgaggcaggcagatcacgaggtcaggagttcgagaccagcctggccatcatagtaaaaccccgtctctactaaaaatattaattagccgggcatggtggtgcgcaactgtagtcccagctactcaggaggctgaggcaggacagtcgcttgaacccgggaggtggagattgcagtaagccgagatcgcaccattgcactccagcccgggcaacaatgcaagactctgtctcaaaaaaaaaaaaaaaaaaaaaatagccaggcgttgtggcgcgcatctgtaaccccagctactcggaaggctgaggcaggagaatcacttatacccaggaggcagagattgcagtgaggtgagatcacaccactgcactccagcctgggtaacagagtgagactccatctcaaaaaagaattatgctaagtctactctgcctgagctctataaatggaacaacaaagcctggatagtagcacgtctgttaacagtatgatttactgagcattttaagcccacttttgagacctactcctcaaaaagaaagattcttttcaaaacattactgctcattgacagtgcacctgatcacctaagagctctgatggagagcttctgtagagcttgagatgttcaggagttgaatgttattttcatgcctgctaacacaacatccattctatagcccgtggatcaaggagtgatttcaactttcaagtcctactatttaagaaatatatttcaaaaggctatagctgccatagatagtgactcctccgatggatctgggcaaagtaaactgaaaacctctgaaaaggatccagcattctcggtgttattaagaatattcgtgattcatgggaggaagtaaaaatatccatattaacagaagtttggaagaagtggatggtaactgtcatgggtgactttgaggggttcaagacttcagtgagggaagtcactgtagatggggtagaaataacaagagaacaggccgggcgcggtggctcacgcctgtcatcccagcactttgggaggccgaggcggacggatcacgaggtcaggagatcgagaccatccgggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaataacaagagaactacaattaggagtggagcctgaagatgtgactgaattgctgcaatctcatgataaattttgaacagatgaggaattgcttcttatggatgagcaaagaaagtggtttcttgaaatggaaactactggtgaggattctgtgaacgttgttgaaatggcaacaaaagattttgaatattacataaacttcgttgataaagcagcagcagggtctgagaggatggactccaatattgaaagaagttctgctgtggacagaatgctatcaaacagcatcacctgcaccagataaatctttcgtgaaagggagagtcaattgatgtggcaaacttcattgttgtcttattttagggaattgccacagccactgcagccttcagcaaccaccaccctgatcagtcagcagccatcagacatggaggcaagaccctccaccagcaagaagattatgacttgctgaaggctcagatgatcgttagcatttttagccataccttaaccaaattaaagtatgtacgttgtttttgtagatgtaacgctattacacactttaaatagactacggtatagtgtaaccacaacttttatatgcaccgagaaacaaaaaaatccaagtgagtcactttattgtggttgtctggaactgaacccacagtatcgctgaggtatgcctgtactgtacacaaacctctctcctggcaccagttaaatatatgcattttctattccttctccaacctataggccttcctgtgtgtctctcgtcttccttccccgcttcctgggaagctcttttacttcttccattataattccttctctacctgtctgtcctttaagacattgttcatctcatacatctttatattaatcataatcctttttatcataatcttaataaaggaaataaacttcagagcgatatgtgaaaataaatttgagcatgatcctattttctgttaaaacaaatacatgttttaacagaaacatccttctgtttcctttgtgtgcacatatatttgtacgagcaaggagaagggtagaaaaatacaaaccaggcgggtgcagtggcttacgcctgtaatcccagcactttgggaggccaaaacgggcagatcacgaggtcaggaaatcgagaccatcctggctaacatggtgaaaccccatctctactaaaaatacaaaaaattagccaggtgtggtgacgggcgcctgtagacccagctacacaggaggctgaggcaggagaatggcatgaacctaggaggcggagctcgcaccactgcactccagcctgggtgacagacagtgcaagactccatctccaaaaaaaaaaagaaaagtacaaaccaagctgttgatactgtttaccttgtgaaggcaggatgaaaatatggatagacttcactttttctttgtatatctgtataattttttttaattaaattttttgtagagacagggtctcactatgttgtctaggctggtcttgaactcctggcctcaagtgatcctcctgccttagtctcccaaagtgctgaaattgcaggcgtaagccaacacgtctagccctttataatgcttgatatgagaaaataaaattttcccttgtcacctcaaagagatattttccaaggttaaacctggagctgggcgcagtggctggcacctgtaatcccaacactttgggagaccaagacaggcagatcacttgaggttgggagttcaagaccagcctgaccaacatggtgaaaccccatctctgccaaataatacaaaaattagccaggtgtggtggcatgcccctgtagtcccagctacttgtgaggctgaggtgggagaatcgcttgaacgcaggaggtggaggttgcagtgagccgagatcatgccactgccctccagcctgggtgacagagtgagaccctatcttaaaaaaagaaaacccggagacatgctagttctgcactgttggctgggcgccatggtttatgcctataatcccaagtccaaggcaggaggatcgcttgaggccaggagttcaagaccagcctaggcaacgtagcaagactccatctctgttttattctgtgtgtgtgagactccatctctaaaaaaaaagaaagaaagaaaaaactaggtctgtactgtctaatgtggtagcctctagtcctagtcatatgtggctattaaataaaatggaaatttttgttctctagtcacattggctatatatcaagttcttggttagctactatattggacagcacagacatataatatattcatcaccacagaagattctgttggataatgctgttctagactgttcctgcttgttcagccttctcttcctcttcccttcagccaattatgcactaaatcttatcgattctacttttttaaaatgtcttaaattcattcttgctctgcgtcctcattgtcttttgtccatcgatatttctcacttagactttcacaatagcctttgaggcattcactttgtctccaacccatgagtctccagtctctgccctgccctgttactgttgagatcttcctacagtgctggtcatatttctcctctccttaaaacctttcattggccaagataacactaggcaccctagcatgacatttcatggtctttacctacttttctaacctcatcagtcactacttcccacctcccttgaagttcgtacttttgcagactgaatcactcaaaatttccctaaacacttcacacctctgtgccttctcacattctatttcctctgcatggtgaaaaacatctatatgttgttcaaaaccaagcttagcccacaatctgattctaggaagacttctccacacccatcttactaaatagagataatttcttcttttatgtcaacactgttccttatatgaacatctgggttaacccttagcacgctgagttgaaatgatctgtttacatgtctctccccagctggataattgggcttcttgaagggagagtctgggtctgatttatctcaccatccacggagctggcagcaggcctggcatgtcataagtgacagtcactgttttatttatttattttaatttaattttattttttgagacagggcttcactctgtctcccaggctcgggtgcagtggcacgatcatggctcaccgcagccacgacctctctgggcttaggtgatcctcctacctcagcctcctgagtagctgggactatagatgcgcaccatcacacttggctaatttctttttgtttgtttgtttgttttttatttttggagagacacccgggctcaagtgatctttccacctcagcctcccaaagtgctgggattacaggcgtgagccatcgcacccagacagtcactgttttctagttcagtcttacctttttcccgaattctcacaggacttctttatgctacttatatttcatttgtcacaggccaccttattcagtagaatacctttggcatgactatggtttgttttcttcttctctccctccctgcaggattctgcatatcctgagggcagagactactcttatttttttatcccatgacatccacatagagtaatgttcaccgcaaacactcagcaactgtctttgcagcttttgaggccaagagggaagctgactgctgtttattttcttcttggctttaccttctgaaaaatctagtaatttcctaaagtttctgatttctcagacccatatagaagaaataaagtagatgtttaggctgggcatggtggctctcgcctgtaatcccagcactttgggaggccaaggtgggtggccaaggtgagctcaggattttaaggccagcctgggcaacatggcaaaacgttgtctctactaaaaatacaaaaaattagccgggcgtggtggtgcatgtctgtaatcccaactactcgggaggctgaggcaggagactcacttgaacctgagaggcagaggtggcagtgagccgagatcacgccacagcactccagcctgggcgacagagcgagactctgtctcaaaaaaataaagtagatgtttatgttcatgtgtttctttccacaggctttggatgaagagtatttaaaagtagatgcccaatttggaggcattgatcagagaaagattttcacctttgcagagaaggtgagtgtctgctttcctgtcttttttcacttgcacctcagaggtatgcagctgtgtttattgaactatgatgtgtcagtcccactagtcatagtgtatggtaaatattctccttgttttgcagatgagaacactgaggatagaagataagaagttgtccaatatcacacagttagtaactgagcaggaattattagtacccagatctttcaaactccagagcccatgtgcctggtgacaaccaggaagctgctcccgcacctgttggatttactcctttcctaatagcccagtttccaaggagaggcattaccagttggaactactgtcctttcacagagcatttggttcgcatttcccagcatctttttctttttcttgtcttttttttgagacaagttctcactctgtcgcccaggccagagtgcagtaatgcggtcatggctcatcacagcctcgacagcctgggctcaagcagttctcccacctcagcctcccaagtagctgggaccacaggtgcatgccacaacacccgggtagttttaaaattacttgtagggatgaggcctccctgtgttgcccaggcaggtctcaaacccctgggctcaagcagtcttcctgccttggcctcccaaagtgctgggattataggtgagatccactgtgcctggcttagttttttgatatagttaatgaatacagaaatgcttactatatatatatatatatatatatatatatatatatatatatatatatatatatatttttttttttttttttttttttttttttttgagactgagtttcgctattgtcacccaggctggagtgcaatggctcactctcggctcactgcaacctccacctcccgggttcaagcgattctcctgcctcagcctgccgagtagctgggattacaggtgcctgccaccatgcctaggtaatttttatatttttaagtagagatggggtttcaccatgttggccaggctggttttgaactcctgacctcaggtgatccacccatctcagccttccaaagcactgggattacaggtgtgagccactgcacccagccacaatataaattttttgagggccaggcactgtggctcatgcctgtaatcctagcacgttgggaggctgaggcaggaggatcatttgagcccaggagtttgagaccagcctgggccacatagcaagactctgtctccacaataaaataaaaaattagccaggcacgcctctgtagtcccagctattcaggaggccgaggcagaataattgcttgagcccaggaggtgtgatcctggctgcagtgagccatgatcacaccatcacactccaaactgggtgacaaagcaagaccttgtctctgaaaaaaaaaaacaaaaaagaaaaaaataaatacattttttgattatttcttattatttgttttttgttgttttttgtttgttttttaaagacagagtctcacactgttgcctgggctggagtgcagtggcgcgatctcggctcactgcaacctctgtttcccaggttcaagtgactctctttgcctcagcctcccaagtagctgggattacaggtgcctgccaccacacccggctaatttttttgtatttttagtagagacggagtttcactatgttggccaggctgatctcgaactcctgacctcatgatccacccatctcagcctgtcaaagtactgggattacaagcatgagccactgcacctggcctattatttcattgtatctgcttgattaactttttagttggacctccttttattattaaagcagggatttggcccataccttgtttttgtatgactcatgagctaagaatggtttttacattgtttaaggattgtgaaaaaagatgaagaataagcagtaaagagcatatgtggcccataaagcctaaaatcttttttttttttttttgagagggagtctcgctttgtcacccatgctggagtgcagtggcacaatcttggctcactgcaacctctgcctcttgggttccagcaattctcctgcctcagcctcccaagtagctgggactacaggcgtgtgccaccacacccagctaatttttgtatttttagtagagacagggtttcaccatgttggccaggaatggtcttgatctcttgacctcatgatctgcccgccttggcctcccatagtgctaggattacagacgtgagccactgcacccagcccctaaaatctttattaactggccctttctaaaacagtttgcccatccctgccctagagattacaacacatatccttgcaatttattacagtttaagttagatatttttaccactgcccaacaatgcaagaaacagttttactacatttttcctccaacaacagttggagtaaaactcattttttgtttgtttgttttttgttttttgagatggagtcttgctctgtcgcccaggctggagtgcaatagcgccatctcggctcactgcaacctccacctcccgggttcacgccattctcctgcctcagcttcccaagtagctgggactacaggcgcccgccaccacaccctgctaattttttgtatttttagtagagacggggtttcaccgtgttagccaaggtggtctcggtctcctgacctcatgatcctccgaccttggcctcccagagtgctgagattacaagcgtgagccactgcgcctggcaaaactcatctttttttttttttttttttttttttgagacagagtcttgctctgtcaccaggctggagtgcagtggcgtgatcttggctcactgcaacctccgcctcccgggttcaagccattctcctgcctcagccttccgagtagctgggattacaggctcccaaccatgtccagctaatttttgtatttttagtagagatggggtttcaccatgttggccaggttggtctccatctcctgacctcgtaacccacctgcctcggcctcccaaagtgctgggattacaggcatgagtcaccgcacccagcctcaaaactcatttttgacataaattttaaatcccttggctgggcgcaatgggtcactcctgtaatcccagcactttgggaggccaagacaggcagatcacctgaggtcagaagcttgagaccagcctggccaacatgatgaaaccccgtctctagtaaaaatacaaaaattagccagacgcagtggtgtgcacctataatcccagctattcaagaggctgacacaggagaattgtttgagcctgggaggcagagattgcagtaaactgagatcgcaccattgcactccaggctgggcaacagagagagaccttgtctcaaaaataaaataaaataaatcttaaagactttactaccattttttttttaatttttctgagactgagtctccctctatcacccaggctgaagggcagcggcatgatctcggctcactgcaacatccgtctccctggttcaagggattctcgtgccccagcctactgagtagctgggattacaggtgcccgccaccacgcccggctaatttttgtatttttagtagagatggggtttcaccatgttggccaggctggtcttgaactcctgacctcaagctgtccacccaccttggcctcccaaagttctgggattacaggcgtaagccactgcgcccagcctgtaattgttttttaagtcacttttcatctatatctacccctacttcccctttctgatactcttgattcttgtctgcagttctttgcttctgtgtgagttcattttccttcaacctaaagagcccccacttagtatgtgtttgtagtgcagttctttcagtaatgagttctttcagctttcttttatctgaaaacatctttcaatttctttcactgggtatgaaattggaagtttgcaattatttttcttttggcacttttaaaggatcattgcattgccttctggcttccatagtttcgactgaaaagtcacctctaagtttattgtttctcctttacagataatatgtcttttctctgcttttaagattttttcttgtttctgattttcagcaattttactatgatgtttttgttgttgttttctttgagacagggtcttgcttgcattgcccaggctggagtgattgatcttggctcactgcagccttgacttcctgggctcagatgatcctcccacctcagcctcccaagtagctgggactatgggcatgtgccaccacacctggctaatttttgtatttttttttggagatggaatttcaccatgttggccaagctagtctcaaactcctgagctcaaacgctttgcctgccttggcctcccaaattgctaggattacaggtgtgaactgctgtgcctgaccagctatgatgttttcagctatagttttctttgtatttatcctgcttagattttgctgagcttcttgaatcagtggatttgttttcatcaaatttgggaaattgtctgccatgatttcctcaaatactgcttctctcttattctctttctcctctagggactttataaaactcatgtctcatattctgttctgctgttttcctttctttgttccctctgtgctttactttggatatgttctattgaactttcttcaagtttatcaatcgtgtcttctgttaaatccagtattgtattgtgacattttagaacttccatttgattctttttatagattccaattgtcttttacaattctctttcatccattttgtctgccttttcttatttcctttttggtttgtttttcctgcctattctgcctatgtactcttattttcttttatttatttatttatttatttttatttttatttttttttgagatggagtctcgctttgtcacccaggctagagtgcagtggcgcaatctcagctcactgcaagctccgcctcctgggttcatgccattctcctgcctcagcctcccgagtaactgggactacaggcacccaccaccacgcccagctaattttttatatttttagtagagacggggtttcaccgtgttagccaggatggtctcgatctcctgacgcctgcctcggcctcccaaagtgctgggattacaggcatgagccaccatgccctgcttattttctttaacctaccaatcacagttattttggcatcatggtctatttattgcaatatctggattgtttctgaatctgcttctattggctattttaactgtcagccacttttctctgcttcccatttctagtatttttttgtatgtgtgtatcaaagggattatagatgcattgtagaccctccggattgtgtttgtaggatgctatgttttctgtagattgctaaattactgacttatcacctgggttctgtcaggggttggttttaggctttgttagaacgtctacttcagcttagcctttactcctgtggtgtggtccttgttcctagagcatggcctttctagagactcaaactgaaatatcatggtgttcacaaagccttctctactttgattggagctaaacttccatctctgtctccccaatactgtgcagcctccaaaatctctgcccaggtctccagcctcccagaacctgttctctgccagacttcctggtatctcactatgtgcatacacagctatgagtcagccaagaaatcagtggggaattttgacataggctgaggaacccatcccaatccctagcctcctccagccctgaactccaatagctgtttcctctgcttagtctttcgctgtctgcttggtctctttttatcagcacctggtttgcaaagaaataccctcagtgagaaagcccaaggcaagtgtggtcaccttacttcccttcgctcaagatttgctgccctgttgggttttgttttgttttttgtttgttttgtttttgtttttgttttttgagatggagtctcgctcttgtcgcccaggctggagtgcaatggcacgatcttggctcactgcaacctccgcctcccgggttcaagtgatcctactgcctcagcctcccgagtagctgggattacaggtgcctgccaccacgcttggctaatttttgtattcttagtagagatggggtttcaccatgttggccaggctcatcttgaactcctaaccttaggtgatccacccacctcagcctcccaaagtgctgggattacaggtgtgagccaccatgcccggcttgccctgttgttttatgtatttccagcttttattgttgtttatggtgacataagtccaatagcctcacaatgtaatactgatagaaaagcagtagggaaaaaaacttcgcttgaattacagtcactgtcaaagctacatatttagtataaaaagattggaagcaatataacaactactcagttgctggccaagtcagatgagatcagggcactgaggaggaacttagactaatatcggcttttgtgtgtttctctaatctctcagtacctccctgcacttggctattcaaaacgggtccatctgatgaatcctatggttccaggattaacaggcagcaaaatgagctcttcagaagaggtaagttgccagctgagacttgaatttagaaatcttcagcctcaatggagagattgaggactgaaaagaacagtgacctggctaactagaattctccaatatttgagttagaaggagccttacaccattcaattagtttagtggttcttgagtatcaaaggatccagagcagtcctgatgagatctaatcataacttaatggtttttgctgctgataaaaaaataaaagcaaaagtaatgtctttgttcatacgactgtgatgaaattcagccttattaatgagagcactatggttgcatttcactaattagcattttgattcctagggtaatacttgatatcactaatattatgatatcttttaatatttaagagtccctcttgagctcgtgtacttgagggaaagttcactttggttctgatcattagaacgtggaaatccaaagatgtgaaaggttgagttctgggttcccaaacatggcttaccttcagaatcatctagggaatttaaaaaaaaaaaaaaaagtgttgattagaccttgtccatagagattctgataaagtagttctgggaggaacttaggaatctgtatttccttccttccttccctttctctctccctttttttttttttttttttttttttgagatggagtctcactctgtcacccaggctgcagtgcagtggtgcgatctcagctcactgcaagctccgcctcccaggttcatgccattctcctgcctcagcctcccagagtagctgggactacaggcgcccgccaccatgcctggctaattttattttgtatttttttagtagagatggggtttcactgtattagccaggatggtctcgatctcctgacctcgtgatccacccacctcagcctcccaaggtgctgggattataggcgtgagccactgcacccagccaaaaagtttttaaaaatcaaattaaaaaaaaaaaaaaaaaaaaaggcctacggaatgggtggaaaaattagtctcctgccctttttttctcctttttgttattctgggggggggggggggtcccccccccctgctgtcatgcaggtttttaatataatgacgagttattcccccgcccaagcggagacaagagcgacgaacaaaaaaaaacaaaacaattcctcctcccattaaccctaggatatccccctcaatccaatgcggcgcgtctcgcctcccacgaataataaccaaacacactaccttccactacaactaggaacaccaagaatgataacaaaaacaaagaacaactatatacccccatcacgactgtgtgtctctgatccgatctagtctgttggtgcttcctatatcttcctgcatcaatcccgttctcctccctttcaccaattttcctcgtcctcgctcctgctctactcattcatacatcatacgagaataatacttccttgctgataagtctaataaaatttgcgaatgtaactgtaatagagtgtacataatacatagataagcattctgtcaaatataactatgatttaactatggaataatcagaggtgagtgataggagtttagctatataatatggaggtaatacaaatacagggatagagcacgcgagatagacctacaaccaaagttaattatagaatactactattgaattcatatactaatagtacgtcaaatgatatattagtgtctgatcgcgtactcacattaccatgtgttggttggtgatgagctctatagtgatatagtgnnnnnnnnnnnnnnnnnnnnggaggctgaggccaggagaattgcttgaacccaggaggcagaggttgcagtgagccaagatcacactgttgcactccagcctgggcaacaagagcgagactccctctcaaaaaaaaaagggccaggcacagtggctcacacctgtaatcccagcactttgggaggccaaggcgggtggatcacctgaggtcaggagttccagaccagcctggccaacatggtgaaaccccttctctactaaatatataaaaattcagctgggtgtggtggcatgcacctgtaatcccagctactcgggaggctgagacaggagaattgcttgaacccaggagaaagaggttgcactgagtcaagattgcatcactgcactccagcctgggccacagagtgagactccgtcttaaaaaaaaaaaaaaaaaatgcctggcccaatcccaagagattttgattcattaggtttgggtggaacccagtaaaaggtgattcatatactgtcacatgtgagctagaatttggtaaccactgaactcaaatgaccatgaactcactctttccaaataagaaacaaagcctattacctaaaaaggaaaaatggctgtagataatatataatacttagtgtggctgattgctgtgaacaagtatcctcacacattgtcgacagcaatgttgattaggatacctttcaaaaaacaattttgaacctagcaattttcggcatcttaaggaaatgattctagagaagggaaaagactgcaaagatgtccaatgtagcattatatataatttgtaaaaattaggatagaatctaacagtttggagtttgctaaattatgtttccactaataattgggaatataatatggcataaaaactataagtaggccacacattgtggttcacacctgtaatcctagcactttgggaagccaaggtgggcagataggttgagtccaggagttcaagaccagccttggcaacatgataaaatcccatctctataaaaaattttaaaaattagctaggcatggtggcatgcaccaatagttccagctacatgggaggctgaggtaggaggactacttgagcctgggaggcaaaggtcgcagtgggccatgattgtgccaccacactccagccagggcaacagagcaagcaagatcctatcaatcccaacactttgggaagctgaggcaggaggattgctagaggccaggagtttgagattgtcctgggcaacacagtgagaccccattttaacaaataattagccaggcatgccaggtgcggtggctcacgcctgtaatcccagcactttgggaggccaaggcgggtgaatcacctaaggtcgggagttcgacaccagcctgaccaacatggagaaaccccgtctctactaaaaatacaaaattagctgggcttggtggtgcatgcctgtaatcccagctacttgggaggctgaggcaggaggaaccgcttgaacccaggaggcggaggttgaggtgagtcgagatcatgccattgtactccagcctgggcaacaaaagcaaaactgtctcaaaaaataaataaataaataaataaataaaaattagccaggcatggttttgtacacctgtagtcctaactcctcttgaggctgaggtcagaagatcacttaatggcaggagttcgaggttacagtgaactataattgcaccactgtactccatcctgagcaacagagcgagaccgtctgaaaagaaaaaaaattgtaagtaaggaccaggtagccactcagaaatacttaaaagatagacatttattctccaactacaaattcataacaattttgtgtgctataaacaaagcctgagaagaatataaaaaataaaatagtttaatttgttagatggcaggattgtgagtggtttttcactgtcgcccaggctggagtgtagtggcatgatcatgcctcactgcactttcaacctcaggctcaagtgatcctcctgcctcagcctcctgagtagctgggaccacaggcgcgtacaaccacacccagctaattttttattttcagtagagatgaggtttttctatgttgcccacactggtcttgaactcctgggctcaagcgactctccagcctcccaaagtgataagactacaggtgtgagccactgtgcccagccaaatgttaaaatatttttattgcccgggtgcagtggctcacacctgtaatcccagcactttgagaggccaaggcggggcagatcacgaggtcaggagatcgagaccatcctggctaccacggtgaaaccctgtctctactaaaaatacaaaaacaaaattagctgggcgtggtgacaggcacctgtaatcccagctattcgggaggctgaggcgggagaatggcgtgaacccaggaggcggagcttccagtgagctcagatggcgccactgcactccagcctgggcaacagagtgagactccgtctcaaaaaaaaaaaaaaatctttatttatttatttttaccacatccacaggaaaatatctgcaagtacctaatgttaaaatctttgtaaaaagaatttttttagcgaggcacagtggctcacacctttaatcccagcactttttgggaggccaaggcaggagagttgcttgagcccagaagtttgagaccagcctgggccacatgatgaaaccctgtctctacaaaaaatagaattacctgggcgtggtgacacattcctgtagtcccagctttccaggaggctgagatgggagaatctcttgagcccaggaggctgaggctgcagtgagccatgattgtgccactgcactccagcctgggtgacagagaagaaaaaacaaaatttaacttatattagttgagcatattctcattttcaaccacaagaggtcctcttccgttctatgacttctaggagtccaagattgatctccttgatcggaaggaggatgtgaagaaaaaactgaagaaggccttctgtgagccaggaaatgtggagaacaatggggttctgtccttcatcaagcatgtcctttttccccttaagtccggtaacactctctgttttcttcctagaggccaggctagaatagaaaagttcgtgctgtgatcatacttgtgatttgtcacagactcttccttcagggactggctgccctgattctctgctctgatttcttatatattaaagtatgaatgatgttgggatgtaatttaattgtccatatattcgttaccaggctaggttctgagggaatactggagtgggcagaggtgttagaagtaagggtgggggcagacatgttgaactagaggaatacaacaaaatagatataagccacaagccttcccctgaagcagctgagatgctagctgggtatacaatagtgccactcatccaatttaagaataataccatacaataaagttcagaatatatggcaaaaactacaaatagtcatgcatgtgggctaggaatagtcatgcatgtgagctaggaatgctgtcaatgagtttgttgacatggatccttttccttatagagtttgtgatcctacgagatgagaaatggggtggaaacaaaacctacacagcttacgtggacctggaaaaggactttgctgctgaggtaacatgaaaggaaaaggaatcctttcatgaagatctgtattttgttattttttgctgactgttagaacttgtttagaacaacttgttctgtgtaaaagtgagctgcctgctatttttgctctacttttggtaatctcactagtgtccattttccttcaaaattgcagttttggttaaagtttcttgtcagttagcttttctgacttaggaattttgttaatacagatggatttctatccctcggggccctttccttacctggcagggactctgtctcacctcttctcaggaaacatttcttatcagtaaatgtctgtaatcttatacacacgagtggtccctttaggatgtacaaaagcagtactcattcagtagaaaccatacttcttcaagtacccatacaaccattctgtttttcactttctgtattcaataaattacatgagatactaaaaaaaaaaaaaaaaaagaaaatgggctgggtgcagcagctcacacctgtaatcccagcactttgggaggccgaggtgggtggatcacctgaggtcaggagttcgagaccagcctgaccaacacggagaaaccccatctctattaaaaatacaaaaaagtagccaggcatggtggcacgcacctgtaatcccagctactcgggaggctgaggcaggggattcgcttgaacctgggagtcggaggttgcagtgaaccgagatcgcgccattgtactccagcctgggcaacaagagtgaaactccgtctcaaaaagaaaaaaagaaaggaaaagaaaagaaaaagaaannnnnnnnnnnnnnnnnnnncacgatctcggctcactgcaacctccgcctcccaggttcaagcgattctcctgcctcagcctcctgagtagccgggattacaggtgcccaccaccacacccggctaattttcatattttttagtagagacggggtttcaccatgttggccaggctggtcttgaactcctgacctcaggtgatccgcctgcctcggcctcccagagtgctgggattacaggcgtgagcccctgtgcccggccagggctctgtttatgctctccagggctgcatattttgttaatggctttgatgaggattcaggtggttcccagattcgataggcaaatggtacaatgctaatatactggtgctttaatcactctccaaatgacttagcaggctggaataaaggacctaactcagcaaaaatgaagtatttcaggaacagatgcaaaatcaggattcaaaaacaagagataattataaaaggacagaatagaggctcctattcatttcaacagacacttgaacaaaagacttactaggtgcccatgtgttaggcactatgctagggactggtattacacagagggttcagtcctcctaatgctcagtccagtaggcgaggcagacttgtaaacatttcattggctgcattttacatatatatctatatgtgttttttaacatatgtgtgtatgtgtgtatatatgtgaatatatgtgtgaaaatatatatgtgaatatatataatgaaaagaatatatatataccagaaataatataggaggaaatgattaactgactctagaaaagcttgtggaggagacactatccaagcactattttgcttgaggaataggagttcacaaggaaatctgtgagggaataagttgtacaaagacatggtaggatgaagcagcatgatgtatgaggaattccaggtggtttggtctgactagagtctaaaaggtgaggagggggattatgggagagataggcagggccaggtcacaaagggaagatgtgataataccatatataggaataaaatggggggttttgtgattgactctgaattcaggtccaaccaatttaatggagctgctagaaatgttaatgtacgccaggtgcggtggctcacacctgtaatcccagcactttgggaggccaaggcaggagaattgcttgagctcaggagttgaagactagcctaggcaacatagtgagactctgtctctacaaaaaaaaaaaaaaaatcaaaatactggccagccatgatggcgcatgcctgtagtcgcagctactgggaaggctgaggtgggaggatcgcttgagcccaggagatcaaagctgcactgagccatgattgcgccactgtactccagctgggtaacagagcgagaccatgtctcaaaaaaaaaaaaaaagtcttttgtgggaattaggaatagatgaaattcctcagaaaaaaggtctgcagccatgttatccaacagtactttctgtggtgatggatatgtcctatctgtactgcctgatacagaagccacatgtggctgttgagcacttgcaatgtggcaggtgcagttgaagaactgaatttcagtttacatttaaatacccacacaaggctagtagccaccatattggacagcagcagccctagagcttttattaaaattaaatattcccaaggaaatgaagaagtagtatcagaaacaaaaatgttcgctttgttgtattaaaagtgttcattcctaagggatgtcccctcagaatatctagaagattctttcagaccagatttgagatataaaaaaggcagtcagctgggcgtggtggctcacacctgtaatcccagcactttgggaggctgaggcaggtggatcacgaggtcaggagttcaagaccagtctgggcaacatggtgaaaccccgtctctactaaaatacaaaaaattagctgggcgtggctgcatgcgcctgtagtcccagctactcaggaggctgaggcaggagaattgcttgagcccaggaggcagaggttgcaatgagctgagattgcgccactgcaccccagcctgggcgacggagcaagactccgtctcaaagaaaaggcagtcacaggacacaaggaataaaatggaattactgaactattaccatgtacgagcagcgttctcatcattttcacacccacattcagtgatttaaccctcatccccatcctgtgagatatagctgttgttagcttcactttataagtaacaaagccaacactggcccggcacgttggcccatgcctgtaatcctagcactttgggaggcagaagcaggcagattgcctgaacccaggagttcaagaccagcctgggtaacatagcaagaccctgtctctacaaaaagaaaagagaaaaagcagcagccaaagcttagaggggttatgtgcctagtttggagtcgcacacagctagctgggaatctaatctgggtctgtcgaactccaaagcccttcctctttcttcttactcagctgtctccctcaggttatctttaggccttgggttacctatgtgaatgtttctctgcttgtaaataccagttggtctgtgaccctactctaagcataaatggagggactagaagaattagactaacaaatacattcagctcctaaacaccctcaagttagtatagatttcagaatcaaaagacttggattttggacacgttagtctttctgaatgtattttcccttctcctacctgcctcacaagattatcacaaggatcaaataagactgttgggaaaaactcccttgatcctacttttttggattcaggtgtcctgtgccctgttctagactttatctcactaggtcttgttcgattctgcaggttgtacatcctggagacctgaagaattctgttgaagtcgcactgaacaagttgctggatccaatccgggaaaagtttaatacccctgccctgaaaaaactggccagcgctgcctacccagatccctcaaagcagagtaaggccagctggagaggggccgacatcatcaggagagagagcttgtcaatgagccttggaaaaatgcctgtcttaaattgagggcacaacaacccagggggtctgaagtgcaggaatgtcatgtcctactggctcctagaatggaacttgagtcattttgatttgggtttggttaacatcaggaagtgatcacatccttttgtaccggcattgctgagagctgctggtgtaagatgtatactttggtccttctagtctgtttgttaaatctgcctcttcattaaagatagtgaccggggccagacacagtggctcacacctgtaatcttaacactttggaaggctgaggcaggcggatcacttgagcccaaaagttagagaccaaaacccagtctctacccaaaaaaaaaaaaaaaaaaaattagccaggcatagtagcacatgcctgtagtcccagctacttgggaggctgaggtgagaggatcacctgagcatggggaagttgagactgcagtgagccatgatcgcaccactgcactccagcctgggcaacagagtgagactctatgtctcaaaaaaagaaaaatgatagaaattagattagacctattatacccaaccggtatatagggtatcgatagtttcttacacagctgttgggcagagcctgcagagcttagagaagcttatctttagattctcccagtttccttctatgtgcatgggcctggctcttagttggccatccacttgtgcgtaatgctaagatattggcattgatagctttgtgcgacccttccagaaaaaaactcagtaactcagtaaaattttttttttttttttctaaaagagacagagtctggctctgttgcccagcctggtcttgaagtcctgggcttaagcaatcctcccgtctcagcctcccaaagtgctagaattacaggtgtgagctaccacacctggccaagactcagtaaattctatgtggaatgcatgaatggaaatacctaaaggaggcaaagctactactgctccctccccgctagtctaataattgagggagagaacagatgaaaatcaggtatgtcatgtctgaaaggttgccaacccagtattaaagaagttacaactcagtgtttagactctggggattctacactaaatcttacctaatctcagtgtcttaacgtggtgggatcagcagctgacctgccacagggaagaattctacctcatggggttcttctcattcccagagccaatggccaaaggccctgccaagaattcagaaccagaggaggtcatcccatcccggctggatatccgtgtggggaaaatcatcactgtggagaaggtactcatttttcaccacatctcagagaggcagattggggtcaggtttgtctgtttccatccggaggaaacgtggcctggagatgggaagtaacatcctgaggtcatattgcaagtcagagtgcaggtgtctaattccaggcatcaggctttctgttgcgattgttgcctgtggatattatgcaaccaaacacagccaggaactcagcatgggggacggatgttagtcagagggaacttgtttatctgttaaatctggtctgatagactcacctgatccctatcggcttgcctggactagctacaggccttatcttggatgggccactttgcccccttcagaaagtggtggagggaagacttcctttttcccagagacagaaggttatgcacccagtggcctgggaccattgttctgggctttttttcccttcgacatggatttgcttctcactgtgtaccccaaccaccaaaaccaccctgagatcaatgctggtgctcctgcatcagatggcttagagatccttccacctcttaacacaagcatctaggtccactttactcaaatctggcctcagttgagagcagagtataccatcagagcccattctcctgtctgctgtctgggacgtggaaagaaagttagctctagggggtctttccaggggcctctgtaaggagtggatgctcctttccggaatccaagagttcaccaggctgcttctctaatggacgatgatcctcttcctcctgacgtctctccctggcagcacccagatgcagacagcctgtatgtagagaagattgacgtgggggaagctgaaccacggactgtggtgagcggcctggtacagttcgtgcccaaggaggaactgcaggacaggctggtagtggtgctgtgcaacctgaaaccccagaagatgagaggagtcgagtcccaaggcatgcttctgtgtgcttctatgtgagtgaggacttggagtggggcacaggacctggggaggccaggaagagtagggaatcagcccatatgatgtccttccacacaccaggtggaagctctgagaacacgtgcctcttccttgctgatgccaaaagttgatgcatgaaggacttatcgtacaagtactgttaatgaagcattttacctacagttaattttgttaaaatagaaatggagggctcaaaccagtacatacccaagtcttactactagtaaggagtggagcagggattcaaatcccagttttgatgtctataaagtcctcgctacgttattttatacttcctcccctagaaacacagattttggtatcttgacacacaattttggtatagcctgggttaatgtaaccctggtgatatgcagggatgtagcaagataagaggacctcctggggctctggtactgaggatgccctaaatcccatcagggcccctgtgtaaaggcccggattgctttggcctccacagtcactggaacccatccatagcctcactcttctcttgtcctgtgtcttcccagagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggtaaaaagctgtaattgttccctttcttggctgggctgcctggactgtgtccccagactgtcctgttactgaagccatagctgcccctctctgttgggacttcctgcatttgagcccctctctccctccttctttccagacctttttgaattcaaggtgcctaaggagcatgggggtcttaggaccttgcattacatctccgacagatcatttgaggccctgtgtcagggacttcagacatttcttcatttgatcttcagtctgtaataggagattatccccattttacctggcaggatacctgacaaggccacatagggtcaccagaaatgatgagggcagggccaggcatggtgtcccatgcctgtaatcacagcactttgggaggccgaggcaggcggatcacctgaggtcaggagttcaagaccagcctggccaacatggtgaaaccctgtctctactaaaaatacaaaaaattagccaggcgtggtcgtgggcgcctgtaatcccagctactccggaggctgaggcaggagaatcacttgaacccgggaggcagaggttgcaatgagccaagatcacgccattgcactccagcctgggcaacaagagtgaaactccgtctcaaaaaaaaaaaaaaaaaaagaaaagaaaagaaatgatgaggccaggattggccgggcgtggtggctcacgcctgtaattccagcactttgggaggccaagacgggaggatcatgaggtcaggagatcgagagcattctggctaacacagtaaaaccccatctctactaaaaatagaaaaaaatcggccgggcgcggtggcagacacctgtagtcccagctactcaggaggctgagacgagaatggcatgaacctgggaggtggagcttgcagtgagccgagatcacgccactgcactccagcctaagcgacagagtgagactctgtctcaaaaaaaaaatgaaagaaagaaagaaatgatgaggccaggatcaaaaccttcccagggtccctcctgcccatcttgagtttagagcactcattgtctccttgccttctggacaatgaaaatctggcctgccccagtgatccctgaattcattcactcattcatttaacaaataccgattccataatatagctgtcaggcagtattctgggtgcttgggctacctcaatgaataaagcagcaggagttgactctcctcatggaactaacactcatgggtgactctttctagttaataccgtgtttcttcagtgagatagaggagtgcttctggaggacactgagagtcatttctactctccatcctcttgcatgaggccatttgctttgcccactccctcctttcctggttttctaggctgactttgtgaatctctttttttctggctataaaataaattttcatggtagaaaacatctaaaatataggagaaaaaaaaatcctagtcctgccacatagagatattaaagaatgttattagtgattatttccttctggtcttttgctatgcttggagtgataatacgtttatggtttaagtcatactaaatgctgttgattaattagaaacagggtctcactcttgtcacccaagctggattccagtggtgccatcatagctccctgtaacctcaagcctgtaaacctcctggactcaagtgattctcccgcctcagccttgcaaagcactggaattataggcatgagctactgtacctgaccatgatttttattttatttatttatttatttttccaagatggagtcttgctctgtcgcccaagctggagtgcagtggcacaatctcagctcactgcaacctccgcctcccaggttcaagcaattctcctgcctcagcctcctgagtagctgggattacaggtgcctgcgaccacatccagctgatttttgtatttttagtagagatggggtttcannnnnnnnnnnnnnnnnnnnttccaagcctcctggccatgatttctctc

SEQ ID NO: 16439 - DNA, 14574 bp, Human
  misc_feature (1)...(14574): n = A,T,C or G
ctgggcgcggtggctcatgcctgtaatcccagcactttgcgaggctgaggcaggtggaccacctgagatcaggagttcgagaccagcctggccaacatggtgaaacccagtccctactaaaaatacaaaaattagccgggtatggtggtacgtgcctgtaatcccagctactcaggaggccaaggcaggagaatcgcttgaacctgagaggcagaggttgcagtgagcataggtcgcaccactgcgttccagcctgggtgacagagtgagactccatctaaaaaaaacaacaacaacaacaacaacaacaacaacaacaaaaacatgagcttgagtggaccaagacccattatgaactagtcataaaccatcttttctttccccccctccccccccaagatagagtcttgctctgtcgcccaggctggaggggggtggcgagatctcagctcactgcagcctccaccccctgggttcaagcagttctcctgcctcagcctcctgagtagctgggattacaggcacgcaccaccatgcctggataatttttgtattcttagtagagacagggtttcaccatgttggccaggctggtcttcaactcttgacctggtgatccacccgcctcggtcttccaaagtgctgagattacaggtgtgagccgccatgcctggccctaaaccaccttttctcaaacgtgtctgttttgacttttccatactatataattaagcacaaagaattcctattctgtggtggtattatggatctttaacatgaaatatgagcatcttcatataaagttttatgcaaagattacttaacaagtgtgctgaaatcacttttaaagtatatatcactcatacctcactggggtatgctttatattaatggacttgttgcaataaagaaatggctttttcttttcttttttaggaagttccaggttaaaggcagcctcagctcacggggcagttgatggtggtagagaacagccctgggaagggggcgggagagagttacagaagtgaggagatgaagtcttgcacgtctaagacaatgagacagctcatgagagatgctgtttgaagtggaagagaggaagttcactgtcgtgtggttgtgtataggcatgtaatctcactttctggagcactctgttaggtcttttagaggaaggctagcaggcccatggggaaggagaattaggaaaggttgtccacagagagacagaggatctatgatttggtgaggatcagattagataagaagctgacatctgggcatgaggactgattttgagagcactcagctcagcagaaacagcagagaaaatctcagcctctgcctagcagccttcttagcagagaaatggaatttctgcatatttcaatgcactgaccccagatgaccagtctctgaatagtcaaatatacatgatagcctttacttggggttcagcacccacattcccttggcatcaatttctggggttcagtgttttgacatttcacagggctcttaaaatccctcctctaaggaacctcgtagaagcttctctttatcacactcaaagccctatacctagctcagcttcttgtcctggttttagatgtcaccttgaatacttttctccctcaaactgagtattaaccttatttgttcaaatcagtatcgaccaaggtcttaactcctcaaagatagaattcccgtctgtttatccgggttaactgttcatagcacggttgggaaatgaagaaacactgctagctgattagctgcatgcgttgttgtggaactgactatactcatacttggtgatgtgtccattgaaactgtgccacttttaaatgggtcactgaggggaggggactgcttggtttgcattgtcgcttggccccacggtaaaagccgggcgcagtttgagtccttgctgtccctccctgggcgtggactctggttctgatctcccctgctttgttttcctactctctcttgtgcagagacagggcagggcattgttcatgcactgaccgacctcagcagccccggcatgacctcagggaacggaaactctgcctccagcatcgccggcactgccccccagaatggtgagaataaaccaccacaggccattgtgaaaccccaaatcctgacgcatgttatcgaagggtttgtgatccaggagggggcggagcctttcccggtacggactacttcttttccccttttttttttaagtatattttggatgtgtcttagaatatttttacatttccatgtaaaatttctgaaaatgtgaacaatttgctctttccttgctaacttcctcccccaaagaatatagaaccatttctttctaggattatctttccaaggtccagaagaggggggtcagtgatcaggaataattgacaagacccttggttagaagtttcccacacaaactcaggtgtgtccctgcctgttgatgtgtgaacccttggttaaaagggagttcactgtgggatatttggtgagagatgatgggttttgggaaattagatttcattgagttttgaatgccaaaacctctgaatggcaaaacttcggccagttaggaacaaaaggaattgcacagaacagaattctcaagatacgtgtatcagaaatgaatgtgaggaaacagggtcacaacctgaagcttgttttctggggacagagccttgaaaggggagttaatgagattgaggggcactcagaaaggtcacgatggaagcctaagactaacaagaaatatccacgagccacgaagatgggttattgaccaaagcacccagagctgcttctgtgcagtgtgcactggagacagtggtgctgccctgtgggtgtggaggagcccagagccagcggcacaccagcctctgttctgatgaaaagtatctggctgttggagaagacacctttctgggataccatctgccttttcctcattctttggttccatgagtggtttgattagtctgcagaagacgcggagcttgattaactgagatgggtgaactgctcctgtaaaatgccaaaagacacatagcttcttgtcttctttcccactggaggttgtccaaggccagtggcaaagaaatctgcctggaacaccttagctagaagtggctctcgctctgttacatcccttccctgttagactgggcctcctagagtaacactagaaaccacctgatctcatggggtggaggcagattgcatagcacccccagcattgccctagagtcggtgccacgtgactggctaccaggctgcctaaacacaggccacaaaaggagatctaaacgcgtaaataagctgctctggggttctgacaactgagagttcattggctctgtggcccagggtctgttttttcctgctatactctgtggcggcctgtacctctggcttgggtcaggcattggggtaaggtggagaacagtaaaaaaatcagaaaatgggtgctgagtctctctctcgtatgtacagcctcacacagactccgctctgtccttgcctggagatgcgtgggtactgggtcttggtgcttgatctggcactgtgggaaacctgatctcagcccttagactcttactggaatagacattttcctaatctcctgagccatccgttggtcctggacagaagccatccctgtactttgcccattagcatcttacctcgtgagccaaccagcaaaatagggccttgagcccagcacacttggatgatgacatgggggaaggtttgaggagggctggcctctgtgcctggatactttatacgtgtaattgtgatgaggatggatagcaaggaagccgctcccacctgaccctcacggcctccgtgttacctgtcctctaggtgggacgctcgtccctgctggtggggaatctcaagaagaagtatgcacaggggttcctgcctgagaaacttccacagcaggatcacaccaccaccactgactcggagatggaggagccctatctgcaaggtgggcatctcagaccctgaatctctcggcctcccagcgtggctggaaaggcaggcctcacacacttcctctctctgtttccccagaggaaccctgagccagcgagtctgtaaacatttcccccagcacctcctcagcctccttccctcaaaaagagggataggggaaatcacgggaaccatgtgtcctctgctcccccaatccccctccagccaaccacaggatcccaagaatggcttttcctgtgggaatcattggcaagttttaggcatgactgtaggagtggccccaggcaagtcctgcccttcgtccctgccttgagactggggccagctctaggtcacagcagagaccaggcaaggctgctctttccacatgaagcactgacagagctgcacagctgcaggagcgtgggctcctgaggtcttttactgggtcagcagccagctgcatagatcaaggtgtgatgatgccagcggagcagctgtgacagcatccagagtatttcctgggggctcctgctttcttccacagtcatttgatgctgattcttccccacctgtgttttgcctcagactcagaccacgtggaagaaaaaaatgtcaagtctacaaggggcatccccagacacccttgagtgcattccaggggtgagaaccactggcattttccatgctagaatgctgctgtatgtcacagctgtgggagcaggaggaccaggcaggatggagtagggaggccccgtggtggggctggccacagtcctgcaggaatttctcattctccaccctacccatttctatacttttcagaatccaaagaggagggtgctcccctcaaactcaagtgtgagctctgtggccgggtggactttgcctataagttcaagcgttccaagcgcttctgttccatggcttgtgcaaagaggtgagtggccccagccccctccatttccccaggactgcactttatgtcccacctcctgccattaatagtctaccccaggaggtccataggggtggcttctccagtttcctagttcctcgacccacctggaagcaggatggcatccctaattcaacaagcacgagaagccagaacccctaagagcaggtgggagagagcagcgggagtccaaggaaaagccgcagtgctttggctcggctggccctcctgggctccactggcacccattcgcctttcctagcattgacagcccctgccttgttagggtaagccttacccagaaccacagctatagtgttcccttggtgagctctcgcccagcatagatcactaatggtcatcataaaaaccactgccatttcctgagaacctgctgtgtgctagtcactgtgccagtcaattgatacgattatctcatcttcaaaataactcccaagacaggtattactattgtcccctttatacaggttaggaagccaaagtacaaaggagtagtagtgcctcagataacatagctaataagccatgggcctggggatttaggcttgtccaattctaaagccatgtgtggtctttgtaccacaatggaagcaacagctgaccttgaagccctgaaatcccagaagagaagaaatctctaggtcccagacagaggtgttctgcatgccaagctagagttcggctatcttcagccctcattcccctcaggctgttggagcagccaggccactccccagcaggacagtggacagtagtttcccgtcacagggtaacatttatagtggaataagtcaggtgtgagctttcgccctggtccaagtccaggtgtctcaaacattttacagacattatctcatgttgtaagaccagacctagaaagtgagtggtattacccccaactccagataaggaaacggaggatcagggcttaagtgacttaaacccaaagtcacacagctagtagttagtgatggagttaggatctgaaccaatagatggactcaaaatttgtcagacagcttggctgtgctcattctgcctacggcccataagcacaatgactactgtgacatcccctgttcccctgtccctgaaggtacaacgtgggatgcaccaaacgggtgggacttttccactcagaccggagcaagctgcagaaggcaggagctgcgacccacaaccgccgtcgggccagcaaagccagtctgccaccacttaccaaggataccaagaagcaggtaagaggcgggcagagcctgaagctccatccccacagtccccacagcttcccttccatggccctcgacaccacggtcccctccagctgccgacttcagcgcactctgctgtgctctcattccttgtagacctgtccagtcgagccttctgcaccccagtaggtcccttcatttagacccatgggtgcttacaaggttccctgcccccttccgtggccttgcctcaacatcaccccaccttccagtttgcctccatccttggcttctggggccacggaaatggggtctcccctgggctgctcaggtaacctcctgccttacgtggagggctgggtgagaaggcagcctccaccctttgttttgccacctttttgcctccctgaacacgcgagcacagagttcttgaaggtctctaccaggaacatgggtattcagtcattaaatattttttagcaccagctgtatgccagaaactctgttaggcactaggctctaaggacacagtctcgccttaaaggaactccacagcatggtgtgatgttttataaccttatgtataattttgccttattttttttttgtcttaaacctccttaagaatggtccaaagctgtgtacgtacagaagaaatgttacatgctatttcaagtggctctgtgatcacctcctagaactcagagccctgctttaaaactcatgtttagaaaaagataattgcagtattgtgtggtagacactacaatactaagaggggactaactctgcctaggggtaggagacagggacagcatggannnnnnnnnnnnnnnnnnnnnnnnnnnnnncccagccaacaggcactgtgcccctttcggttactgctgctttgcagctaacacacagccaggaagactccagccgttgctcagataactcaagctatgaggaacccttgtcacccatctcagccagctcatctacttcccgccggcgacaaggccagcgggacctggagctccccgacatgcatatgcgggacctggtgggcatgggacaccacttcctgccaagtgagcccaccaagtggaatgtagaagacgtctacgaattcatccgctctctgccaggtaaggcccttggaaattccatgtctccccggaatagcaaggaaagagaaaatgagagaccctcccaccaccaggaggattaggtagtttagttaatgactcaggttcaggaactggggtgcagaaatgagtgagatgagctccctgcctataagagcttgcttatattcagcatagaatgcaaactataaatattccatagctgtaattctgtatattttctggcatgggaagtgatctgtgtgaaatacagagatgataatgtaattaactgtctctctctcctgggagagattaggaggggagtcaggtagagtgtaggatatgtgtcaggaacatcaaaattaagaaaatagccaggtgtggtggctcacacctatagtcccagcactttgggaggctgaggtggaaggattgcgtgaggtcaggagtttgagaacagcctgggcaacatggtgagacctgtctctaccaaaaaaaaaaaaaaaaaaaatttaattaagaaaatgtaaactaaatgacagtagacagacaagtatgcctttgctggatggagagactgcaagagggcgcacatgcagaggcatgaagatagggaagtctgtggtatggccagacatggcacagagccctgcgtggtggagcacaagtggtggtgaggcccgggatctaggagccagctgtaagaggcaagccttacatcattcacagatgccttcagtggggcctggatgcattactgtttttctgccagtctcactcatacaccgaccaggtcaggtattcatggcaaccacaagcctctttctcaagagactgcagtgtggttaagagcacagacttctgagtcacacagaactgggttcaaattctggctctgtcacttaacctagtatgttatctcttcatccccaaaatttttattacacagttgctgtgggtaaggaattcaggagtggcttcctgggccgttctgcctcaggtgtcttatgaggttacaattaagatttatcagccaaggctgaggtcacgtgaatactgaagagctgtgggatctcttccaaggtgcctcactcacgtgatttgccctgggctggctgttggcaagaggccttggttcttgtctatatgggcctctccagagggctgctcgagtgttctcatgatatgcatggcagtgggatgtccccacaggtagggatccaggagtgcaaggtagaagccactgtgccctttatgatctagcctctgaagccacgtactggcattttcacaatatatttttttaattaaaatttttcacaatatcttatgggtcacacaggtcagtcttactcattgtgagagggcatgaactgggaagcaaggattattgggagccattcagagacaagccatgtagttcaccatgacccccagaaatttgtgttccttcctcatgcagaataccctcaccgccaccaaatccccgacagtttggtcccatgacagcatcagtttgaagtccaggctctcatcattgaggtgagatgaggctcctggggtccagttcttcaagtataggtcctctcagtctgaagatctgagaactagagagagaggctatctgctcccttccacaaacccaatgcacagtgggacagccataggataaccattacagacatgcccatccaaaaagggagaaacagggagcgtacaagagtcgctgatccattccagttccgaaatccgctagggtttatggtggcatttcctcaattgggactcaaagcctgggagtgatttctgtcttggttctgccctctgagttctccttccttttctgtgaaaagtagcctgtattttcagtgtagtcgttttctcagcctgcttcctcctttttattttatattacctttgacttttttgttttttgtttttgagatagaggcttgctccatcacccaggctattgtgcaatggcgtgatctcggctcactgcaacctccgcctcctgggttcaagcaattctgcctcagcctcttgagtagctgggattacagacattcgccaccacacacagctaatttttgtattttagtagagatggggtttcaccatgttggcaggctggtctcaaactccttacctcaggcgatccacccacctcagcctcctaaagtgctgggattataggcgtgagccactgcgcccggcctacctttgactcttaaaatcagtaattcagtatttcttaaaataattgtgggttttctgggaatcttgttggggtccattccattagacaaaaaccacacccagaattatcttcaagggtaagctgttgtctgcattggtattcttctgaagctgaggggcagcatggacagtgcccttcacattcttagaaaccctgctgttgaaaagaggatctgcgaggcatgcctagaaaatccgtcgagagcctttggattgaatagctctttgaggcatcactttagatctttctgaagtcttcacaaaaagatttaagtcacatcctaagtttaatctgtagaccgtgttttcttgactgtgccctgaatttgatctttgcctagaaaccatttcttaatgttagcatcatgtgccatctggagaggctgggcatttttaaaaccggcagatcccggttcctttatgttgaacagttttgtttgtttgtttttaccttctctctctcctattttactgtgagcagcagtaagaagccaagcaacaccttccacattctgcctgaaaatctccttagctagaccacccacttcatgaggtacattcaacttacatttctgctaccaaccacatttttacaaaatgttcttttatttcataacagagaccctgtttcttccaatctccactaagagtttcctcactttcctttaggcctccccagcagcttccctaaaggccatgagacttctatatacagtctctcaaagcaccttagacactcacgctttccacagagtccttctggctcctgcctgtggccagttctgaggccacgcccacatctatagagctgtttgatgtcagcactccttttccaggtaccagaatctgcattagttacctattgccatgatgtaaattattccagaactcagtgactttaagcagcaatcacttgtcatctcaagggccatgtgggtcaggaatcgagtggctcggctgggcagtcctggtatgaggctcctggtgtccagttcctcttagtctaagaactagaaacagagaggttatctgctcccttccacagacccagtgtatgagtttgaggtcatatgaggtctcagggaagacgccatacaggctgcagtgtctgaggtctggagccagaaaacccacttccagcacggttcactcacacggcaaggaggccggggaccaccagggccttggctgctctccacgcatgcctctccaaagggttgctggggtggcttactggtagctggcttactctgcagtaacccaggcagaagagtgaggtgagaactgctgtgccctttatgatctagcctcagaaatcacacgctgtcacttcctcagcactttagtggacatgggtccgcccagttcatggagcaggggtctgaacaggggaacataggaggaggcccagatcgcggctgctgtgggtgagttgcacagcctctctcaagctgcaaaataagaacagcagcgccttcctcaaggcgtggttatgaggactaaaagaaataatggatgcagataactagatctagataactagatgcagtggctgccagaggtgaacactggcggcttggattgacactgtctttggtggtaccccctcaggctgccaggagatagcagaggaattccgtgcccaggaaatcgacgggcaagccctgctgctgctcaaggaggaccacctgatgagcgccatgaacatcaagctggggcccgccctgaagatctatgcccgcatcagcatgctcaaggactcctagggctggtggcagccaggattctggcccagggcgcctcctcccgactgagcagagccagacagacattcctgaggggcccagaaatggggccggttggagggcaggggctctccctaggggcatagctggtgaggaggtctgggcacctcctccatggctctcaggggcctttcatttctgtgggaggggcagagaggtaggtggcacagaagatggggctttatgcttgtaaatattgatagcactggcttcctccaaagtcccaatactctagccccgctctcttcccctctttctgtcccccattttccagggggtatatggtcagggctccccaacctgagttgggttacttcaagggcagccagcaggcctggatggaggcctagaaagcccttgccttccttcctcccacttctttctccaggcctggttaactcttccgttgtcagcttctcccccttcagcctgtttctgcagcagccagggttctccccactacaccctctgcaggtggagagagagaagctgggcccagccgggccgtgcctgctggcacagacgccttaacgctgtgtgtatgactgtgtgactgtgtgggagcctggactgacagataggccaagggctactctctggcatctccaggtgttttgtagcaaacagccacttagtgctttgtcctggactccactcagcctcaggatggggaatagccaagaatggcagcctcagcgcagaggcaaggtcagaaagagacggcgcttcagagtttcctttccagacacccctccctgcactgtgaagttcccctgaccgccctcctggttcacaaagagcattaagaaagctgcggtggtctgagcaacatagcccagagggctgagcctcctggcctgcctgcccgcccaccctgggagtcccagtggtgaggctcagagaacttctaaggggaaagaacagctggagtttctgttgatgtgaagaaggcagctcttggcctcccactcccacacttctttgcctataaatcttcctagcagcaatttgagctacctgaggaggaggcagggcagaaagggcgagggcctgcctctgacctgccgtgtcctttgcaggaaggaggtaggcacctttctgagcttattctattccccacccacacccccaggcagggttggaaatgaaggacttttttaacctttgttttgttttttaaaaataaatctgtaaaatctgtctctttggtgcctttctcccctaggaatgcctgtctctgggcccaaatggctacttttcacccatacagacaggtgggtccctgggctggggaagggaccttaagtggatggcatatcctccacacttttctggagctgggtcatttgagggtgccctcagctgcagttcacacggtagataccagctttcttcacacggtgtcccttggagtgagagggtccagaagccctttctgctctgcgcccccctacccgccattcccacttgggagatgatgactgttgggctagcagcctctggacacctggggcagaacccagactctcccatcttccagcacacacctctcgatagagctgcacagcatccagaatagccttgggatggctttggttcactgagcacttttgcatgctcaaatagaaaatgattagggcagagatgaggcatctaagccttgaataaagaaggagaaagggcattccagaccgaggcataagtgcaaaggcacaagcatgaacgtggaagtgcaaatgagaggcaggtgagctggctggattagacgtgtgtgctgctaaccgtgacctgtgttgaccacatgcctctgaaccaggcactgtgctagaaatgagactggggtgaagcacagaataaccatgtgccctcttgcgtggagtgaaatctaccccacatctatggggggaggggaaaaagaggcagcttggccttactgctcctcccccttcatcaggtttttccctaagggaccatttctacctgttaaaaatttaggttatggctgctcacatctgtaaacccagcactttggggaggcccatgtgggaggattgcttgaggccaggagtttgagaccaacctgggcaacatagagagaccccatatctacaaaaaaataccaaaaaatggcaaggtggtgcatacctgtaatcccagctattctggaggctgaggtcgatcacttgagcccaagagttcaaggctgcagtgagctatgattgcaccactgcacccccaacccaggtgacagacaaaaaccctattttttttaaaaaaaaaagcaggggtgggggtggtttgagggtcaggccacaacctactgaatcacagtctctaaaggacaattacttacttgaaagtaactttcaagaaccaacactcacatcttaataactcctctttggaaagcctattaaaatggaactgtcttggaggagaaacacactgattagttgatccccagggggtagaactagggactggaaagcctgtcccaggaggcagggaatggctggcaggaccctgagctgacgggaggaggaggatgctgagattggggagtgagccctggggagcccccaggcaagaacgaacgccccatgtgctgccgcctctcctgctgctggagtgcaggccacgtgcgcaggtgcaccactggcctataggactctgggcagttcttttcactttctggaccttaattttccctttatggaagaaaatgaaaaccaggccccacctgagtttgttgtgtgtagcaaagagggagggaaccaaacctactcctaaaagaagatgtggtgaatttgattcacaccaataagtatccatcttctttagatgaaaagctccaacctgctgcaagtttgcagggtgcacctgcaataggcatttgctattcctgttgtttacacttcacactgaatttcacagacctatttccatcatgatccacaatttaaagaaatatttcccaaacttgtatacacatttcaatatctatcaactgaaacaaacatttcatgaaacaaaacctacccttacgtacaatatagaatattttccattgtattcctgttcgtattttaaaaatcttggtcacgacccactaaactcattacacggccttcagataggtcacaactggaactttaaaaagcactgcccagagtaaatcacaacggttcaacatccac

SEQ ID NO: 16440 - DNA, 32172 bp, Human
  misc_feature (1)...(32172): n = A,T,C or G
tgggtcattttaggagcctattgcaataagaacttcttccctaaaaatgttcactgcaatccacctatatattcacattcatgtatcccatccatttttatatatgccggcagtataaatacccctttaaaggagataaaattatttctattttatatatgaggaaactcaagtttggataatttaatctatttgccctatgagtcaaagaaatgacagagcctgaattcaagctcaggtcttacagtctgtatctgaaattactttcaatattcctgtttgtatgagtttccagttacagaaattttgatcatgagatgaactgtttctggcagctgtttgcttgatagagtcatttccttctttccagttgtagaaaaactgtctcatgctcaaggcctccacttgccatacagaaaatacatcccctctacttccttatcaccctacttatttttttcagagtatatgaaaaaatgcataattatttcatttgttcacttacctttcttttttcttttcttttctttcctttttttttttttcttgacagagtcttgctctgtcgtccaggttggagtacagtggtgcaatcttggctcactgcaacctctgcctcctcggttcaagtgattctcatcccttagcctcccaagtagttggcattacagacacacaccatgcctggctaattttttgtatatttagtagagatgaggtttcaccatgttggccaggctgctctcaaactcctggcctcaagtgatccacacgcctcggcctcccaaagtgctggggttacaggggtaagccactgcgcctgtctgttcagttacctttctagtgtctgtttcccccaaagagaatgcaaatttcctgaaaactaatattatctctgccttatattctatagcatttccacggactgtcttcctttttatcttcacagcccttatatcttctcacctacatgaccatttacttatttcttctgttcattattaattatctatttttcttcactagagagtaagttccatgaggacaggacccttgtttttctttatgtagatatcctaagtacctagagctgagtttggcagatgaccaaaagccaaaaatattttttttgtgaatagtgaataattagtacttactacttcccagccaccgtgctacgtgtttactgtgaatcaacacctttagccacattttaggattttgggaaaggagggacaaagataataaggaatctggccaagttcccaactaagaagtggtagagctaggattggaagctaagcagtcgggctctggagctgaggctcttaagtcaccgcattattttgctgcattttcactacataagaaaaggtgaatatactggagatatttccaacacaccctctcttctatgccctttccctaggaaagggcaggatttcacattaaacttagtgaatatttaagtcagggtaagtcttatcctaactatagaatgaaaccatttttgtctcttagtgaatggattttacacctcagtgaacaggtaagagggtttatctttgtgaagtagaagtctttctcatccccttaagaggctacccacttctgcatataaagttaaactatatgagtttgtctccaaaatttataataactggattacctccttgatcccttcaaaatgaagtgtctgataaaaaaagagaattaaatttaaatgtgtcttatgaaagaacattatttaatcaaaagaaagataattattcttctattcttactctccttaaatataaaatgttttcattggttcagaacaatatagccaaaatcacagaattagaaatttattgtatttgaccttattctaaaatgtttattttttaaaacctcacaataaatttaaaaatattaaaatataaatactttggaggtgattattcaaccagtctagcaagttatttgacaatcgttctctgaatgtattatttttcatttctagataattctaaggcactgatagcatttctggcatttctgattattgtgacatcaatagccctgcttgttgttctctacaaaatctatgatctacataagaaaagatcctggtaagagttgattttaaatttttaaataataatggtattagtaatggtgcaaacgcatatccatatggcagtgatggaaccagttaaatgaaatatgtgaactagagagaagacagcatacagcccacttcatgacacaacttttaatcaaaaacttttagtatggttttattggtttgaattaaacattaatattattttctaaatttactaataatgttgtggacttgtttaataataaccagtgaaaagaatgtgtgtggtttttagtacaaagtgggtcagagggatctaggagtgtcaaaagaaaaagaaaggagggagatgtctggggaagttaatgtgtttctttggtcagaaacaaccacatcttatgaaaaacagaagatttaaaataaaatcatttagctacttatgtgagtttagcagacaattcttggttgttttctttcctcccacaccctcctctctcctctctgactctgctttctcccatccttctgtcctccctctgctcaaggctcttcctcccttccctcctttcctcttctcctctcctctcttccccttttcttatccctgacttccttcctttgttccttcaatatattcattaaatataagtaaaataccaattgaattttgtgcttcttgagaatatagaaacttatttttcctattttcacagcaatttagatgaacagcaggagcttgttgaaaggggtaagtatgtatatttttgctgatgactattccttcccctgcatttgaatccattcattttatttatttatttatttatatttattttaagacagagtctcattctgtctcccaggctgaagtgtggtggtgcaatctctgcttattgcagcctccgcctccctgttgaagcaattctcatgtgcctcagcttcccaagtatctgggattacagacacacatcaccaggcccagctaatttttgtatttttagtagagatgggatatcaccatgctgcccaagctggtcttgaactgctggtctcaagtaatccacccaccttggcctcccaaagtgctgggattataggcatgaaccattgcgcccgtccccattcattttaaataagaattgggcatttttagtttaacttggacttttgttgatacagtgataaaacttaaattcctttactcactcagcacctgtgaagttcccagtgtacgccaagcattgtgccaggtactgagagtactacagtgacaggcacagactctgcccttaaagggtttagaatctaatagaggaaagcagatatctcaacaaatatgacggtaatttgatacatgccctagtagttgaatgtgtatagttctatagatatatggaagatagaaaactgtgtgcaagggcagaaatctggtctgttaagattgtggggaaccaatggacaaatgagggagtggtggagggacgagtggatggaagtcacagagatggggagatgggatgtctcctcaagtccctgccagggtggaatggtggctgctcccactaaagacacatttatggattggacaaagaacagcaatttgacttgggagaagaaaacacatttgtttatcttttttttcaacatttatattctttaattttttaaaaatgtgatttctgatccagtaaaaggggacaaagtttcagaaattgaacctttgtttacaataaagaaatgtacttgctttctcatgcttaagacaggaataatttcagaactcctttgtctgtgttaatctgtgttggaagtgtttccctctggtaatagcaggtaccaggtctctatgcagaaactttagggctgaatctttggagctccttaaaaggctttatttttctttgcagaatgtaacactatctgatcccttattacatatttattcatttggtcattgactatcctctcctaactagaatgtaagctttgtgaaagcgtggaggcttttttcttattcactgctttatgcccagtaccaaagtgagtacctaggatttgataaatattagtgaataaataacactgacatagggtatcgtgaggattcattttgataggctgagggaggaatgaagagtacaatcagtaataaacacctgagcagaacaggaaaatccatctcaaggagttaaggtggacttggaaagtgtcaatgaaatattttatctcaaaattggtaccgattgcaccttggaacgcagtagaatttactcactcagaccccatgaaaccctgaatgtggccctcagttcagaatgaatgaataccaggcattcccaacaacctaaagaaacaattgcacatagccagtttgagagctgtgattgtatagaaagtttccatgggcaataagataaatgggtcaccctcatggataacttctttctttatctgataaactggtaaaattaatatgattactgaaagaaacactatcagtagtacatggaagagtaggagaaacataattttacatatgcgacagcttaaattctcttacctttctaaagctgttggttttcaagttccatatgcaattgtagctttttatggttagtatactttttaatcttcagtaagttatttcacaaacatggtatataatgtgtttcatatacttgaagcataacaaattaatacaacttgtttcaccatttagtgtaaacagatgatcaaattaagctgagtcatgggtataagggtattaatcatattgtcttatttcatttgcatgtttacagtatttcacaagttgaaaatgaaaatacaaagaaaaataatattgtattataaataaataattatagtaattgctataaaatgcatatagtcaaacgtgaatgtccttataatggtgatgtttggtctgggatcccttctcttaagcatagaaaatggggaagaacattctagtagagagaacaatataaagcccagaagagatctgaagtacaagattgaaaagtcattgatttataggtaaatgtttgtatgtgagtgagatttctcagatgaaatgtgtacgaggaggaaagaagctaaaggattgagtacacggtgtaaatttaatgaaatgtgtatgcccacctgaaagacacatgtaactagtattgaatctttaatatgtttccagatgatgaaaaacaactgatgaatgtggagccaatccatgcagatattttgttggaaacttataagaggaagattgctgatgaaggaagactttttctggctgaatttcaggtgtgtgttgcttttgttatatgatgataaattcgacatcaagacagttccactttaagtgtatttatattgccatttgcctttataatttatcccacttgatattgcaacataagcaaagtagatattattagcagatctctatgaaccagaagagagactcatagaggttgacgggattatagtgtagagctagtaaatattttaatgtagtgctttattgtattatgaagttgtgtcacaaaatgtatttggctgattttgtagttgtactctagatactcatccaagtatctgtttttaaatgaatttgatagtgacacaacaactaatcctaaatttgtccccactcaagagatttgttctgaaagttgtcaatcattaatttgtaagaaaaaagttttttttttaacataattcctgatcttaattttgattactctaagcaaatttttttatcaatatgaagaaaatattttacaggatatctcatttactcaaaacggtcattggtaagggggaaattatttttcctgaatctgctgtgatccaagaaatcgttgtttctttcagagcatcccgcgggtgttcagcaagtttcctataaaggaagctcgaaagccctttaaccagaataaaaaccgttatgttgacattcttccttgtgagtatttattgagtgctgaattcccatatattaggctacttgattattcactatttcacttgtttatttttcttttccttaaacagatgattataaccgtgttgaactctctgagataaacggagatgcagggtcaaactacataaatgccagctatattgatgtgagtaaaaatttgcatttttcttatacctacatatttcattcagctccttgtttgtcttggtaaaattttagaaatattattaaaaatattttgaagtgagcccatatgtcactgatataaacaaaaaattatcaatattagcaaggatagttatttattatgtgactattggtattaggtataacatagaattttcctctacaaacaaaattatattaagaattaatttaatatactctggtgtctattatgtgctagatattagactaaatattctatgcatatatttctcacaagaagtccacatttgcctcagccatgtgccgtataggtgaggactgggaggctcagtttagttaattaccttgttgttgttcacacaattggtaaatatttgagttgaaattcaaccagagtctgactgactccaaaatgttatgctttaatttcatcacactaaatttcagcagacattcctcatcaacatgatcatctatccattggatttatgcagaaatgtaaatgtccgtacgtggttaatttatttaaaatattttaaaatttaatttattatacaaatgttaattaatgtattacataggttaaataattttaaacagtataaaaatatatacagactgaaaaaattctttttgtctccccaaatctgccattttcccagtgtcctcacctaccagaaataactatattttctattcaaatatatatggtaattatggtatcaggttacttatgtttccccaatggaacttagagctccctgaaagcatgtgtcttctgcttttagataggtgattgacatattgtagctattcaataaatacttattaaataaatgaatgtatgcgcaataatgtgtcatgagatagaagtttcaggaagttacttaaattaatgttgaattcttgtgacccatgtttcaaatttaatccaatggcaaaggtcatccctttctgaagagctcctttagttactgaggtgaatttaggagtctgagataattctggaagaagccagtataatattttatctgcctctgtactcctttatcttggtaacaggagcagagaaagcagacatagtaggtaatgaaatgaaagttattatatctcttatctgaaatggcaaagaagtctagggaatcatattccagcagaagttaagaggtgaaaatgcgggtaaaatctaagaatgatttgtttaaagaaattgagtaaaaatcccaaaagtaactacatggctggtgagcttgtttaaatagtggtagatgatcctataagagttggcaggatataaaatgttgaaatgtctagagcactcttgtaaattaccacagcatcgcagatgnnnnnnnnnnnnnnnnnnnntagtattaaaattgtttgaagtttacagcaagctacatgaaagtcatgaatattctttgcaaatgctaacatgtttagcacaattaaatgcctgaccaccaattaataagattcccttaatactttgaaactgcccagtagtaaattcacaatcacaaaatgatggatctgaagcaattcctctaactcacaatttttcctgttaatgagtaattgaatgttcagcaaatgacatatctctgcatgtgttttcaatagggtttcaaagaacccaggaaatacattgctgcacaaggtaatttctttgataatccaatattctttttgaaaaatttttatagcacttttaagaaaatttttcttatcagcttttatttgtttacctcctaggtcccagggatgaaactgttgatgatttctggaggatgatttgggaacagaaagccacagttattgtcatggtcactcgatgtgaagaaggaaacagggtaagaaccaagaagattcatagtgtgggtcttggggttaggaaaacaaggtgttgaatggcattttgaaaagccacatgtatctgcctgatgactaaaacagagagttctctattttaatcagtgttaacatttaatttaaaattttcatacatgtagaaaactaaaacttttaacatacaaatatatgtctatatgcataaaatttcaatgcttctgattaattgctagactcttaacttgattcctgtttctttgcagtattgttataagttcagtatatttcactgttttaacttcacaagaccttaatactcgaaacaaaactgaccttgggcagataggtggtgagtcatgtaatgtgactttaggaataaaagcctctctgtccccctacctaaaattaaccacaagcaatcatatcctttttgctgacaactgattatgtcctctcttaacatgcatctaagcctggaaagatcatcctgctaaaaagtatgaaggaaattcttcaggacacattagtgggaaatagaatatatttcaagcatcacagcttaaggtttatatgtgcttaaactatacaactgttttgagaatttcaaatgagtataggttttgttttcactgtttaaagaaagtttgataaaaaattggcttaaattaaaaattaaaatacttaataattttttaaaatgtagaacaagtgtgcagaatactggccgtcaatggaagagggcactcgggcttttggagatgttgttgtaaagatcaaccagcacaaaagatgtccagattacatcattcagaaattgaacattgtaaatgtgagtttgctttttacataatttttgttttgatacttttttataaaaatataattatggaatattaaaagtgagaaaataaaatatatcaggaaaaattatttttgataacctttaggatgaaagctgtggttagaacaatgacaaaaatcaatagggtcaaatttaagtcactggtcaagacgtttttgtccaactcaaatcgaaagaattatactgtattaattaattatctgttttaattattaaaaaaagagggaaggtccattaaatgtgttgaaaatataatcaaattattaaaagaataagcaatttgtcttcattgtcagtgagttcctacttttatgaaaaaaaattatattatttccataagagaaatgacagcattagagaacactgtaagaagtataaagttctaactatgcagcagagatagaatgtttagttcagaaaataaggaggtcattgtggccttagataatagttaaaatagagatcgtcatgcatgttatataattccattatatgaaaaatccacaataggcaagtcaataaagacagaaagtagatcagtggttgcctggagctgaggaggtcaaacagaaatggggagtggctgcaaataagaacaggctttcattttgtgatggtgaaaatgttctataattagatattggtgatggttgtactatttagtgagtgtaatatgaataccaaattgtacattttaaactggtgaactttatggtatgtaaaatgtgtatctcttatttccaacaaatgaattttatttttaattttttggggtacatggtaggtgtgtatattcatggggtaaatgagatgttttgattgaggcatacaatgcataacaatcacatcagggtaaatggggcatccatcatcccaagcatttatcttttctttgtgttacaaacaacccagttatactcttttggttattttgaaatgtataataaattattgttgaatagtcaccctgttgtgctatcaaatacaaggtcttattcattttatctaattatatttttgtacacattaaccatcaccatttccacccctgccatacccttccaatcctttggtaaccatcattctactctgtatatccaagagttcagttattttaaattttggctcccacaaataagtaacaacatatgaagtttgtatttctgtgtctggcttatttcacttaacgtaagtcctccaggtccatccatgttgttgcaaatgactagatcttacccctttttatggctgaataatacttcattgtatatatgtactacattttgtttatccattcatcagtcaactgatgcttaggttgtttccaaaagttgactactatgaatagtgctccaataaacgtgggagtgcagattatctcttcaatctactgtttcctttctttgcggtatatacctagcagtgggattgctggatcatatggtagtgctatttttagtttttttgagaaacctccaaacagttctacatagttgttgtactaatttactttctcaccaacattgtctgagggttttctttccttcacatccttgcaagcattcattcttggctatcttttatatataagttgttataactggagcatagtgataacttaatgtagttttgatttgcatttctctgatagtaaataatgttgaccacctttttatttatctgtttaccatttgtatgtcttcttttgagaaatgtctattcagatcttttgcctatttaaaaatcagattattagatttttcattataaagttctgtaagcttcttatgtattctggatattaatgctttgtcagatggatagttggcaaatattttccctcattctgtggcttgtctcttcactttgttgattgttttctttgctatacagaagctttctaacttgatgtaattctacttgttcatttttgctatggttgcctgtgcttgtggggtattgttgaataaaactttgcacaaaccaatgccctggagagtttccccaacattttcttttagtagtttcatagattaaggtcttagatctaagtctaatccattttttttatttaatgtttgtatacagcaagagatagggctttagtttcattcttccacatatgaatatccagttttcacagtacaatctattgtggagactgtcctttccccaatgcatattctgggtacctgtatcaaaaatgagtccactgtagagttgtttcattgctctatgtatgtttttatgccagtaccatgctgttctggttactatagctctgaagtataatttcaaattaggtattgtgattcctctagttttgttcttttcactcaggatggctttggctattctgggtcttttgtggtttcatataaatattaggattattttttctatttgtaaagaacattattggtattttgatagatattgcattgaatctgtagatagttttgagtagtatggacattttaataatactgagtctttcaattcatgaacatggaatagctttccattttttatgtcctcttcaatttcttgcatcaatgtttcatagttttcattgtagagatctttcacttctttggttaagtttattcctaggtatttatgttgtttttatctattgcaaacgagattactttcttgatttctttttcagattgttcaatgttagcatataaaaacactgcttgttttaatgttgattttatatctcatgaccttactgaatttgttaatcagttctaatagttttttggtggagtatttaggtttttccaaatataagataatggaatgtgcaaacaagtataattggacttcttcctttccaatttggatgccttgtgtttctttctcttgtctgatggctctagctgggacttccagttgaacaacagtggtgaaagtgggcatccttgtctttatccagatcttagaagaaaggctttcagttttttctcatttaatatgatgctagctgtgggtgtgtcatatatgactttcattctgttgaggtatattccttcgttaccctgttttttgaggtttcttattatgaagagatgttgaattttatggcataatttttcagcatcaattgaaatgatcatgtcttttgtccttcattctgttgatataatgtatcacaataattgatttgtgtatgttgaaccatccttgcatcccttggataaatgccacttgatcaggatgaatgatctttttaaagtgttgttgaattcagtttgctagtattttgttgaggatttttgcatcagtattcatcagggatattgaccggtagttttcttttttttgatgtgtctttgtctggttttggtatcagagtaatactggccttgcagaatgagtttggaagaattcctttctcttccattttttggaatagttagagtagaattggtactagttcttctttaaatgtttggtaaaatgtggtagtgaagccattaggtcccgggcttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaaggagtcaattcagcaagaggatataacaattgtaaatatatatgcaactaatactggagcacacagatatataaagcaaatattgttagagctaaagagagagatagactccaatacaataatagttggagacttcaacactctactttcagcattaggcagatcacccaggaagaaaatcaacaaagaaacattggtcttaatgtgcattgtagaccaaatgaacctaatagacatttatagaacacttcaaccaatggctgaagaatacacattcttctcctcagcccatggatcattctcagggacataccttatgttatgctacaaaacaagtcttacaaaattaaaaaaaaattatataaacttttctttgactacagtagaactagaaatcaataacaagaataagtttggaaactatacaaactcatggagagtgaacaatatattcctcaatgaccactgattcaatgaggaaatcactaaggaaattttaaaatttttcaaaacaaatgaaaatggaaacacaacaaaccaaatcctgtgtgatacagtgaaagcagtactaagagaaaagtttgtaagagtaagcacctacattaaaaaagaaaaatttcaaataaacaacataatgatacatttcaaagaactagaaaagcaagagcaaactgaactgtaaattagaagaaaaaataataaagatcaaagtagaaataaatgaaactgaaataaaaaaatacaaagcatcaatgaaataaaatgttgtttttaaaaagagaaaattgacaggccaggtgcagtggctcatgcctgtaatcccagtactttaagaggacaagtcgggtgtatcatttgaggtcaggagtttgagaccagcctggccaatatggtgaaaccccgtctctactaaaaatacaaaaaaatattagccaggtgtggtggcatgcacctgtaatcccagttacttgggagactgaggcagtagaatcacttgaacctgggaagccgaggttgcagtgagccaagattgcatcattacactcaagcctgggctttgcagtgagactttatctcaaaaaaaaagataaaattgacaaacctttagtcagactaaggaaaaaagagtggagactcaaatgcgtacagtcagagatgaaaaaagagacattgccactgatacttcagaaatttaaaagattatgagatgctactatgagcagttatatgctaatgaattggaaaacttagaagaaatggataaattcctagatacatgcaacctatcaagattgtaaaatgtctcttgatagagctgtttaaaaaactacaagtctttacatgggggttaagattttctcttaatttcatttattgtagggcttttagtaatctaaattttatttttgtatagtctagctatattttctacaggagaaacagacttagtctatatatctccgtaggtcttcttaggtttccatggtattactaattgttatgtctatagagtgctgtgaaacaatcctatcaatagtttctggccaaacacttgtttgactaagccacaaaggcacctgctccatagatatgaggatatatttctagattgatgcctatctggctacattctgtagtctgggtttactggtgttaattaactcagtttgtgtgtttcttttgttatctaaatgtagatggttctttatacctggccatagaattatgacttatgcatcttatggtggttaccttgaaattagaacaaacctgagctctaatctggggctgactttcctcagtcgtctctctacattctgtgttgacaatgctaccatgtgaaggcctaaggaatacaatgttcatcaaataattaatcagactttgctcacatatgaattagttctgtttgctggcctatcaagcagaagtattttaaacagttgtgagaatgacctttaccaaatcattttaaacacaaatccaaaaagcttccacccatgcaccccacttttatggtgtatgtttattttgggttttttttgcttgacagcatgcaagttcctagaaattttggttatacttttaaagaaagtattaccttacttaccttactgttaagttattgcttacagggtagtacatgcaagtcctgcacaatatcttaactactagttattgattagaaaggaaaacacaaccatggttgagaaaatatataagacacctgaggaaactatgaactcttttgagtagtttatgtttacacgaggagactttgtactggtactcccttccacttatttatgtttcatagtttgctttaaaaaaatcatctcaaagaaaatattatctcttgactagaaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcaggtaggaaaaacgaacaaaaaaaaaaaacaacaacaaaaaaactccaacagaatccacctgcctagggctgttagagacatctttccctttggcaattgctattttgggaaacaacctatgggagaagcttagattcttatattggcttcacacctgacagcttttccatgatcatgcctctgcttttttttgcttggtttgccagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggtatgttctaacctttagtgattattctcactttggttttttggacttaaatcttttccaagtgataataatgatattttttaaaaatccaaattcttcacaacctcaaacagtagatgatttcctgaaaactaaaacgtggtaatcaccagaaatacttagaagcatttttcattagtgcctaaaagtactgtggaagaaagatgaccacaaaatatataatttttaaaataatgaactactgttaacatatatcagattggcaaaaaaagtaaaaatgctgaaaatagatttggcatcatctcataaaattaaactgaagagacagaatagtatagtaatcaacagctggttttagaaactacacttacaggtttcaaatcttgcttttaattattaatacgagggtgagtggtattgtttattaagtaattttagtctgactgcacctcagttaagtcatctgtaaaatggagacaatgataatacctcacagacttataaccacaaaagtaatacaaataaagcacttaaacaagtccctggcccatgctatgcatttggtgattgtaagtgatggtaattactgaaaatgtctgtatttgacccagcaaaatcacatatatgcatatacccaagagaagcatcaactagaaacatttgcaagaatgtgcattgcattcagcattgtcaaaatagcaaaaaaaaaaaaaaaaaaaaagtgaaatacatatcaatgaaagaatggaaacaccgtaaatatgtatcaataggggaataggaagacaaaatgtggacatgtgaactctctgtacaacaaatgctatgttgtggtagaaagcaatgatctaggtttgtgtctgtctgtttggagagatgctcagatgaaaacaatgagtgagtaaagctgccatacgaaacattcaagatataatttatgtgatttaaaaaaaacatgaaaatgtacaatgcttgtgattacagatacatagatagcagtgtagaaacataaaaacaaattgttaaccaggtaaaaagaaattatttacagtggaaaataaagtacagtggaaagacagtgccaaactcagggaactaaaggtggcggttaaagaggattatcagaagtataccatttccttgaaaatactggattcaaacaaaataagcagtaaagagtagttaaatctgggtttggcccattggattacaaaaaaataattttcttattaaaagaatacttttcttattttaagttctaaaaactataaaaaaaggttttctaaggaataacaacttgcttttttatctcttgaatatactgtgaaatttattatagttttacattcagtaatttggcttactgacccaataatcactaaaggaagtaacatacaatgttctttagtttttaggaataaaagttgtgcaatacagagtacatggataatctatttgcaaagtaattcttttctgaaaaaataatctgaaaatagaatttgctcatattccagaaaactctgagagtgaacttccagaatatttaaatattatagatatcaatttactttgccatgaattgttccaatatgagcaaatttatggggaatgtatattttatttaaatatgacttggaggactctagattatcagttaactatctgtatttgttcttgaaattgtaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccaggtaatgatagtgacaacaataataataattacagataacttttattcagtgtcatctactttctaggtgtttgctatgcacttgacatagtgcttgcatttagtcttcaccagaaccaaaggagcacagatgagaaaactaggacacagtgagttaagagaaatgcctgaatctacacaactattacataggagatttctttagacccagaaatctgattctattgctaatacttttagccattcctcattaagctggtataaaatgaagtgtcaaaataatagtatatagccacaaaactggtctgccaaaggcaatacagcatatcacctttaaaaatcgtatctggttttggtttgtaaaggaaatcattagaagagtttatgactgcttaggaagttgaactggctggagctggtagacacacagtaaaggataagtacatgtgtcttaacctatttattaggcaattattctcacagctaacctagcatgtagttcactataatttcagagagtttgcatagctgtcctcaaattgctcagttgtcaaaaaaatgttttgtgttttttttgttccacctatgatttccaggttactgagtcattccataatctaccaaactggtaaattcagagtttctaaagaccaggagtgtgcttttaatcacatgcagaaccatttaatgtttaggatcaaagtggggttaaggtgggggtggaggtggagcatgcaataatgaccaagtgactcaatcccccagaagacctgtacttataatggaagaactagcagacacagggtagtctcaaacagagtagtgttttattgttgttttcttgcttttctagctgataaattaaccttattcaatatacctgccctactaatccacataaacacataagctgttagagacagttatacatttaagttaaacattcttatgaatgtttatttactatagaaaagacagacaatttttttcactaaataaatgtgcttgagtttctgctatgtgccaagtacaattctaggcacaagagtcaaaatgatctgcaagtggacatgggaagaaggatgagaggatgtgatccagatcacagatggaagctgtgaaattattccatttaagcagacagtaagacagaagatgagagtagaaatgcaagtcggttggtaaatttggtattgggaagttgaggcagctcttgcctgatgatctttcatttttcaagaaaatgtgaggctaggtcatcagttgagagttgagagatacaagggcgagtagggcaaagaagagctcaatgcttgaagggtataaactagttacctcaaagtataaaaacaatctccctaggcagaggcagtaagattgccagaagttatcatttgatcacctgaaatttatgattataagtttaaagaggaattagtcagttggttgtattgttttctatggcagcattgagctctttgggggtagaggctgtgtatgcagatagttgagttaaacctatctaggttttgaaaagtgactatttgaaaatagtgaggcaaacgagttgagggtgtttacaaatgaatgatgactgaggtggaaaataaaaagcaaattggccacatgagggaggtgagagaaagtagtaaggataataagttggagactttgatagaattacagattgctaggttgaacatatcagaataaatgactaggaataataggggtaattttcaatagcacagatagttgaacttatgattttagaggtgatgtaatatttggaatgaaacctacaaaggtggaatgatgaaagtggatgactgggaagtggagggaaagtcatgggaggtgaagaagctaagaaatgaagagactagagtcttggatagattattcttgtcaatgttgaattaaccaaaaatgatgacagaccttggaaagaagagaatatacttagccaagcctaaaactaaatgaggtggagtgattcagaaatcaatacctgacacttcccagtgaagccggtggatagaagctagtatagtatgatggcaggaatatcaaagtgcttggttgatttgaaagcaaatgagtagaaatggtttgcaagtagaatcagggatcaaggagaacacgtatcttttcttgaagctgtgaggtaaatggggtgtgaggaggaaagtcaactttttcttaaaagggctgctgagttattggtggtgtccttagctgacatccaggttttaattggtggaaagaaaaaaaaaagggtgaagtgactgttgggagaagatgattaagataaatgggagttcacagatgacagacgatgggcatcagagggcagggaggaaggcactgatgggttagatgtaagagactgggttgtatctgaggatacaaataaccattcaggaataaaaatctggggaatgtggatgcactgggaagcttagacttgtgatggcaagtgaaacaggtagagatttaagagtgacagatcctttgtgtcttagatgaaggtgagccattaattccacctataatcctgagtattgctacagggcataggctgcctcggtgactacactcacaagagcacaaggtgttgtaacagtttccaaaacatctggtccttcatgcagctcatggtggtgttcaagtggcctaaaattcagtgatgatattttctttcactcaattacgtagcaaagaatgaggtttgaaacagggtgccataattagtttgaatgagggtactatgctgaaaaaatatatgtctatatacacacacgtatctacatgcgtgtgtgtgtatataaaatcttaccgaattgtacatgaggagccttctcagtttcagttatttgtaacattatctattatcattaaatattattcacttgacaaatacttatttaaggactagtggaaagactgtaggcaggggtgtcttccagaagaaattggtatttaaactgatacctagagggtaagaaaagttattagagcaaccaaaaggggaaagggtagttcaagcaagaaaaaaaaaaaaagtgtttatgtgccaagagttgaagaacagcttggcccttccaagaattgaggaagctggtttggtagaagtattgagggacccagtaaggtgtaaggctggagaaacagtcaggggcgtatcaataaagactttttatgctattttgaggaggtttgttgtcctcttatagtgatggaaagctgttcatcttcagaagagcatcttctgttttgtgttttagaaggattagagcaggcgagattgaagacaaagaggccagttaggaaattgttgatgttttacaagcgagaaatgaaggcagactggattaagtaggaagaaagaaaactaaaaggatttgtgtatagaaatgatggatcttttctgactaattaggaactgtgggtgagaggaaagcaatctggaaggtgtaaacaaattaagaatgaactttcaaaacatgtgccaagtctcctaagaatgtgttgtctccaaagtttatttctgatcatttaaaataacttaccattgcttttgcaatatagatcaacatcggtctagtggtttcaatttatataagaacaaactatattatttttctatcaagcagctctgaagaaggagacatagtctgttacatatatatctttagtgcatactagccctgtcaaaaggactaaatgcctgagcaatttaaagaaaaaaaatcagaggcaaaccgaaaaattatggcctatagggagcatatgcaaatttcacaaaaattaatgaaatgcttttccttagggagcatcttatgatgcaataagccaatatttacattttaaaggagtttttctgtttttttttttttttttcagagacttccttcatataggagctggaggacacagcacattggaaatcaagaagaaaataaaagtaaaaacaggaattctaatgtcatcccatgtatgtagtttatttttttattttttgtatcagataaagttaagctcttttggatttgtttaatgtgggacacacagtcatataaattatcttgaagcaagttttcaacatttggttgttaatagggaagaagttactaggtattaaaatactagttattgcaagaacttataatcctgaacatttacaatgggctttggagggtagactgtattcagtgttttctttttaccaattatttcagaaatgggttgtcataaaagagaaatatataaagctgggagaaaaaagagcaagtctcttttacccattttctttcatttttagtttatttcagttatttactccagggtaattgacaaatagtaaaaattacatccatttgttctctatatgtttcctttttatcccttataactgggaggttgaaagtaaggggaaaatactctataaattctaaatcttcaaatttaacagatcaaaatatgcacagtttcaatacttgaattctactatttaagcatattaaaatgatcacatatggtaattttattcagctgcataaactaaaattagcatggataaaatataacacaagttgataaattagatgaccaaataaatcagatcagtgcatggttgacctagttaattttcataggagtccttatgaatgtagtttaaaatatggaattgatggtgatatggttaatcaaatcatttgaccaagttattataaattatagaaattaagaaacagtgagaaattataggtcaaataattttctgggctaaataattaatcaaagctacccatataagattgttaatttaatattactggagtataattgagggaaaaaatctacgctatgtattttgtaaacttatatcaagcagaattataatagtccatgggaaattaaagtatatgtatcaaagattaaataatcatatataatgatatgatatctctttgttgtttgacatggaattatgttccatgttttttcctggaatcctttttcttagacttttgttgtataatttgtttatcgacaagtactgaattttatataggatcttatttcatgtagatcagtaagttttcataatacaatctgtccctttttaaatactttcaaatttccacatgacaatgaagaagaaatttaattttttcaaggaagacttactactgatttatttcacatagatgactataacagagtgccacttaaacatgagctggaaatgagtaaagagagtgagcatgattcagatgaatcctctgatgatgacagtgattcagaggaaccaagcaaatacatcaatgcatcttttataatggtaggtacttaaattgccaaaacccaagatccaaacattttaaaataatatctatgttattagggccattcattaagcgattttataaaagaataatgagcttggtcataactacatatagattgacatgagagtttcaatttcaatgctacaatttaacttaatgaaagatttaaaaatactataacctaataacctgagacaaaataagataatgctattggttatattttatgacaaatatagctataatcacatcaattttaaaaatagtaaaatttgagcaaatacaagtatttgaaaatgtttatacatactcagatacccaaattgtaggcaatgacaaatttgtatatttgtatggttagaaacttttcattcagataaactgaattattaggtgagtctgtgtcatatccccccacttttttaattaactgagaattcaaacaatgaaactttagtcatttattaaatatttattatttatacactgttggatttacttattttccaaagtttcctaaagcacacattcatagaatattagtttaattaggaaatataataagaatgtaaagacactaattaaaattagtatagacacgatgaaggtaatttgaaatgcttaagtaattcctttttacaatcacattaacctttatagagaaacaaaaatgtgtgtcttttgtggaaaggaaaatttgtttcgcaagatatgttgtaatcttgatttcacattattagctaagaattactattatctgtataattattttacatatagctattacattgtttcttgtaagaaacataagaatattactatttgtatgtaacagcattgatatcaaactgactatatttccaaatggttactttaagaatctactgagctctcttctgtagtaacgaagtcccaccctttttttgtctaaaaagagctactggaaacctgaagtgatgattgctgctcagggaccactgaaggagaccattggtgacttttggcagatgatcttccaaagaaaagtcaaagttattgttatgctgacagaactgaaacatggagaccaggtttgtacttttgaggattttcttttaagcctttctgtcataaaacgtcattctctagtcttggattgcttgcttcatcgccatacccacgtctttttttatccctccatcacataattctgtctgctcagtcttacccctttcaccctggtgttggcctccatcagctgtgtctggattctgacagtctctcctgtttgtcccctccagtcttgcatgctgctcacagattagccaggatgcagcaatgtcagcgtcacagcaaataacagctacattttcacgctgttttcctcattttctcaagataaaagccaagatctttttgtgatatccagcaccctggacaatcaccccctcatgtgtctttcatcttcctcccatttttatgttttccatcctctccactctggacaagcaggtttcatgcccaagcctaaacacgccatttgcattgtcatcactgagtctaaacttattgatattccatgtaactaaatgtgtgctgtcttccagttttgaccctattcttttaacaagaccaaactcctgaaaaatgtatctatatcatcctttctttattcccatataatatttattgccataaaagtctatagttgaaggtgaatctaagctataatttgatttttttacttaatgcttgtgacagatattttatccttttcttaatgtcttcagttattattaaaatttccctggtggtagatctcactcagctttagcaccaaccacattatctgacatatgttcaagcctattcagtgaataaccttataagtatgcaaaagatttatgcttttttatgcccctctctctcccctaaatctcactctttctcaccctcacctggtccccttcccctgtacatggaaagttgctttttatgttttttgttttaaaggaatataagtccagatttctagcatggaattcccacaatcctttccttcatataaattgtgaaagctgggaaacaggatggaagtaccggcaggactccctgtctttgtcagaaattgtggggttgtagttggtagacaacagtttgtagtaagaagaaacacttttgtggttcatctactcttcaatctggccctttccttagctatgtagacaaaatatataaagctgcttatggtgttggtcaacaagatgacagagacaaagctccaaaagatgcagcctccttcctcaagaaccactgaagggacagtgggacctgagttattgaaagggtcatgaataacattgactcatgccagccataaatattgaagaggtcatgataagcatgtggaaaagaggagcaaacctcaaagacctacactaaggaaaacagctgttccgggggtgtcccagtcacctcgattgtgctcagcttcccttttcttacacaaggaaacaccacatatttattaaatgggtcgccagcacttaaatagattctggatttttataagtaggtttcaattttagaacacaataattttcatttaatagaaaagaggcacagacagagaaagaaagggagaaagagggagactgatcctttgcatatttcaaataggaaacaaattgttgaattgtcttcttttatctaggaaatctgtgctcagtactggggagaaggaaagcaaacatatggagatattgaagttgacctgaaagacacagacaaatcttcaacttatacccttcgtgtctttgaactgagacattccaaggtatggaaacaatttggggagtatatttctttgatataatggatctggtagcaaaatgaatataaattactctatgcaggcaaggccatcatataaataatgtttcagaataacattttaaaattatttaaatagaagtaactgtgaagaaaatatgactatcaaattagaaaataagctgaacttcactccagttaatgctctcttcaattctgattttagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcaggtgcgtgggatttggtagaatgtgctctcaaaatcataatgcttgacttctcggttcacatgttgtcttatctagttatcctcatatatgaaacacataaccacagtaaaaacttcttatggagtcggtcactctcttggttgtttccacaacacaactattgtagaaatataatagaagtgattatattatagtgcaataattttaagttgtgttttttaatacttggtgtcatgtcatctttgattccttggtagctaacattgagccaggaatgtcatttgtgtgaatgaattaatgaatggaagggtgtgtgaacagataggtagatgggtatcaccttacacatatacccatatacattgatctactctattaggtgtcacaaagacacctaatatgtttaatgaacacaaagtttattaaacatattttaagttaaatattaactgaaatcacaaagcttagcaattttgatttgaaactcattatttaattttctaaactgaaccaaaggcaaagattgtggtaatatcaataatactactagattttattagtttcttcatctgtgataggtgcttacatattcaccttaaataagcaatataattgaaagaaagatatataatataaaagtttacatgaaaaagaatattgaagtaaatgagaaacgaaaaatagtaaagtaaaatgagaaatgtttatctagtgaaaaacttttggaatttttgaaaaagtctaattgttattattggaattgcatatactagaatcaagccttaagaaatatatgaattttcagcatttatgtggaaagaaagctgaggaagggaagtttacactgtaaaactatatatgtttcttagaatatgatttatgtacaataactaaagtgtcctgctgataacatattgtttaaattgaatctttatgataatgctttatacttctcattgtttggtaaactatttgattgccctctttttagtgaataattctactaggtattacttttctactgatgcagaagtgaaaacatttgtgaaacgtggtagagaggcagaagagtgaagaagagcatgtgttctagtaatttacaaaatattaggtctaatatttctgattacatcagctttctcttctccaaatcttggtttccttatctatcatactggcattctgatattggtttcaacaacttcagatgtaaataaaaatgcattaaaatccataaaatactaaataaaagaaaatatatttgtaaagtcgaagacaaataagttttcaattccaggattatcacactcttaaattgaaaaatttgcctaaaaatgcatttagcgtaaataatttggttcttgaaagaggttggaataagataattatgataaacatgaagcaaaaaatatattctctctcttcctgtttttattctaatatcaccctttttggtgagaagtaggattattttctatcttttctttcttttatagggatggatctcagcaaacgggaatattttgtgctttgttaaatctcttagaaagtgcggaaacagaagaggtagtggatatttttcaagtggtaaaagctctacgcaaagctaggccaggcatggtttccacattcgtaagtatccttcaccattgcttttaacatgctcggaattttttttttctttttgacggtttccttttttcttttctcctctcctttcctctcgtttgttcttttttcccctttccttttctcttctctattttctttcctattcttttagcttttctacttttacatgataattcacattaaattattataagtctaaataagagcctaaagtttactagcactttgttgtgacagttcatgaagagcctttccctaaatgctcatgaatttcttaattttctttccttcactcctgtatcgatttgtgttgtgtaacaaaccacccccaaatttgggagcctaaacaaataacatttattatggttcagtagtctaatgatatgctggaatgttctgctggtgccctcaggctcaggcaatagagaccaggctgactcatgtgtctgccttcagctgatgtgtgccctacagtttggctggtctaaagtgacctacactgccagtaggctggcatgtggctgccatttagctatggcaacaacagtgagtgggccacatgtccctcctcatccagaagactagcccaggcctattcacattaaagcagcaagttccacaagggaaagaagacttgtgtgagaccacttgaggcccaggcttaaaagtgacacacatgtcttcttctgtatgttattagccaaataaataagtcataaagcctgcccagattcaaggggtagggaaatagactccacttcttgagagggcctgcaaattcacattgcaaagaaatgtggatacaggaaggaaaataagttttatattcttgtaatcgatctatcgtgtataccctctatgtggtagtaactgtagatggtcatctgggaattaatccttattcacagtgtaaacttaattactcactaaaatatataaagcttttaatcatgtatgatattgagatttcatatcttggtacttaaaaatgtatcaaatgcttgctatgtgctcttgctataaagagctaattggtatgagggaaagccaggtatttactaatcaatgtagtgagtaaaatgacagaaaaattataagaagaacatgaatgagggcatttaatttaaactttaggaatcaagaaacgcttctcgaagcagtgattcctgccctgattcttaaataatgtgtaggcattagacaggaggataagtacaaaacgtggcatcatgagcaaaggcatggaaatggcccatgagcggagtgaacactggtttggggttgctccaaggtaaagttcaaaaagtatcctgcagtcaaccctttagcaccataaagaaactaaattatttagatgtttttatgagaacatatcaaaaagtacttttctgtcatccaatacttccacaaataaatcattagttcttgctaatcttcatctggcataaaaataatgacatcaactttcttcatgtaatttcccacttaattcctttactaggagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatatgtatgtgtgtatgggtgtgtgtttgtgtgagagacagagaaagagagagaattctttcaagtgaatctaaaagcttttgcttttcctttgtttttatgaagaaaaaatacattttatattagaagtgttaacttagcttgaaggatctgtttttaaaaatcataaactgtgtgcagactcaataaaatcatgtacatttctgaaatgacctcaagatgtcctccttgttctactcatatatatctatcttatatagtttactattttacttctagagatagtacataaaggtggtatgtgtgtgtatgctactacaaaaaagttgttaactaaattaacattgggaaatcttatattccatatattagcatttagtccaatgtctttttaagcttatttaattaaaaaatttccagtgagcttatcatgctgtctttacatggggttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatcccattcataactttcattaaagcatttactttgaatttctccaatgcttagaatgtttttaccaggaatggatgtcgctaatcataataaaattcaaccattatttttttcttgtttataatacattgtgttatatgttcaaatatgaaatgtgtatgcacctattgaaatatgtttaatgcatttattaacatttgcaggacacttttacaggccccaattatccaatagtctaataattgtttaagatctagaaaaaaaaaatcaagaatagtggtatttttcatgaagtaataaaaactcgttttggtgaattctgtaatagcttatcatgaaggtcaaacacaacctttagattggtttggttttctatatctttactcttttgtctgattttatatgtcttaactatacagcaccgattattgtccattcaactcacatttattttgtgtccctacttctaattatttcactattgtaacatataaaattaacaattaacccttatagtagtatatagatccttgtgcttatttaacagatgaaaagaagtaaattttacaatgaagccacagtttctaatttatattaaggttacttattacatctttacttattaatgagaaaaggggattagaatcaccaattatgggcacaaaaaataaagtttgctttcacttacctcttcagtcactcaaactattatgcattcttttcttttattgaaacttgatcagttgccattttctagataatgtagttaaaatttgcagttctcatgttcaatagaacattatgatgtatgcctactttatctgttaattgcttcaaaatacaaatagcagaaagtctaaataatctacaagcaaagtttttcttcagaagtttcaattgcaagtaacatcttccaaatgtagttgtgtgttttaaatgtgttttccacctgacactatcttttgaaagattaaaaactacttagaaaatagagcaataataatttctattagtttaagaatcaagcttgagactttttttctacatatgggaatttgttgtaaagaaagagatgaaatagtggctcagaaagcccactactttgtgagaacatatactaaaccgaaggtgagacccatggcactagaacatggaattatatgtctatgatttttacctgtagaaagaaataatatgtgaattataggtctatgtctatggccatgggttgcattaatggggatctgttacaaggtataaaagatttatttgctaaagtttggcactgccattattaattctaggatccagtcagaaatattaagcaaaaagttttg

SEQ ID NO: 16441 - DNA, 28055 bp, Human
cacagtggcccagtttcagctcaccgcaacctccaacctcccgggttcaagctattctcctgcctcagcctcccaagtagctgggattacaggcacatgccaccacgctcagctaattttttgtatttttagtagacatggggtttcaccaagttggccaggctggtctcaaactcctgacctcgtgatccacccgcctcggcctcccaaagttctgggattacaggtgtgagccaccgtgccccatctgcatatcttttaacattgtgaatatttccatttaaaaatttttaaggaatcaaatttctcagtattttctttttgtcttctgagttttgcataatatttttaaaggttttcccaagttaacttaagaagaagtgtctcattttttcttctattactttaagaatttaataagagttttgatccatctgaaatttattttgatgtgtggcataagataggaagccaactgtattttgacaagctagttgtcccaaaatcatttactgataaatccttcatttccccatggatttgaagtgccacatttagcatacatttaatacatgtattttgatctatggacttttcaattacagtaatatcatattatgtgttcatatctaggaaggctggtcacactttattattatcttagaaatttccttttgaaccttagaatcagtttacctagtttcaaaaaacaatcttggtgtttttattgggaatgaattaaacttaagatcaacttgggaagaaatgaccgctttataaagttgagttgtcctacacaggatggtgatcttcctttttatctgctcaagtcttatttggtgtccctccataccgtttccaagtgttttactgacagcacttcacatttcttaagtttatttctagaaatttcaccttttgttgttgttgctattataggttgggtctttaattacagtttctgacttgttattgattgcaggtatgaaaactattggcttctatacttttggtattagccagctcactaaattaccttttataatcattgttagtagattcaagttttccaggtaaaaaatgacatcttcaaataatgaaaaattaacttcttcatttcttatgaaggatttttttttttttttctgagatggagtcttgctccatgctggctgtgcagtggcacgatcttggctcactgcaacctcagcctcccaggttcaagcaattcttctgccttagcctcctgagtagctgggagtacaggcgcctgccaccacgcccagctaatttttgtatttttagtagagagagggtttcaccatattggccaggctggtctcgaactcctgacctcaggtgatccgcctgacttggcttcccaaagtgctgggattacaggcatgagccactgcgctagtgaaaggcagaagtttcattttttttttttttttttttttttacataataagatccttcaaatgagttcaaaagttcaaagttttaaaagtataaaagagtaaacagcagaaagataacctttctaccccactgcccagatcccctccccacaggcaaccaatatttttggcagtgtgttttatatcattctatagacgtctcatgtatatgcagcaagtacagctgccctgaaagtgcttctggtaacacagtttcacaagcccaggtagggccaaatatgagatccttctcttgtctcttcaggaactaaagaaagaaaaattgaaaagacatagggcctgagtcccaagatagttcccaaccttctctggtagagggtcccagaccaggtaggcttggaagagttggggccccagcttctacttttaatacatttatttttcaccaacaaattctacttccttatctttttcacacagataaattgcagatgcacgtgttctctctattatcaaaacagcccatgaacatcttgcaacttgcagcccctgtcacgtttagggcctgagatttggagttggatatgggactcctgtttgtggcctcctctcttccagagtcttccagtgcagtccagataacatctctgagagtctcttgagaccactgaagcaagaggcttcaaggtttgttctaggcttctctagttggcaggtcttccccatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacagggtgagccaagccagcgctcgacagggcttgctggactgtatgcagcccccgcagcatcacctgttttcattaaaggaagtgggatggatggtaggcggggagatggtggtataactatggtgggggagggggtactggtgataatgaggtggctgtggggggggggtgtggtaggtgggtgctggtagaggtgatagtgagctggctgtggagcgtggtgtgatgatgggtgctggtggaggcggaggcggaggtgatggtgatgttgctgtggggtggttatggggtagcatgttggggtaaactggtcatgatagttgtatgatggtgagatggtgatggtggttaacatggatttatattcttatcccaaggtcatcatagcataagtgttcacagcttactgatacaaatgagagacaccctgggtagcatgaaggtgtcacagcttctacaccaaatgggagagaaggagaggagggagtcagggaatccacctaaaaggggcagaggcagacacaaagcaagaaaccaacacaggtggtcagagtcgcagcactcttggcaggaattattatatcctggcctgggaattgcctggctgttttgtgtcctgggagaagcaagcgggtaggcagagggaaatggtgcagaggtgtggggacagtggggtgcagctgtggttctgttgctatagaaactgcctcactcccctgccctggttggtctggtgtgcggagggcaactgacgctgagaccaacagctgagaagggaagaaaaagaactctgggtgaattaagtcaataatctcagccacgtcttgtgaaaatagggcagacaccaataaattgtcctttttttttttttttttaaacggagtctctctctgtcaccaggctagagttcagtggcgcaatctcggctcactgcaacctccgcctcctgggttcaagtgattctcctgcctcagccttctgagtagctgggactacaggcacccaccaccatgcccggctaattttttgtatttttagtagagacggagtttcaccttgttggccaggatggtctcgatctcttgacctcgtgatcctccgcctcggcctcccaaagttctgggattacaggcgtgagccactgcgcctggccaaatcgttctttttattctgtagagaccagacaaattaaaatctactcaatcagagaaacacaaagatatcaggagattgtttagtctagtcccaaaccagaggatgcccctgggcactaaattctttccaggcagtgggtggcagagggcccagtagccaccagatgagaatcactgagtatgaactcatgacatgctgcagtggctggagctggcttgtgctgacttgcaagagccaattgctaaattttgaggaaccttgtgaaccagttcttaaacacaggcattattaaaaattaaattgtataaacttacaagtaaaaaatttatattaaaaagaaagataataagtactctaaactcatcacttcctacgtattttactcctttttacctttatgttcttgagggcgtttatgtctcctgtatctctgtgctggaaaaaccacatgatgatgtgccagtccgcgcctcttcacagctctgcgcttgctgacatcacctcagtagcttcagactggccacagggggcgtagtttacacaacagaacttggcaaatgctgtaactcagtacgccctttcccctcaccgccccctccccccagccagtcgttaaacacagaactgcttgaggggcacatctgaggcagctctggggtattgtgaaaggcagagagggaggagggtggggtattgtgcacctctgaagagcattccacatgatctccgggttaacacaacttctcatgggctgtggtacaaataggagatggtgagaaaacacgaaggtatcattgcctcaagacccagtgggagagaaggggaggcaggagtcaatgaatccacctaaaaggggcagaggcagagataaaccaagaaaccaggcagacctaaagaatgcagaaacctcaggggccctgcgagggtctggcagcacaggtgggggcctgaggcccctgtgatgtatctgagaaaatctcctttaaggccgtctcaatgttctcatccattcattgacggagcaaacactgattggctatctattgagttctgctgggacagaggatgcagatatgagaaagcactgtatcttggggagctcacagtgaaaaggggagcagaggactaagcaggtgatgggtatcaaatgggataagtgctgaagaaagtggagcagagtactgtgggagtccagaggactgacctctgccaggaggagtcagtgaaggctacagaggtgggtgcctttggatcttggaagatgagtagacatctgccaggtagagaagagatggtgggagccttctagacagaacaagaatccaaatgaattctagtgactcttgccgtaacactatggtcattacgtgggttcggatacacggaggctcaagtcatatgacttaggatgtgactaaggcattccaccatccaatccaactcaaccagtctgcagaggcagggcttaccctgggccccagcacgagctttgtgctaagcagaaagaggaatcgtttttggtttctgagtgctgctgtacttcagtttacaaatcccagcctccccatggctactttatctatagccatggcctgaccaagccaagtggaggagggggatacaaggatgcaaggggcacccagggacatgaggaccagacacagagaggttccttccctcctctgcacactttcacatttcttcatattcaataatgtcagttcttttgccctaaatagacatcattggcatcttctatcatccccatcaccagtgaaagaaaagtagaacatccttcccctctactcttcagctctaagtcagagagactgggaattgaggaaaatttgaagtaggagtatcctgaatttgacaagatccgtcttgtagtctaaaggaccttgctatcagggtcatatcacttccctgaagtgggttagacctcatttcatacctgtgagcaaaagccatagtttctctcttgtggcagttgagccagtgcaaaaactgcaggctgcctttcagaccaaggagattcccaatggccttctgctattaaaggaacaaaaagtacacaattcctttgctgcaaaaacaaaacaaaacaaaaaaaccaacttttttttccagcattgttccttatcttgcgcttgctgaacatatcttttgacttctctactccttgtttttttcttccctcttgtattagtcggttctcacactgctataaagacatacctgagatggggtaatttataaagaaaagaagtttaactggctcatggttctgcgggctatacaagcttctgctcctggggaggcctcaggaaacttacaatcatggcagaatgtgaaggggaagcaagcacatcttcacatggctggtgggaaagagagagagagagtgaaggaggaggtgctacacacttttaaacaagcagcactagggggatggtgctaaaccattagaaactgcccccatgatccaatcacctcccaccaggcccctcctctaacactggggattacaattcgacctgaaatttgggcagggacccaaagccaaaccatatcacttctgttaaatgagaattgattaacagactgttgtaatactcttgagccacctccgtgaagggtttttctgggctgcatagagctgtgagtttatagtaagactttaggtcaaaaagctaccatgcacagtcttgggtgagacagttccacactcagcctcactcttctcatctataaaacaagagaattggactcagtgatctcaaaactagctctaaaaattatctgattgtgctctaagaaaaaatgagtaggtgcgagaaagattttgggttttattcattgcttgtggattgggaccagaaaaaggaggccaacaatgagagtaagcaacgcacttattaataataataacaacaacaacagtttcatttaatgggacttactgtgtatctgacacggctaaatgtattgtacatcatctaatccccacaactctgaagggagggatgattattctaaggaaaaggaaactgaggctcagggtggttaagttacttgcctgggattgcgcagctaaaacgtaagtggagccgaggattagaaccctggtctctctgactccagaatctctgcttgtacttacattgtcacatgtacttagtttccgtgacttctctctttcccacaacagccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggttagtgagtcaggcctagactcctttggcagcaggcctggggggttctctgttctctccagcaccctgttagggaatcaagggacaaatggcccacactgcagctgggccgtaagaagtcctgcccacctggcagggcagtcatgagggtgccacgagattatgtgcctggtaaatattgtttatgatgactcagaagctgcctagcagcagcatcaccaagagcttcttttcagttgcaaatataatagtagctttgtagaaaattctggatggggccgggtgtggtggctcacgcctgtaatcccagcgctttgggaggccgaggcgggtggattacctgaggtcaggagttcaagaccagcctgaccaacgtggtgaagccccgtttctactaaaaatacaaaaaattagccaggcatggtggcctataatcccagctactggggaggctgaggcagtagaatcacttgaacccaggaggtggaggttgcaatgagccgagatcgtgccattgcactccagcctgggcgacaaaagcaaaactccgtctcaaaaagaaagaaagaaaaagaaaattctggatggaatcgaacccaggctaaatacaacatttaattgctactgtttattgaatccatactacctgtcagatgtatgcaagtacttcacatgcaatatttcattcagtcctcccatggaccatgaagaagttactattacaatgcccattttatagactgtgatgaaggtccatgggtgccaaaagcctttgctctcctatcactctttcttgatgggcctcatttctaggtgggtcactttcattatcctccaaaaacaaatttcacctgctccatctttgtaataccctgaccttattactctgagttgtgaccaagaagtcccagtgacagactaatcaccgtgtgactacaggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagaggtaagtttggacctgggccagcctgggctgcatggagactccagacactggagctggggtgcagctctggcagggagcacctgcaccaggcccctgtggcagccctctctaaggacagcaccaacacccagtctgtgccagggctttctccctgaatgaaccagctctcagacccagggtcctgttttggtgtcacccctgggagaagcaggttgagccttcccactgaaagcaaaagcttgtctcaccaccagaccctggtgctggctcaggctattttggtcacaggagttgagactcactgagatgaccctgggaaagctgcccttcattataacagtgcaggggtgagaactggagagggcctcgggaatgaggtggcctgaggatgggcttctctctctctccccggctattctgtttccagagtgcactcaggctttgcaggacctgaagctgatgcaatctgggggaccctctttaagaaaaagaatataccattttgaattgataaggctccccggccgaccagggccccaagaggtctgtgttattccacaagcttctgcttccgcttcccagaaaatctacacttccctgtctttgctcctctcttccggctcattctgttcttgcagattgctgggcgctctccagacccccctacccaagggtctgacaggaccctacggttcaccagactatgagcggcttccctggggtcaggtgacctgctgtgccccgcccccccaaccgtggccacctctagcaaagctcagccctagctgtggctggagctgtgtcgtctagaaatggccatctgacataatacatgtccaaataagacccaaagtaggacccatcttctcttcctccccactctgaagattgtgtctgtctttgcttttaaatctatctcacccaccttcaaccttgggctccctgaagggtttgttgggagaatggaaaagagtttctcccggctttcctgtctttacaacatcaaacgagtacatagcccttttcctctcaagagttttgctgccagcctgaaggaggccccgtggcaaggcagggctgggaaactgacggaaacatggggaggtggaagaaccttcccaggttcttaagcctggcctcatgtctggcccgcagctcctgactgcttttctctgtggtacctaaatcccagtgggttctctctccacttcttctgtccagggcagcgttctccccgacttcaggtggccccacctgtcctcagctcaggcccttatttcctgctccaagggcgcaggcaggtggatcagcagatgggagctagtattcatccaggtgccccacgtggttgaatgtagatgcagggcccctgggctgggggaggccctttgactttccatgactggcagaaagcccttcaagctgcttccctccgaagctgaggcattggtgtacccccagatcaccctgagtctgcttccagagccaggccctggtgaccgccataaagacccagcaaagagttctaggacagtgcttggctcagggtgcccacactcttgactccagtgccaggagtcctgcctttgtgctcagtttgtagggacctgcctagggagggcctctctgcctgagtgtgggtggaggtctctgtctgggcaggggagagtcattggctccgctcatctgggaggtgactgagaagttttcagattccctggcatctcagtgtcatcttgccatgcttggagatggggattcaaaatgaaattttacatcattttacatcctatgataaaagttggagccctgctcacaggccaggcactttataaagggggctacatacacccaagcagagaggaggaggctggcactgcccatgctctcataagctacttcctagagccctgtagatcctggggccaaacacctcagtttgaagtaatttccaaaaaaataaaaaataaaaaacagtgatgcctagctgacttcagagagtactcaggatggaaggcaggagtggagggctccttgggcatatgggtctgtaattttaggccccagatttttcagggcttcctcatttctggtgtcttatccttctgttgccttcaggaccctcatccccagatggatccctggagggctccagagaggttagcctagcagctcctctggatgatttggaaatccttttctctctgtagtccccagaaactagtctaacccctgtccactccacctcggccactgggtcagagtgattagccctaagcagttgccctcctgcttctagcttcccagaatgggtgatggccccaaagtcgcccaccctcctcatgatttccagcccaaccctaggatgaggaaagcaggaggggcaccgggaggagactgagggagccctagactcacttggacacccccggggcagaaatccaatgttctgacttccacctctcaaccccgctgctccttccaaccctccaaccctgttttgccaaatgctcctcttccctctgcttacatccgtcagcctatgcttaattgtcttttttctgaaacacctgtttttggtcacaaattgaatttgtgggaaagacatacaagccattgggaagctccctggcctgttgccaatttatccagggacgatagtgttctggctgtgaacgactaggattttcttttttttttcttttttcttttttttttttttttgagacggagtttcactcttgttgcccaagctggagtgcgatggcatgatctcagctcactgcagcctccgcctcctggattcaagagattcttctgccttagcctcccaagtagctggaactacaagcacgtgccaccacacccacctaattttttgtatttttagtagagacagggtttcaccatgttggtcaggctggtcttgatctcctgacctcaggtgatccacccgcctcagcctcccaaagtgctgggattacaggcgtgagccaccacgcctggctggttttcatttttttttaagagaaagtctctcactctgtcacccaggctggagtgcagtggcaccatcatagctcattgcaacctcaaactcctgggctcaagtttcctcccgcttcagcctcctgaatagctaggactacaagtgcgtaccaccacacctggctgttttttttttattttttgtagagacagagtcttgctgtgttgcccaggctggtctcgaactcctggcctcaaactgtcctgctttggcctcccaaagtgctgggattataggcgtgagccactgcacctggccagccaagctttttaaggttgttcttgtcttcctggctgaccataaaggccacaccctgattgacccagggactctgggctgggtcccagtgggggcagtgaaagagggacttcctcctcagtcttcattaggcccagagctgacggggtggcctgcagccaaacctaatctcggcagggaggacagaggcctggatgtggagggtggacctaggacccccacaggccctcatccctacccacctctcaccagaggatgctgtgttcctgaagaatgaggctcagcgcatggagtacttgttgaaccagaatggtctcatctacctgggtacagctgactgcatccaggcagagtcctgggactttggccaggtaccagggccctctaggggaggagtgtgtagagtgactgtcccataaccttgcatgttgaggctagacagagctggtaggtccaaaaacccctggtcatgagaccatttctttagcccatttcagctttgtggtgcctctccttcctctgggccatatcagaacatcctccgggagctcccagaattattttccttaaaactgtggcaaatcaagccccagttacatccccactgtctttgagataaagaccaaatccccctagcctaacatccacggcccttccagccaggaccctgctttcctttccccatgaaccgccccatgttccaactcctcaccatcctcagagcaacaggctgaacgttccctctgccaggaagggcttcccactcttatctcctggcaagctcctacccatctctcaagaccttctcgaagccttccccaatccccgaaggcagggggagcctctccactgtgctgctctgtgccggcatctctacaagagccctggccatgctgctgtgctctgtaatctaaggggctgcactgcgtgtccatctccagtcctaaaccgtgggctcctcaggaacaggagctgcctcggtatcctccactcccggttcagggctggtaggacagtcagggttcactaaatggaaatggaatgcagtgcaatgaaacgaaacagtacagcacgggtccccgagagctcacaccctaccgggagtcagacaacagataggcaaaggactggatgcctgggaaaaggaacccaggtcccattgagaggttgggggagggagccagagctcctcagagggatgaggcaagggaggcaggtgtggagtgcgggtctgggagaaggacgagatgatgaggctgtcctgcaggatgagtgcctgacctggggacccttcctcatggccctgtgtggggacccttcatcatggccctgtgtgatccttaacagttcgagggggatgtcattgacctcagcctgcgcttgctgagcaaggacaagcaggtagagaagtggagccagccggtgcacgtggcccgtgtgttgggtgccttggtaagcgagaggctggggaaccagaatggggcaggggtgagaaaaaagccctctgagagacctgccccaccaccgtggcctcagaaacccccaaatcacaaatggccccctcctcccagggtgtggggacagttcctacagaagcgtccgaggaggacaaaaagacaggcaatagcatccacagcggggagaaaagcaaagaaatgtgtgatccctcaggatgcaagcccacagaagactaagcctcttttccctccccacacccagtcccatcctggagcttaggcccatgggaaggagtgggtagggcccatcttacccagggcttgctgctgcagtgatcgaagggacttcttttatacttctaaattattcataagaatatgcagaccatgatggtaactcggtgcttttccttgtccctaaaaatcctctcagaggagtcatgtgttcaccattccctctttgccgctgaagtcccctctgaaaagatggtgagagtccaggccagcctgtgagttgaaagaagcttgggataagtggcctccaggacccaggtgcaaagcacctcaaacgagtcagggtggaggactaagaaccggtgaaaccagcccccaaggaagggcagctctaatgctcctctttgtggctggagccagagaacttgttaagaaggagggtcctgggctccagccctagagctatgacccaggggcctaggatggagcccagaagcatgcaggtttaaccagtaccaggtggctctaatgctggggatctgttcaccatggttggagtactgtgatgagccctccttacccatgccctggaagctgtcctgcccaagggactcatactgacatccacacatttccccaaacagctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacaggttggtccccttgtctcctgtagagtgccctgcctcctgggttgttccctggcctcccatgtgggaaggacatctccaaaagcaggtgctgcctccctgcggccgcatttccccatctcatcacacagaagtagttgtcccaggcagctcctcccgccagcttctgctgcttttcccctcagcaaagttgggctcatttgcaaactcctttcccaaattcacttacttccctaaccctgccctagcagagcagccccgcagcgctgtgttctatgctctgttgccttctcccctggtatatgccccgcatgcggtggaacctgtgccttattgatcagccttcatgcatcctgttcttggctgccacttctaggttcctgcactcctcttctttccaagttttcagtgcccagaggagacactgaaaatcctagcctcccacacgcccccagcccggtctctcaagcgccccctgacactccgcccctcttctcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggtgagaagcccaagggagatgaggttccagtccaggaagggctccaaccctgcatagcacacctctgcaggagccccaccccctgcatggccctggcatggagagtaggctttcaagacccttagaggcggcgctgatggtcagtgatggtgtgcacgccccttcctgggagtgccacagccactttgacacagtgacctcccatcccactggaacaacaacagctctgccaggctgcatttccagaacctcttcagcactcgttttctttcccacttgaatttttctctttgctgcattcaggatcttccagacttccacagagtgctggatgacgcggcctgccttgccccagggttatgatggatggcagattctgcacccaagtgctcctaatggaggtggaggtaaagcctaggggtgggtccaggaccacgcagggctgcacagagctgaagtccccagagaggactcgggagcagcaggcagtcccaagggggtctgcatcctcgaaaacagtagaagcacgaggcatgacagcagccagcagaaagctgacctgatgccagtgggctcatgggaatagaggtgcctgctatcccggctacaaggctgtaggtagatgaggcaccttagagctgtgggtgagggagttgggtcacagtgaagggcagaggatcttaagatggcaagtggctgtgctaggccaggggcttacagcagaggttctgaggttctggacacggatgaagagggcatcgggataggctcaagcccagaaaaggaagcttcaggacccacaaaaagatagctcttcctcacccaggaacagaaatggcacagagcctggcacctagtaagtgctcaagaaaggtagccctattcctgtcatatccatagtaaagctggcttgagagctcctcacgctaaatatgaccctctgagcttctgcctgtccagttcctgagagggcttctgccagggaccatgaccaaaaagttttatcactaaatagttgatcactaaatagtttcacctctgtgactctctcagaaaccctgcctagtgctcacctctgaccttggtcctcgtggagggaaaataggctagaggatggggactgaggttacgcagttctgaactgagcagaggtctaggcgcagctcccatgctcaccaacctttctctccctcagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaaggtacgggccagggaagggccccaggcttctcggtacctgaaacggcaagcgagggaaagggatgggcctggtagatgcagccagaaagagacttgtcctttccgcatcatataaaacagggtttctcaaccccatttgacaccattgacatttgggcccagatatgtctttgttgtacaggctgtgcaccctaggacatttagcagcattcctgaccctcagaggaagtctaaattctttcacataggaaaattcagttccctgcaaaactgtcctcagagacagtgttgacttgtccccaaccttgctctctcatcattcaaggggagaattcatagcacttgaaaaagaacttggtccttgagtggtttggaagagacacactgtatcggtggtggagctgcctgacacagacatttttgggctaaatatggccttagaggcttgctgagttcttgtgactttggcatttgagcagaagtgggtaaatggttttgattcccagggttttattagaagcatttataccacccgggtaaaaggtcagctttgtttcttcccttctccagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctgggtaatgctctatggccccaccagacaccccccgacacacacacacacatggcccctgccttgggcaggcagcagccacagggcaccccctgcagtctctagagatggctttgagcccctgctgctcactctcatgttctctctcattcattcattcaacacatatttattgggcctgaagcaggaaaaaaacacgatgccaactgcagtcagataagtaaacagacccttcgtagcagtgtgagaagtgtttgctgagtttaacagagtacagtggcaggagagcacctccccccaggctggaataagctgcccccaaataaattgtactgcatggaatctggaaggatgagtaggagagtaatggccagaaaagtaagtcttggcattccagacggaaggagcaacgtgtgcaaagggccctgctcatccctgaggttctttcttaattggtctgagatggggtccaggtattgtttttttctttttttaacaccctgtgttattctacagttaagattccctgaaccagaacaattgtttttaaattttgctgcacattagaatcacctgggggaagtttgatgctcagcctgcatctcaggccaattaaatgacagattctatggtgggctggacgcagtggctcatgcctgtaatcccagcactttgggaggccaaagtggacagatcacctgaggtcaggagttcaagatcagcctgggcaacatggtgaaaccccgactctactaaaaatacaaaaattagccaggcttggtggcacacaactgtaatcccagctactggggagactgaggcaggagaatcgcttgaacccaggaggcagaggttgcagtgagccaagatcatgccactgcactccagcctgggtgacacagtgacactccgtctcaaaaagaaaaaaaacaaaaactccatggtggaacacatcagaatttttaaaaactgaagtaattccgatgtgcagacaagtgtgagaatcagttgacgagagcttgtctacagcattgcaacagccttctaaccggtcacctcacctccagtctctgtatcactcttccctttccaagcatgggaggagtggagttgggagagtggcgtgagaactggacagggcccaggtgacacagggtcttgtctctcttgctaaggagtttgagttttgttctctgggtaatggaaaactggtggaaggtttcaaccagggtagtcaatggaatcagaaattcattttaacaagaaagaacttttggcagaatggaatggaaggggtcatataagaagagtgcttcttaaccttagctgcacattgagtcatcttgggaacttttttttggggggggggcggagggggcagccttctgagccagagtaggttcagagactccgatcatctggggaacttttaaaaatactgatgtctgggcttcatcgccagagtctgatgtaactgatttggggtgtggcctggcattgggattgttttgtaaagctccccacttgattctaacatgcatccagtcttgagaaccactggattgaagatgagaaggttgtgtaaatcatcaagtcaagaaatcaaggccaaactaagctagcagcacttagagttaaaacatattaaggagttgagatagatggggcttgtgaatgtgtgaatgtgtatatgtgtgtggtgggtgcttctggtttgggtgagtcactagaataggaaaaatggggaggagcaagtttggggagaaaaaggatggatttggttgtggcacattgtgtctgaaagcccgtgacacacgcaagtggagctggccagcaggtggcaggagaccttggtaagataaagttctgggctggagctcagacgtggaaatcccagcacaggggggccaacaaagagtcagggcatagatgagctcatggcagtggggagaggtcagtgagtagatgagagggtgaggagggaacccagcagcagcagcagcatttagggggcgatcagaggaaaagcagagtaagggaggtcaaatagtcaaagaaagggggcacccagcaaggtcagcagaaagggcacgaggtgtcaaggctgaaaagcaccattaagagagtggacttacagagaagcttcctgggcgttaagccaattgcgttgggaaggtgagacaaactgtctagtcctccctggaggcatgacaggaaaaggtgaggctggggagtagtcagccagggacactgggcagagggagagagttgaacctgcttctatgctgaggaaaataagcaggcaagagggaaagaatggagcctcaggagagatgggttaaaattgatagtgctatgcttggggatatgagacaactagaataattgtagctcacatttatcaggcacttactatttgcccaaaatggtgttaagtgctttatatgcatcatatgcatcatcttgttagccctcacaaccacgttctgaggcaagaaccattgctatccccactttacagatgaggagatgagacacagagagggtcgttaatttactcagggttacacagctagtgtgatggggtcaggatggggcacagatttagaaagcagaggattcaacttaggcaggggggatacctcatcccctgagcagtagtgacagtaggagtagatatttcttctgtaaggtgacaaagcgagaccctgtctctaaaacaaaacaaaaaccctacaaacaacacaaaccatcccactaggtaggcattattagacaaggacactgaggccgaaagagcttaacttgttccagttcacaggggaccctttcccaaccccactgaggtggtctgccaagagcattgtcggggttggtgatggggatgagggtgaggagtgaggtcttgagtgagttccaagtgtacaattgctggggaaaatggtgcatctttctggcctcagtgaggccctgagtcctttgtattgtgtgtgtaactatggctgtttctggggtacatacacctgttgccactgactccacctgtcatgtgtttcagaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaaggtaggcaccagtcctcccctgagttgccctcgtctgccaccactcaggtccccatttcagaaggaatccaggccccttcagagcagatgactgtgctgcaagattaccagaaaatgctacatttaagagctccttcccttgaaagacatagtttcttacatgccctattaaggtttaaatcttccaacttctttagttaagtaaaggtttctaaaattggggccttcccagttactgcctcctacctacagggatcataatagcctatgtttatttagcacctcatacacatgccagaggattttcagctcctttatttctttctaagccctgtgaggtagaactgttcccattattcagatgaaaaaagtgagccctagagagcaacatgcccaagattataaaaacaggaagttctagaggcttatggctcttggtccagccctctttccatgtgtctaccctggccaaaatgaatgagatctgatccctgcccgcaagcaggttatagtttagttagggagacacaacatttggtcttccagataagtgctttaatagatgcacaaagttgctatggaataagtgaagcaaagggaattaattccagctggtgggtttggggatgaccttatgaaagagatgacatctatgctgggccttgaaaaatgggtaccctttcagtacagaggtaggggaaggccactgaagacagaagaagacagcaaagaggtgtaatggaaggtagcgtgaggcgtgtgctggggatggaacagtccctgacggggctgggatgtcacttagtcatgggaagaacaggtgaggtgggagagggggtttggggacacaccatgaagaacgttgaatacaatgtaaactgaattcccaagacagtgggaaaccctccaaggggtctgcatagaggagaggcgacatcagaaatcatcagtgaaggaccaagggtgggaataaatgcaggaagagcaggtagagcggtagaagacatcagctgtgaagtttgagtcagcttggcagagatgaggaaacttactgaggagggtacaggggtgcatgggaggagagagtgactgcagctgtgcccttggcatccacaccaggtattgcctcttcccacagatgccagagaaagcagagcagtatcaacccctcacagcctcagtcagcctccagaactccctagatgcccccatggaggactgtgtgatctccatcctgggaagggggctcattcacagagagaggagctacaggtaagtgatggcaggcttctcatccccctgaaatgtctcaatgggtcagaaaggcagggcccaagagagaaactctctctttgccatgtccatgcagacagcagatacccctagaaactaaactaaaggattagggctaccaagtggcttccctcatcctaggaccaccatatctgcaggaggatgggagtgaggcaggctgtgcgggccccttgggcacccgcctgccctggttgctgccctgatcctgcagggagagcctgggtgttgctgtgaatataggcgagggcattagggctgggtattggagagtaatgaagggaggacaggctatctttcattgtggtcagagggctacattctggtagtcaccaccacaatatacaattttgtttaatttattcccttttattcccattttcaccaccatccttcatatccttttattcgtacgtataaaatgtgtactgttgctttcatgagcctgtacttttaacttatataaatttatatttaattgctttcttacttttcactcagaactatgttaagatttatgcccatatgtcttctgctacataatatttcatcgtgtacacccaccactttctaccactccactccacagagatgggcacccagagtgcctccaactctctgacactgcaaataatgttgcagtgcacatcctcacacaagtctccttatatacttgtttgaaaatttggtggccaggcccggtggctcacgcctgtaatcccagcactttgggaggccaaggtaggtggatcacaaggtcaggaggatcgagaccatcctggctaacacagtgaaacaccgtctctactaaaattacaaaaaattagccgggcacagtggcagacgcctgtagtctcagctacttgagaggctgaggcaggagaatggtgtgaacctgggaggcggagcttgcagtgagccgagatcacgccactgcagtccagcccgggtgaaagagcgagactccatctcaaaaaaaaaaaaaaaatttggtggagtctggggatatatacccaggaatagaattgctgggtcctaggctatgatgtggtttgaccaggtactgtcagatttgcagaatggctgcaagagtctccactccctccagcagcacatgagaatttctgtattcctacccctccttcattcctggcaatacccagctattaacattttcttccagtccaataaaaatgaagtaatatcttactattattttaattgcaactcttcatatgtttgttagccttttatgttttcttctcagtaagtagtttgtcttattttgcccacttttcttttggtgtttctgtgcttccttcttattgatctgtagaagtttcctgtatagtccaggtattagtcccttgttggttttagacgttgcaaatatcttctttcattatgtctactgcatccttagttgaacagacagtataaagttcaagatacttactcctaccctccctgaggtccctaacaggtgtgtgggttactgagccactgcctcagcctcatgaaacttaatgagacattcttgccaagaaatcaagagaagggactgtcaacatttaaccatacttttgtggtctcccaaatcagttgtggggcaaagctccccaaaggaagtctgtcaccaaaagaaggtttataggcaggccaggaggttgctgacaaggctccaaacaccacctgctgacatactgacatcctctcaataagccctgctacatccactgtgcttagcaataagcaagggttccaaagctatagctctttatattagttcgtgttcacgctgctgataaagacatacccaaggctgggaagaaaaagaggtttaatgggacttatagttccacatgactggggaggcctcagaatcatggcgggaggtgaaaggcatttataacatggtggtggcaagagaaaatgaggaagaagcgaaagtggaaacccatgagaaacctatcagatctcatgggacttactatcacaagaatagcatgggaaagaccagctcccataattcaattacttccccctgggtccctcccatgaggaatgggagatagaactcaagttgagatttgggtggggacacagcaaaatcatatcattccatccctggcccctcccaatctcatgtcctcacatttcaaaaccaatcatgccttcccaacagttccccaaagtcttaactcatttcagcattaatccaaaagtccacaatccaaagtctcacccgagacaaggcaagtcccttctgcctatgagcctgtaaaatcaaaagcaagctagttacttcctagatacagtgggggtacaggtattgggtaaatacagccattccaaatggagaaattggccaaaacaaaggagttacagggcccatgcaagtccaaaatccagcagggcagtcaaattttaaagctccaaaatgatctcctttgactctaggtcacaataatgcaagaggtgggttcccatggtcttgggcagttctctctgcccctgtggctttgcagggtacagcgtccctcccagttgctctcacaggctggcgctgagtgtctgtggcttttccaggcagacagtgcaagttgtcagtggatctaccattctggggtgtggaggatggcggccctcttctcacagctccactaggcagtgccccagcagggactctgtgtgggggctctgaccccatatttgccttctgcactgccctagcagaggttctccatgagggtcctgcccttgcagcaaacttttgcctgggcccccagaatttccatagatattctgaaatctaggcagaggttcccaaacctcagttcttgacttctgtgcacccataggctcaacaccatttggaagctgccaaggcttgcggcttccaccctctgaagccacagcccaagcggtatgttggcccctttcagccatggctggagtggctgggacacagggcaccaagtccttaggctgcatacaacacaggaaccctgggcctggcccactaaaccactttttcctcctgagcctccgggcctgtgatgggaggggctgccatgaagttctctgacatggcctggagacatttcccccttgatcttcaggtttaacattaggctccttgttacttatgcaaatttctgcagccagcttgaatttttccctagaaaatgggtttttcttttctattgcatagtcaggctgcaaattttccaaacttttacgctctgcttcctttataaaactgaatgcctttgacagcacccaagtcacctcttgaatgctttgctacttagaaatttcttccaccagataccctaaatcatctttctcaagttcaaagttccacaaatctctagggcagggtcaaaatgccaccagtctctttgctaaaacataagagtcacctttgctccagttcctaacaagttcctcatctctatctgagaccacctcagcctggattttattgtccatattgctatcagcattttcggcaaagctatgcgacaagtctctaggaagttccaagctttcccacattttcatcttcttctgagcacttcaagctgctccaatctctgcctgttacccagttccaaagtcacttccacattttcgggtatcttttcagccatgccccactctactcataccaatttactgtattgtttgttttcacgctgctgataaagacatacctgagactgggaagaaaaagaggtttaattggacttacagttccacatggctggggaggcctcagaatcatggcaggaggcaaaggcacttctaacagggtggtggcaagagaaaatgaggaagaagcaaaagcagaaacctctgataagcccatcaggtctcctgagacttattcactatcacgagaatagcacaggaaagaccagcccccatgattcaattacctccccctgggtcccttccacaactcatgggaattctgggagatagaattcaagttgagatttgggtggggacacagccaaaccatatcactcttccaaacaaactccaatacaattaccaggaattgaaccagaaggaagtcacagatgacaaaaggaacaacagatgtagcttggaagcccttaggatgtacctcttctcaaccatgcagttgctcagcattgggtggctcctgtcttctattcctttataaacacttccattttaatagcaaggtacttagatgtttatttctgcatggtccacctcttcaagcaaggaaggatcaaagtcactgggaccagcagagcaatgaacctgggacagaactagcacctgccttttcctttatttcagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagagaaactttgcgtctcagtgtttgtgttgctataaaggaataactgaggctgggtagtttaaaagaaaagagctttatttggctcacggctctgcaggctgtacaagaaacagtgagggcttcaggctgcttccacttatgcaggaagatgaagggaggcaacgtgagcagagatcacagggcaagaatgggttgaggggtaggggtaagtgccaggtgccagcctcgttttaacagccagctctggggtgggggagggacatatagagcgagaacttactcattaccccaccaatggaacgaagccattcatgagggatccaaacacctcccattaggccccacctccaacactgggaatccaatttcagcatgaggtttgcagggttgaatatccaaactacatcactttatcagataaatgagtagtcattcaggttgaaaaggtgctcagatacctttaaggagtacattcagattgttcaggttcaggttttttgcaaccattttactgctcattaatacattcattaacttacagataagggaaaggacctaacacttaaatcattctaatatttctgatgaagtgggatattatcccaaaatggaatttttaggtaatcttaaaattacattgatcaagctgggctcggtggctcacatctgtaatcccagcactttgggaggctgacgtgggcagatcacctgaggtcaggagtttgagaccagcctggccaacatggtgaaaccccatctctactaaaaatacaaaaattagctggacatggtggtgtgcatctgtagtcccagctacttgagaggctgaagccagagaattgcttgagaacctgggaggcggaggttgcagtgagccgagagtgtgccactgcactccagcttgggggacagagcaagactccatctcaaaaaaaaaaaaaaaaaaaaaaaaattacattgatcagtgctttccctgatcattatccttaaagatccaaacatgactgaacgaagttatacaatacaggacctgagagaataattcagctagaggtaagtctttatattagagttctatattcattaagtatcccacaattaaagtctgatgttaataacatgaatttggtccagtagagaaatataaaagtatataaaaaataggctctatatgaaaggataaaagaactagactgttgtacaatgttattattttgtttatgttattttgttgccttgacactctgtcagtttgattttagttccttcccttcatgacacttgttaacaatacaaaatggcacttcaaaacagtaagctaaaactcatttggcttaaggaatttcaaccccaaccccaagtatacattagtcactcaaagaatgactgctgttgctgattatacctaaagacagcagaaaggcatatgttatgaattacacctacaaaaggaagatgatgggcatgagaggtggcggagacctgtaggacatgcataatgccctattcagctcaccagaatatacatcattatagatttacactgctttccaatatgcagtcttctagactgatgcaaaagtataattaagtggtgatggttttgcaaaaggatgaactgaaaaggcccttaaaattacataaaatctcttacacactaaaaaatttttgatttataaaaatttggtatttacatttggggacacacgtaaccaaggacaacacaagtatgtataaggaaaataaatctgttcaataaggtgggcaaacctaacaaatgagctcaatgccaatatattttagagacatggagtaatctgtgataatattcagaaggacttgctgataataatatataacatggtgaaatactaagatgaattttggagtcatcttttataaataaagtgttttgttctaaatatacttctgattagaatcagatttttaaacctacaaacccaaatgaaagcaatgttctagtctcaatccactgtattt

SEQ ID NO: 16442 - DNA, 31423 bp, Human
gaccttgtgatccacccgcctcggcctcccaaagtgctgaaattataggtgtgagccaccacgcccggctggaagtccccttctattcttagtttgttgaatatttttatcatgaaagaatgttggattctgttgaattcgctgattcactttgaaaaagtctaaatacaaccaagaaaaagcagctaggtctctgtacttattggcttatatctagaggcaaaagacagacaaaaaagtagctaagaaaaacatctgaacacctcatcctaatccttacactagtaggtctgttgatatgaatgaacaaatgaaccggtcatgtaaattaacttgtcaattaagcagatgagcgattcaggtaagtgtatagctcagtaggtgatggaaagaagggtgggccaactgaggcaggcttcatggagcaggtaggtattggaggacaggtggaatttggttagagagtgaggggcccttgagttggggctataacagcaaatacaaaaacagggatttgcttggggatagattggctagaggacagggccaatgctgggaatgatgagaagtgagaatgcaagaataagctaaggccaagtatgaagagctgtgtcaagttaaggaatgtgccttttatatggcagactgtaggagatctcagaacttgtaaagcaaaagaatggcatgattaaattgtcttgaggaaaggtaatctgataatgcattaagagatgggagatggggagagatacaggaggcaggagacctcatggaggccattatggtgactaggtatgagaagacgttggaattatgtgaatgtggaaaaggatggatagacaccagagatgttttaatggaaggcatgaagagagttagtgacaggtgaatgggcatgggctgagaagaagatgggtgagccaattgtgatttaaaggctgtgagcccaccaggtgactcggaccatggcagaaccatggtcaaacaaggaaaaatcaaaaacagacccttctggcagagacacacttggagactagtgaggtcagtctgtgttttagcagaggctccagaaggttgggaatgaaactttctttgactgttgtcagcatccaagctcccagggcactgagcacgtggcctgtggtggtcagagagccagcagatggctaaaagaagagcagctagcagccgggcacggtggctcacgcctgtaatcccagcactttgggaggccgaggcaggcagatcacgaggtcaggagatccagaccattctcgctaacacggtgaaaccctgtctttactaaaactacaaaaaattagccaggcatggtggcgggcgcctgtagccccagctactcgggaggctgaggcaggagaatggcgtgaacccgggaggcggagcttgcagtgagccgagatcgtgccactgcacagcagcctgggcaacagtgtgagactctgtctcaaaaaaaaaaaaaaaaacaaaaaacaaaaaacaaaaaaaaaaaaaaaaaaaaggaagagcagctagcccaaggagttaaacccagggcaactaaaccagggagcagctccccagacctggaggctagtacaggcgcaagtgagactgttaacttgagtccaagaaagcggatgctggggtgaatctgaagccatgtgaggctgaagggagcaatcaaacttggccaggtctacagaaggacttggacagaggcagaaaaccatgcccctccaggagggtgtaagggagaagaagatagagggtcagagagataggagaggaaggaaaaaagaggaaagcgcatgcatggaacctcattaaatcctcatccttatcctcatcctggcaggctgatcttatggactctattttactgatatggaaactgaggctcaagctaagttactttctcaagtttgcagaactagtaagtggtggacaggattggctccacaaccccactattttgtctaaccctggctgccccattgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggtaagaaccccagctggctcacaggggctgtgtgtgtctgggaggggattttcgggggtttggaggtcgccatggagggcctcagctctacttccctcctaggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccaggtaaggctgggtgcccaggcggtgccctcctttctcttctgtcagtgctgccagagagacaggctcaagggtttctagaccccgctcccgggccacccagagcctcctcaattccctgcactcagcatccgccccaactaccaccaatcagggcaggaaatcttgctattcatttacttatttagaattttcaagttataaaccaaatcatctttgcttaaacagaaaaactgttacaattaagtttgatcgtgaataacatctaccttcatcatataattttaagttaactagagtatttttcgttataaaaggaacgaatgcactgcattgagtatttatggaatgaaggaaagggtcaaaaaaaaagaaagagaaaagtgtaaagtaaaaagtaaagcctcccaatctctaagttccattcaacagcagttctattctttcagattccattcacctttaacattttcttgtgtagttttacaaaagtgttctatgcttaatcaaatatgtatgcctctgtgtgtgtgtgattctacaatacataccgtaagtgagattatgtaatacataccattctccagcttttttttttttttaatttaacaattcaactttgggcacattttcctatcggagcattcttcttagcagctacaattatttcactgtttggatgcaccagatatttttaactagttctctatgggcattttagctgtttccggtttttttttttcttcttcttctatagacaaagtaacagtgaatatctcacactacctgtctcacaagccctgacctctaaatctagttggggacagggctagatacataggcagacacaaggacatggtgtgggcagaaggggtcaggagtagagaacgggtctgctgtgctttgagcagaggccagactcccaagtctggcttctgacttaggggaccatccgcttcccatcttccctctctttctaccttctcccccagccttatcccaagggggcctcctgggtcacatcaggacccagagccctggatgggttctaacgcctctaaccactacccgcttccctgtccccgaatggctgagaatgctcacccatcagccaggtggagagaccctgccatgggatccaggagggccagtcgactgttttccctgtctctgtctcgtatctctctctctctctctctcagggccttctgagcagtggggagaaaagcattaatgatggggccttctctcttgagcttgtgccacacccaggccccgggagacccaacactgggcctagggttggtgggggctgaagtgccctgtggtgctgcaggacaggagggtattggctgggaagcctcactgtgtagctcaggccactgctggccctggctgagagaagggggctgtgtggtctcaaccatgaacctgcagcttctcgccacactggcccaaaccctcaataaaatacatctcagcaacgacgcctcctgcaccagcctcctatcaggctgtgtctgaggctgcctctgaggagggcacctttccctcagggtcagacagagtttccagacagttctaggaccctgcaaagtggacgtctgtgcccatggccttttgtttgtttgttcttaactttaaaaagataatttttaacctttattttagattcaggggtacacatacagatttgctatgtaggtaaattgcacaccacagaggtttggtttgatgtacgcattattttattacccaggtaataagcatactacccaacaggtagtttttcttttttttttttgtaatggtttcttttttttattattatacgttaagttctatggtatgtgtgcacaacatgcaggtttgttacatatgtatacatgtgccatgttggtgtgctgcacccattaacttgtcatttacattaggtatatctcctaatgctatccctcccctcttccccccaccccacgacaggccctggtgtgtgatgttccccaccctgtgtccaagtgttctcattgttcaattcccacctatgagtgagaacatgtggtgtttggtcttacgtccttgcaatagtttgctcagaatgatggtttccagctgcatccatgtccctataaaggacatgaactcatcattttttatggctgcatagtattccatggtgtatatgtgccacattttcttaatccagtctatcattgatggacatttgggttggttccaagtctttgctattatggatagtgccacaataaacatacgtgtgcatgtgtctttatagcagcatgatttataatcctttgggtatatgcccagtaatggtatggctgggtcaaatggtatttctagttctagacccttgaggaatcgccacactgtcttccacaatggttgaactagtttacagtcctaccaacagtgtaaaagtgttggtatgtctccacatcgtctccacacccccaacatgtagtttttcaatccttaccttcctcccaccctccaccctcaagtaagctccattactttcaatggcaaaatccacaattacttttgcaccaacctaatgttaagatatttttgaactggcttcaaaaccctctgttcatatgggcagcacgtatatgtgtatatgtataaaaattcatgctgtaaacattgttcataatctgttcagacttcatgtatcacatacagatttccacgtccatgtacacgattttgctgccttacgtctctatggtatgggattccatggtggagatgtattgaagctatctaactactccccaataacagggcatgtaggtggtttccagcttttcagaatcataaacagcactcagatgaacagcttagtgtctaaacctttgtgcacatatgaaatgctttgtctagattaaatgcctacaaaaggaataatgaggtcaatgccaacccttaaggtctggtttgctcttttccaaccaagattagtatagcagaaaaagcacagaatatggaatcaatcggctgtgttcaatttccagctctgtgctgatgtgtgatttgggcaatttacttaatcactctgagcctgtttcctcaaccttaaaatggggataggatgtaaatgtgctttgtaaaccaagaaattccaccaaagggaaatttttattattctaccttatgttcatgttgagcctgttgctggtgttgggagcatggactccctaagacccactgcctcgtgcccctcttggtgtcgccaggggcccttgctccagaaccgtttcctctgggactgtggggatgagaatggggcagtaagggaaaggtgacttttctgcttcgtgccctcccactctggttcctagaggatgctgtctacttggacagtgaaccccagaggcaggagtatgtcatgaatgattatggcttcatctaccaaggcagcaagaactggatccgcccatgtccctggaactatggacaggtgagtctcagccctgcttatggcccatcccggccccgagcttgtggggagagggagcagggcacatgtgagcttcacctagaactgctgaccaacgctaactaaatggcacgaggaagatgtgtgttgtgagcccaggttgcccgaggagcagccatagggagtgggagggcctttctctttgctgatcatgtctgatttggacaacaagagctaagggtaagggcagttaaaggcacctcacccaggaattccagtgagcatgagggtgaagatggaaggcatggcaaccatcacagcagtgatgatgcccggcattttggttcattaaactgtttttccactggggtcccattttccactctctcacttcatgctcacaacccttggtgactgacccctagcatcagttctgtcacaccaaggacaacttgtcccctgaatgtctcagccagaagcagggctgatgagcagcaatgcatctccctccccatggctactgtctctttatttctgtgtctttttgatgatacatctttttaattatgaaagttaatacatgcttgtttaaaaagatttgcaaagagacattacaaaaatggatacatgaaggtcatcccaagcaccatcaccagcttggtgtatgttcctctacattttgttttctatacgcattctaaaacgctactttatacgtaaaaataacgtcatattaattgcaatgctctgcacctcctgcctttctaaaagcctgcctctcatttcaaattcagcctgcagcagggacttcaggaagtccagtgccaggcaaggaagagggctcttgatgctgagccccagtgccaagagcactgtgggagggagaggatcagccctcagcctctcagaaagctgtcagctaggaaaccctggggatcctcgtggagccttgtctcagcttgatatgaattcctctcctggacctgcccaaatagaactccaacatatgtgtccttccagccccagcctgggcccaggggtggctctagccaagatgagatatagcggcctcaactggccccaactcacatccccaatcctcactaagcatgggcagattgggcatcatggagagacctggacaggagtgggctgccatctgtaagaaacagaagagaggggttgctgctttctcagacctgggtccctctgtttctgtctttcttttgttgttgttgtcttgctttttgtttttgagacatggtcttgctctgtcacccaggctggaaggcagtggtgagatcatggctcattgcagccttgacctcctggactcaagtgatcctcccacctcagcctcctgagtagctgggactacaggcatgccccaccacacctggctaatttttttattttttgcagagacgaggtctcactatattgcccaggctggtctcaaactcctgggctcaaatgatcctcccgtctcggcctcccaaagtgttgggattacaggtgtgtgccatcgcgcctggcccatttctgtctttcttcttcattaaatatatattgatcgcctgctcagtgccaggcagggtgctaagtgctagagatatgaaaatgaatacaacattgtccctgatcttacagtgtaatgcggactcagacacataaacaggtcacttatcatgaatatgtaaagattgagagacaggggcagagtgttctgagagccaaggggaagagctcttggttgggcatgggagtatcatagaagcttcctgggagaggagatgtttgaattgagttagccaagtgaaggatagtgggaaaaacatcccagacagagggaaggtgtgagcaaagacacgagggtgggaaacggtttggcccgctgcagacatttggtgttgctggagaaaaaatggtagggatgggggcggagggcaattattgatacttgaggctggagaggtaggttggggccagatctgggaggaacttatgtgccttctgaaggaggtcagagctttgattctctaggctgtaggaggcctttgaaaatttgaaaacagaaaagtgagctgatcagactgtcctctggggaagattgatcagagaagcctcctaattctgcatgttgcccagtgttacacaggaataaatgtattcatttacactcattctacaaagaggtacagagttcctgcaatgtgctgggcaccatgccaggcctaaggtccagagttgtgaagagagctggactgaaacagccccgagactcaggcaggaaaagacagacttgactacatcacgtaactgagtctcacacggagaggggacatacccagggctgtggcgctaaagcaggctcaggctcggggaaggcctcagagggagtggcattcacaccaagtctgaaggaccaggaggagccagcctgccttgggtgggaaattttcataattcacatgcaattagtcagcctagagccccagtgaatcacaggtgccatggcaggttggcaccctcacttcagcagtagctgccaatgctaagctgggtcagcaggtgagtgtggaagcaggggcaatgtggttttggcaggaacaccccctggtgctctaggagtgtgggaactgagaggagaggaggagccttttcaatcagtcagactcactggggaaaaaacccaaacaacccaggagtagcaatagtcatctcggagtgaaggggagggatttggtgtgcagggcatatgcaccaggtgaattgtgaccctagagttttgaaaccccacacctgaatgggagggaattcatggctgttctgtttgacacagttaccttccaagtgagtttatattccactagggttggggggaagtcattactttttacatactcccacgtgacaagcatgggtgccttccctctctgcctctccccccgaagtttgaagacaaaatcatagacatctgcctgaagctgctagacaagagcctgcacttccagactgacccagccacagactgtgctctgcggggaagccccgtctatgtcagcagagtggtgtgtgccatggtgaggtccctggcgtgcccggggagggaggaagctgtgcagcgggagccctgcccactcacagttgccccctgcagtgggtgaaagagggaccctctggcaaagccatcttggatgagactgacgccagaatgtgggtgacaagttttctcagccgagctctgaaatagctgggtgtgggtcatcacctctattaattccaaattgcatgttttgagaaagggtgagtgtagctccagtttgggaaatggtcttgttgtttctaaatttcctcttttctgaagtgttttttaaagctctcagaggtaagctccagctttgcaggggatgggaggacatgggtaaggggtagataggaacataataataaactaattcacagtggagcaaaagtcagaagagtcaacccccatccttagccctccccagcaggtctggaagtccacagtaaaatgctgtcaaaagtctctcctctgtttctcaggcccatgggtcttccaaggcagcccacacatggcatgttgaggaaatggatgtttctaacacttctctatatggcttctcttcagatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacaggtaggaggtagaaaggaccccacaaaaaggtcagaagtatagccgctcatgtatgagccttctgaaccattcccatcccagtcccacacagttcccaccaagggacatttggaaggaagcccttttcctctctgaaatgtctcggccgggcacggtggctcacacctgtaatcccagcactttgggagcccgaggtgggtggatcccaaggtcaggagttcaagaccagcctggccaagatggtgaaaccccgtctctactaaaaatacaaaaattagcagggcacggtggcaggcacctgtaatcccagctactcgggaggctgaggcaggagaattgcttgaacctgggggggcagaggttgcaatgagccaagatcacgccactgcactccagtctgggtgacaagagtgagactccatctcaaaaaataaataaaaaaataaagtgtctcatcacggacctcagactgcacatgtctgggcttatgtcagaccatggttccgaagtgacagtcacacgtcccaggacgcctgacacccttgcttcgtctaagcttaggcaacttaccagcatattcctaagagcttggctgggaactgtctaggttcaagacagaaatgagatgagaggctgagtaattaggaaactacaaactgattagtgtcctttctgagcacagagaatgggctcaatgaagatgtgtacatggaagggaaacgtgagtcagggctgtggtgtgggccatggggccagagcaagatggcaacccaagggaaatgaccttgaatttggagttgttgagggcctgatagcctgactctggccagagggttaggggaaggaagaaaatgtgaggtcagcttttcagataaggaatggatactacattagtagaggaaaaactaaaaaatacatatgtggaaaagatggcaaatggaagttggtttgtgggtgacaagaggaggagatgaggaggaaatcatgaggggagtgatacttggaaatgagtcacacatggaggtgaaaggaggaggccttctgcctcacccagggccaagcacttgctccgggtcctcaccctcaccctgccccacacccaggcctgctctcggcctcttggcttgcgcattctgatttgggtggcgatcagaaggttatttattgtgttaagctggggagagaagccaagcaaggttttcgctcacaggattctttaggggaatccaagaataccagatctgcccatagcttggtgtttattgggggctcaggccttctgggtagaattttgtgtgtgacaaagtttgttgcatttcgtgtgcatatatgtgccaggcccatctctgggctgttggaagaatgcaacttccctgaaggaagctcagagagccccaggcatctgtccaagggcacgaggaggtgttgccaccgagagagagtgactttgcacagttgatgagaatgatcagtaagccccaagattactcctctgcagctgcagagccagctcttgagttggatgagttgagttggatgagttgagtgcccaggtataagaaacaaggaattccacagctttgagactccatgtcatgaatatttgggtgaagtgagaggactgagtccttcaggaagcaagcacaagactgacaggtagagactagatcttgtataagatagagagagaaccttccagtgtgtggaaaagcctagcatctaatgggccaggtatgtgtgtgtagaaggagtgagccaggtttgggtgtggttgtctggaactgcgtgatgagagaagtggagccagtgaatggagattatgcaatgacagtagaccaattaacatgtttgtgagaatcatggccctttagtggcctggaaaacaaagggttggtcaaagtaggtcaaacgtggcccagtcccctgtagctcaatcagcactaaccttcccccaaagagctaccatgttataaattaagaaatacagcagtttgaaaaactcatcccttcacagcaatacttactgagtccttattctacaccaggcactcactgtgttccaagagctcttggatacaagatgggtaagacccagcttctgtcttcaaccaaagttaaaattaaagatttagtcaaactccttaacctcaaacagttcccaaagcatgttttttgaaaatatatatgttattatttcatagccatagtaactaatgtttattggggacttcctttgtgccaggcactgtgctaaaaccctgacagcctagagtagtggagaagcttgtggactctggaggcaagatgcgtgaggttgcataccagcactaccattaattggctgagtaaccttgggcaagtcatttaacttgtgcctcagtttcctcagatgtacaatggggaaagtagtggtacctacctcataggattattgaagggattgagtgacttcatactggagagtgcttagaatagtgcctggctatagtgagtgttcaggaagcatcagttagggtcctcttgtctgatcccctaaatgaccttatgaggtgggacctatcatctccatttttcagaagaggaaattgagtggtggagccagtctcatacccaagtctggctggctctgtaagccatgtgctaaccatcaggccataccacctcatgaacattgctagcagctgccattaatccagcaccaagtccctcaggaacacactggacgctttcacttttactaatcctgaccaccacctgcaaagtcgatatatcattatagccatttcacagatgaggaagcaggcttaaagtgactgagggactctggtctgactcagacatgcatctcccctctacggccctgcctcccagtgtggcctttcaacacgttgacacattgacttcaacttcccatagaaaaaccacaaaaggaggctttgcgtgcctcaaagatgaggttatagtttttgcacatccatttagttgcctgttacttgagaattttagagaactccctggcctaccctttctgtgcccagggccaggcaccctggagttctaggccctcaggctcttcctgttctggcctttcactctttgacaagattggaaccctcagccctcggctgaggtctgggaagtagcctggatgcctttcacgatagcaagagtacagaggggacagtgatgttctgttgcctgaaaactccccaaaagccagctgtgaaaaagccacatagtgtataatttcatacatatgaaatgtccagagcaggcaaattcatagagatagaaagtagagcgtggttgcttagggctgggaggaggggatagttgggagtgactgctaatgtaatgaggtttccttttgaggtgaaaatgttttggagttagacagtaaagattgttgtacaacctgtgactgtattacaaaccactgaactgtccactttacaaggctgaactttatggtatgtgaattatatctcaagaaaattatttgagaagaagccaggcatcctgggaatatgcctggtctattcttgtccataactgcctggggttggaagtggggtaggggacagcaatgacttgggctgagggttgggaggtactaatgtgtgaccgtaagcaggtgtacagcatcatccctcttctgtaaaataaggtccaaggtcccaggggctgtaaggggaaggggaggtaggaaagggtgtgggcgatgggaggctgcctggttgggactgggactgggccctcttaaactaaagcaacccaacttgcatgtcttttatacatcaaatcctcacttatgattggtttgcatatagggccctctgcttaatacttttttgaaaacccctgagctagatattatctaagatttttctaactcaattatgtaggggcctttaaaacgtatctcatcttcatttcaatacaataactcttgttctcattgtttttacccttaagtctcaaagaaggaactgcagccaaggccctggtgcataccccagccttttcttagatcccagttcaaactcttttgtgcagtgccctggactaaacacaaacctttcttattttccattgatttccattgacataagatagtacggaatgttccctcgtaaggttgttgactaatacatggagagtagatagaaagatgtctggcccataagttttatctaaatgttagctattataattagtctggtactgttttaatctctgcctcttgggctccagggctttggctgggtcttattcaaaagttgtttcggccaggtgcagtggctcatgcctgtaatcccagcactttgggaggccgaggcaggggaatcaccaggtcaggagatcgagaccaacttgactaacatggtgaaaccccatctgtactaaaaatacaaaaaattagctgggcgtggtggtgggttcctgtagtcccagctaatcaggaggctgaggcaggaaaatggcatgaacctgggaagtggagcttgcagtgagctgaaatcaggccactccagcctgggtgacagagcaagactctgtctcaaaaaataaaaataaataaaaaagttgtttctagctatccctgaaacttcagttcccctctctcccactttttttcccttttatttcctttctttcttggaatgtttagagttaactatattcctcatttcatggcacttaccataattggtctgctcaggcccctctttgtaaaaggcccttcttattaaaattaatttcccccttttatctcatagcccacttccattcacctctctgcatgatagggaaacattttaatgtgtttaatatgtagcactgtagttggatgtgttttcgcaaaaaaatcatattattatctttgtgcagtattttattcagtatggttttggtttcatctattgtatttgtcttttgcatgcatatgtatatagttttatttttgtttattttttagggctagtcaagtgaagcagtgggaatggaaaaggaacaaagaaatctgtaacttgttgtgatgaattagttgtaaacaccactgcacttggacccgtgtgtatttttcatctttagaagttccactgagtcttttttttttttaccttccatttctcttctcattatgtttttgtttttctataactccctttgggcattttgagcatatttataatatttaaaatagctctttgaggtccttgtctccttttttttttgaggtcagctttttaaaaaataatttcaacttctattttagattcgggggtacctgtgcaggtgtgttatgtgggtatattacatgatgctgaagtttggagtatggatgattcgtcactcagtgctaatttcattgtctctggcatttctgaatctggttctattgattaatttttctactggctatgggtcatatttttctgtttctttgcatgcttgcccattttttattgtgttatgctgttgataactggattttgttttattcctttaaaggactttgtgtggtacagcaataacaaattccttgcagattaatttgagcttttggaggtttgcttttttttttttttttttttgagacagagtctcgctcttgtcgcccaggctatagtgcagcagcacaatctcagctcactgcaacctccacctaccaggttcaagctattctcctgcctcagccttctgagtagctgggactacaggcacccaacaccacgcccggctaatttttgttcttttagtagaggcagggtttcgccatgttggccaggctggtctcaaactccttgaggtttgcttttaagctttgttatgatggctccagagcagtctttaccctaagcttaatttagccccactactaagtcatgcctcttctgaagactcttatcaaatgccctatgtattatgaggcgtctccactctattgctttatctggcctcctggaatttcatccccatgcttgcacagattaccactcagccaaagacttgaaagacccctctgcagatctctggaatactctctctgttcagctctctcccctccatacactccatcctgcaaatttgagccatcttagcttccctcaattgtgatctcatctcgttaacttgttaagactgctgagttctttctgggcttcccgagcctgtgttgtggcctggatgctgctctaggaagttcctcaattgcgatttgtctgttattgttctcatgatcatactagaagtatgtattttggggaggaagacaacaaaagtagtgcttcctgctcacataatatcaagggtgcctgctgtcaatacgacttatcactgttgatgttgaccttgatgcctggctgagatggttcagtctttgctagcatgaagtggcgggggacgaggctacaggctgtgtctgtacagtcagtttgtccaaatcaggatctaattaggaaccaaacattgcacctgattgcaatgtcctctgtgtctcctttaatatcaaagagatcctttaattcaatatgtgacttttttgaagacactgagacagttgtcctgcacaactctaccttttagacttgcccgagggcttcattgtattgttggtcttatgcctctgttctttgtattttgcaactggaagttagatataaaatattcatattaaacattttgactagaggtcttttaaagcagtcttctgattgtccatccccacacaagcagctgaaatttttgtcttttctctgttggtccaggagactgacttgtgtgaggatggagggagtagattgtagtgctcattgtgaaggggccttttttgccatttaagacccccccccccaacacacacacacagataacccttacaaatctgccacagagccacagagcaggtctcacagctccatggcaactgcccagtgccatcttctgcgctgccattttcatctaatacatgacccaggtcctacatgctgtgctttgctccttcaaggttgatatccttgtttccatttcctatttctctgtaaacagtgctcatttgtacttcttgagtaacaggttattgcacttcgatgacgagggttcagttcttaattgcccccacccccttatcaaaaaataattttggtagggccctgtcttagtgcaggctagaagaccggagattatcatggaaaacagatggtatacctttgcatacttaaggtactattaaggaaacaaataagatttcatttccttgccattacaggtgagagagaacagttcaaatatgattagtgatggcatatctgaaagaccaaagcaatatgatcatcttggttataagggacgattaaaggcatgggataaagagcaggaagtgatatatttatcatttggaagcttaatgcgttcagggagaaattaaaaggtgataaaagtcatcacatttatactcaattactttgactctaagagctggagttttggccacatttctcgataaaagctatgggagtgtggcagtaaagctaactgaatgcatttcaataaattgaactctaactttccactgaattttcttataaaattagggccacattccacattgcagcaaaaagagctttacagccagtcctgaaacatactagatattttattttattttattttagacaggatctcactctgtcacccaggctggagcacccaggctggagtgcagtggcgccattatggctcactgcagcctcaacctcctgagctcaagcgattctcctgcctcagcctcctgagtagctgggaccacaggcatgtgccactatacccggccaatttttttatttttttgtagaggtgaagtctcactatgttgcccaggctggtctcaaactcctgggctcaagcaatcctccctccttggcctctcaaagtgctgggattaccagcctgagccactgtgcctggccccatactcatcattttaatacaccattaggacatggtccactaccagtcaagtgaaattgtattcctcgaaggcaggaatgtctttcatttttgtatcctcttcatctaattgactacctggtctcaacacttatcactgaatgactactaaatggctgaatgaagaaatgtaattactaatgctgagaatgcagtgtgatataccttgataactctgtggtcccttcccaactctgagatctcgttcacctttgcccagttgtcactgcatcagtgcatgtagtgtatgcatgtccataagcacagatgccacacatgggtttctctttcacgagggactcagatcccacaaaatcatcagtgacaggtcacctaaatctcatgtcaaactgtgagtcatcaggactgatagtctgcagaaacaggttaaaggtgcctcactttaacaggaatataatgagcacctaccctgtgcccagccttgtactaggaatgtagaaatgcaagaaaagtcttatatgagctcaactctagggggatttgtaatttggcagacaaggtaagacagacacattaaattacagagagccgaatccagtgctgaaatgtgtgacacaggcgatcagggttatgtgagagcatgagaagggatgagtgcggtgtggagtcattggtgaaaacttcacagaggaaggtgcattgagactgaggtgtggctgggatgtccaatggagttacagtgttgtggcctgcagttaaaagcatgagaggctttgagatcagagagacatgggtttatgtcctgccctggtttttctcttcctgccctgtgaccttacctctctaaacttcaggtgtctcatctttaaagttgggataatcatatgggtatgaagaagactaaggtagataatccttgtgcagtgcttggcaccatgcctggtacctatgatgatgatgatgtccttgactagaaaggaagaccgagaaggctggaagacaataagttcagtaagggatgtgttcagtgacagcaaggtctctagacaggctcaagattcaaattcaagagtcctgggcacagaagtgggagagaaagccatagtcgggatgagctctttgtgggaggacagaaccagaaggacagagctctggagcaaggcccctggaaacatgtatgtgcatgacttctggtgaacagatctgagtgccttgaagctgatgccttggcttcaccccctatgtaagaaaccattcttgcccctctgtaacttcattctgttctactgtgacaatctgctccccatccaagtcctctcacaagccatgatgagcaaagggtgagactggatcagtgcaaatccatcaccactcaaagcttatgctctacggacagttgagcttggtacccaaagcatatcccacaaccatcaggatagtggtgagttgaactcagaaatcaccagaacaggcaaaagattcacaagacaccactcatccatccatccagcaaagatgcagcaagatgcaaaatgggccttgccctgtattgttaatggttgagtaatgataaagatgaataacacacaatccctgccctcaggaagacagactcataaacaattcattacaagcctcatactctggttaatggagaacttcaaagtgcttcaggaccagttacctgtgttagggtgggaaagtgcccatcgagtcatgtttagcaggagttgacaccactattgacacttcaggtggccactcatgaactcatccatctgggtgaagggcagggggaggcttgctccctgctctccctccctgccctcttctttggcacgttttcttgtcactgtgagtgtcatccaccctcctgactgtacttttagcataaatgcgcccctgcaatgctgctctcttgcctcactgctgtctcagggtccttcagtgacagcttttcaaacttcagcctcacctctgcagctgtcctgtgtcacctccacctacaacccacttgtcagctctacccaccacctgccctagttcttcagccctgttcaaacctgccacgcgagctcaaggctccctttgggcttctcccctcccttttctggtcgcatccagaggcctgtccccaccctggcctggagaggctctgtgtcaaagtgcagaataagaagagggtgagctaaaatctgtacacaattaaatgtttaaactaaaaattataaacttttaagaaatgacagtagtgtgtgtgaagaacccttagaaataaccatatttttgactcagtcactttaccccttagaatatgtcccaggggaggggggatattgatctacaaaggtatttatcacagtatttacaacagggggaaaattgaaaaccaactaaatgtttcaaaataatcaccactaaaatcttgctttcggcaaatattcgataaaataggaaaatgcttaggatgtaaaattaggtaaaaacactaagatgctgaactgtatgcatactaccaaaagctggactcagtattgattgcaagcttagcagtgaaaccaggattttagtggtagctctgcctcttactagctgtgtgaccttggtcaaggtagcaaactttcttagcctctgattctttgtcttcaaaatggagataataatagtagccatcagatagagttgtcttaaggatactatgtgtgaagcatttagcactatgcccagctggtagatactattattgtcattattagattgagtggactgtcattgctggacatgaagggacaggaatccccagagcatttcatggtcagattttcctgtacttaaaagagcacagaggccgggcgcggtggctcacgcctgtaatcccagcactttgggaggccaaggcaggcggatcacttgaggtcaggagttcgagaccagcctggccaacatggtaaaaccccgtctctactaaaaatacaaaaaaaaaaattagccgggtgtggtgttgtgtgcctgtaatcccagctactcagggggctgaggcaggagaattgcttgaacccgggaggaggaggaggctggagtgcgatttttttgacttcaaaaaaaataaaaagcacagaatggaaatacagcagaggataaagaaaggaagttggctggcaaacagaatgcatggcccccaggaataaagacaacactctaccttctttcaagaatttctctaccaggtagaaactctcacttttctaagctcttgttacatggttttctttcctcttggcttaatctatgatgcttttctagagaggcttccaagatcatatacccaggaaaagggggaatcaaagccacagaatattttgcttgagaatctgatggtctgaagcaataatcctaactacagaaaggaatggaattccagctttggcttgaagatggagatttagggccagaagagaaatgcagttgagtcaggcctctgagttttgccaaaggaaaggcttgccagtcccaccctcctggcgtaagcagagctcacagcttgctagactttactggctcaggcagtgcttgtctgagcagtcagcatccccacctttgcctagaatctctcccatgagctccagaagtggggaaggaagttggaaatatcactattccagtgttccagacagctccagcatgttcctgcagatggcaaatggaagatttccccaggtccaggccccaaagtccaggaatatacgggtccggaatctacagctcacaggtgatttttttgtgccctttttgcagtgatgaggtgtctggggatccctacccgtgtgatcaccaacttcgactctggccacgatacagatggaaacctgatcatagatgagtattatgacaacacaggcaggattttggggaataagaagaaggatactatctggtgagaaacaacctctcaacctatttctagggccacacatcagagccaagccccatggcaggaggaagggcagaacgaggtccatgagcctggtccctccccttcacctcctccacaccccctcaccctcccccacccaccccccaccaaggctgtccccacacctcttgccaatcttcagctgggagacatctgaacaaagcccatttggggtttagaagtctcatatcataagagtgttctgccctgggttgaggttttcatctttgtcacctccatcacagaacctcctggctctatggggcctggagaaaatttccccactgccctttgaaggtttgtttaaaaaaaaaaaatcaactcacaaaatcagatcaataggagaaaaggcatacacattaattaacgtatatacaggagccttcagaatgaagacccaaagatacaggggaaattgtccatttttatgcttagtctaacagagtatggacagccatgtagaaatctgcttggacaaatggtatgacctaatggtaatagactgagtggggaaacccagccctgtttgtctacattctgcttggcctctctgagcatgagttccttccttcccaatatggggcagaaccctctctagaatgagggttttttgacctacagtcaaacaaggtaggtcagataaattttttatggccagtttttatacaaaaaggcagaaggaaagctagggtaatatttttaggttttaagactgcctttggggaaaaggggttctggtttccatgaccttcccaccttggggaggcgagattttaatttctatgcctagccatgggggtaaatgagactgagagacaggaagacaggaaaaggtccaaaaaaacacttctgcttctgagaccttcattttggagtattgtttcctgagtcccaacagttctgaccacaggacggccttacctccgaatacaaagaccacgagtgcctctgtgagtcatcaacgcacacaaaggggccacaaagactgtttcatgagacagtgaaggatttttaacttcagtggactctggaagccttcactttctgttcacaagctgagtccgcagagggagactcttttctgggaggcaaagagaggtccacaagaggaagacctgtcactaattaattacttttttgagacaaggtctggctttgctgcccaggctggagcacagtggtatgatcaaggtcaagccttgatctcccaggctcaagtgatcctccacctcagcctcccaagtaggtgggactataggcatgtgccatgatgcctagttaatttttttttttttttgagacgagatcttccttttttgcccaggttaatcttgaactcctgagctcaagcaatcctctcacctcagactcccaaagtactaagattactggcatgagccatcgtgcctggctatccacagaggttttaagccctgtgtgtgctaagtctgtctttctatccaacagttcatttgctcatccctcccttgccttgttctagaaagaccaagcagtacaacgtctcccttggctctgtttgacacaggaacttccatgtctggaatgagtgctggatggcccggaaggatctgccccctgcatatggaggctggcaggtgctggacgccacacctcaggagatgagcaacggtgaggctctccagaagaaaggcaggccccgctcccgtggaaagcaccccacccctgcccagccctgcaacaaacagcccaccgaggctcccctgttctccttcaggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggtaagtaagcaagccagccctactcagagccccagccctgcaggaaccttcccctaccccagggagccagagagcatctgcgaggcaggacccagccccactgtctcctcagctgttcagttttgaggccccagttggggtggcctcacagcctcacttcttcatgacacccccaccccacatcctgcaggccagcgagctcccgccacaaggcgctgacatggaccgtggagcccaaacagaatatgaatacttcacccctgcttccccctaaaatcagcctcccactgaagatggcagggaatttagtaaacactctgccattcatttattttatttagggtattatttaattcactgtgtttcactgagtctttggaggacaggctgaagtgagcccagatgttcactcccaccactcctccctgtgggaacggcacggccagaggctgactctgaggtgacagccctggcagcagggtcacaggggaggctgtgttagtcagctatagatgaatgcctggacattgagaagcgccagccactaggttcaattaccagggagccaggcaaaaatatccagtccatgagggccagaggcagggtgagggccagagctgggatctggctggggaggatctgagcaggtgcaaggcagggtggctgaagggcggtggggagggctgagcagttgctgggagtgctggtgagtgggtgtctgtggttcgtctacgtgggcctcggggacagacgcagggaggctccagaattccccacctgggaaggggatttgcagtagggggcaagtgttgaacacagcccagcagtgccatcaccacccactccctggggcctccggcctcatcttggctgggctgccccagaaatggatcctgaggcaagcattcaaatacaggtggtttattttttaggctatcctggaaatcctggagcagagtgagggagacagggaagggaaggaagtggatgtaagagtacattttcaagcctgttagcacagtgacagctggctgggagctctggaagtggggttgtcagagaaaataaaggacaaataatgctttagcataaatttgtcccaggccaggagctgtaagctcacacctgcaatcccaacactttgggaggctgagacgggaggatcactttagcctcagaatttgaggctgcagtgaactatgatggcaacactgcactccagcctaggcaatagagtgagacctcatttctaaacaaaaaaaaaaaaggctgtcccaaattatttgttgtttatttgaaattcaaattaaattgccttgtatttttgtttgctaaatctggcaaccctatcactgattcggtgtgaagtgtagaacaatactgctgatttatcacaccagagagtcacaggggctagggtgtttatccatcaactcctgttggtcatgagttgagggctgttcctgggggatgtaaattctttagcacttctggcctgccccatgcatgagctgagtctgctctggtagcagagaaaacctcagacagagttgcaggggctgcaatttgaaaagtagggcctgtggacactgaaatggcaagtgccaagggaatatgggcagggctttgatggcatttgctagagaggcccacggggtcccctgtggactcagggggattggagccatacccgagtggacctgagtgtcctgcttaggtgctcctcaggccagcagtattcagtcttctcccacccagcctgacagggtctggggtcgcacagaccgcagatgcgctaaatcagattcccatcttcctgggcccactcttttttttttttttttttttgagacagagtcttgctctgtcacctaggctggagggcaacagcatgatctccgctcactgcaacctctgcttcctgggttcaagcaattctcctgtctcagcctcccaagtagctgggattataggtgcctgccaccatgcctggctaaattttttgtatttttagtagaaacagggtttcaccatgttggtcaggctggtctcgaactccagacctcaagtaatccaccctccttggcctcccaaagtggtgggattacaggtgtgagccactgccctcagcctgtgggcccactcttactgaagcaaatgtctccagattctcttttgtctggaactggccttagaatgaaccccagagcaaggggataaaagtggcctctgcctcaggaagttgtggcaaatgcattgaaggggtagagctggtccctggggatagtaagtactcaacaaaagcagcttctggaattatgaggcgtgggcaagtattcctgcacatgcggcccacagggacccccaggatagagcagggaagctggggccaccctgggaactctgcacgcctagacctcctctcatatgtatttacttatttactgtgcttctcctttcccttagtttccaggaattagtctatgcctgaccaataatctggctctggaacaggacatcacaccatgccctgctgtctttatgaggtttatttctctgcatttgtgggccttcatctttcccttgaggagatcaggatagagttgagcggtcacaggcacgggttttagagttgggcaggtttgcttcccacctgggatctgctccttactagttgtgtgacttgggcaggtgacatgacttccattagcctccttttctttatctgtgtatggaagaagaagaagaagaagaatgctaatggtaatacaccttgcttgtggttgatacaggaggaagggtgtgaagtggccagcagagcctgcctgggaaagcacatgaggagtggagggagtgcttgttactgggagtgaaggcctgaagttgttggtggagatattgggtgggggatggcgctcagcctcagtctaccccggtcagcctggctcacagctggtgctgtgctctccccaacttcaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaaggtacgcatgtgcacagtttgtgtacgcagagttggttttggcaatgtcagtggggtcaagccagccaacagggttctgggggcagacccctgagacaccatcatttctactgtcccctctggcacgattcccctccttccctcttctccttcccccttccttccttccttccttccctccctccctccttccctccctccctctcttccttccttcgttgtatctcctctctccctcctttctcttcctcctcctttcctaccacaacaaaagtagctggttttgcagaaaaagcctgagatttggagtctctgagaccttcgttggagcctcagctctcccatttcctagcagaatggccttgggcagccattttggctcttttcagctcatttcctcatctaaaaagctgccacctgcttccctgggatttggtacttgttgactttctcttctctgtggaagagagacccaggtccaacccaggtacggctgattttctcagctactctcaccccatccttgtgttctttctttagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgtaggcaggagtcctgcaaatggcttgtggggctccttggatctggcggggagggggtgaagccctgtgagagggcagcctgggcctgcttaggagagcatcccctccttcctttgcctcttctggtgctccaggagggagaagtttgtctgagagatcttcatcctcttgcaccactcactagaggccctatggatgggtccttgagcaggtgccatggacaataggagagacccccctcttgtgcccctcctgctgttggccttccccatgggtcaacataaggaaagtgagcacagatgggagggtctctggtcgggggagagccctgtctgaaagtcagttcagacttgatttgccattttttggctgtgtatccttggacagggccttgggcctctgtttcttgaactgttagagaggggattaggctagatggcctctgaggaccccgcctgctctgacattctgcggtcttccaagtgggaagattttaaggtctcccttccttcccgtgctgtctccccaaagtcaaccagcctcctagaccctgttaagtaagcccatggagccccttccggtggggaaacatgaaggtttggctagaacttgggcttttgtggcatcttagcaaagaagcaatatgtttttagagaagtgacaagagaaaaggaaaggaccttgagtctcaaggggtggcaaattttgggaaggcaaatacatgggaaactcatggtagataaaacttagaaagtttgttgtgtagattcctctggtgccctctccaggctcgtaaaggtctgaaggcatctctggtgatcagcctttgtccttcctggtagagaggggaggggggacacctttgtaaatttatgtcctgcttttaggcaaataaagggaaactagagagcttttcttatatctgcttcttctcaattgtcttcggctcaaagaattcttatgccaaagtggcatatttggaggtggcatatcctgccaccttacagaatggtgcccttcgtaaatatctggtgagttggggaatgagaactaattctccttcccctcctggtctgtttaggttctaggagcagccgttgtgaaccagccactctccatacaggtgatattttcaaaccccctctcggagcaggttgaggactgtgtgctgactgtggaaggaagtggcctcttcaagaaacagcagaaagtcttgtaagtgctgcaagtgctcagccttctcctgtttttcccccctgagattagcactatccttcctgaacatgggttcctgagccagactccacaacaccggggaagggaaagtggaagcactccctcccactcaggaagctgggtggaaaagggctccagggtcattatcatgcttttggttttctgacatgctccattctctgttgcagccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctcctttgcctcatgtagtcatcactttcctatctgttccttggatgctgcagtctccattcattcaaaaaagtatttattgagtgcctagcatatgccagaagtggttctgagtgtaggggtacaaagtaaacaaagcaaagtccctgccctcatggagcttacatttctagtggaggcaggggacatagacaatgaacacgtccacaaataagtgagatactcacaggtggtgtatcagccatgatccagctagaaaaaacaaaaactcacaggtgtttctacttactacctaccatctttgtgtcttggggggaaaaaaaagtctgggagacctttcacccttggccttcctttgaatcctttcccatatgacatctaagaggtccctcagtcctaacagtaccagcctattcactcaaaactcactgacgcactgtggtcctggatggccttgggttggctggggagataaagctggctgaataacacaatgaggtagactttgagtgggaaatggaatactctcagagttttctattagttgcagcctgtgtttatggtcatgcaaactccacgctttctgggtcctactgaacacaaaaaaattctgatcattatctcctcttgtggcactgcacaaagttctgcacaaagaaaggcatgatgcacttgctctctcagtactgactatatgactgagacagctgtcctatcaaatacacacacagtaaataaagaagatgaagacttccaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagacttccagtatgtataaaccaaaggtatgtgtagttaatcagtgggatagaagggcatgtggcaagaattagggaaagtagggaaatagtcctgtgagagagtgggctgagaaccaggagctactggcagggagctggaagtaacttaaaattatttcatcttataattattacctgacaatcatgagaaatagtttaaggaaaacaccagagagagaaacatcttatagacacaatgacctctgaagcacatggaagatttcaggaactgcaccctaggactctttaatgagtcctgattttaacaccacattcattaattctttgattcaacaaaaatttactgagtttctactaggggccaggccctgagccaggtagg

SEQ ID NO: 16443 - DNA, 32414 bp, Human
tctcaatcattggtagcttgaataaaaaactttatgaaagactaaatcaaaataatacctcaaatacataatatggagatttttatagttctcaatttaagattattatttctcttctgattatgtatttccagtctaattgacatctgataacaaagagctttactctggcagctaaactttccaacttctaaaacccagggcacagcaagagccctcaggttcacacacacaatgtctgtcagctctggcagtgagctgctttggtggttttttttccctaggtccacaggttaactgactaatgtttctaaaggggccagagagcagctgtgggactccaagtcttgcatcctggtacacagcttgtccttacatagtttcatgactttaaggaaacttgttgatctcttaggccttgagaactcttacctataaaaatgagaaattgcatgaaagtctccaaggtgccatctagttctaaactcggtgataaatcaattcagtgaaaaatttcacaacaaatacttgaatatgacttgcatatcctaaagaacacatctccatttactatgttaagtagacttaagtggcttaaaaaacttcaaatcccataatgcatcatccctctatacctttattatataagaatataatcgaaggttttttaagatttaaaaaaaaaagaaagaaagaaaccctcatagcctttatttgtggaaagacctaaatgcctatacatgagttggaatttaaaatgaggtggggttagtttgactgagtctacacatataaaaacactgtgctgtatagaaaacaaaataatcagtaattgacattgtttaggtgatttctgacaagcagtttgactagaactcagatttggcctgttccactgcacatcaccaagcacatagcagataacataaatattagtcaaaactaagtttaggtctcattgatgaaactgatcaagcagcatttataacatgacttgtgaaagaccaataaaatcaggcagctgatcatttgttttttatcgatattataactaacaatttcatagagtaaattatatcaaacagttgatttagtttcccggagatctccttagtcacaggtacctacctatgatgacgggaaacagaataggaaataaataaaacagattgtaacttaactatcaggcagtcatccaggccttgcaagacacaattccttcaaaaaattgctcaccaggatgcaaaggcgtacgaatgatataataggctgggcgcggtggctcacgcctgtaatgccagcacttcgggaggccgagttgggcagatcaagaggtcaggagatcaaggccatcctggctaacacggtgaaaccccctctctactaaaaatacaaaaaattagccgggtgtggtggcaggcgcctgtagtcccagctacttgggaggctgaggcgggagaatggcgtgaacccgggaggcgcagcttgcagtgagccgagatcgcaccagtgcactccagcctgggtgacagagcgagactccgtctcaaaaaaaaaaaaaaaaaaaaaaaaaaaaaaaaaaaaaaaagaatgatataatggactttggggactcagtgggggtacccagggggaagggtgggatgggatgagggataaaagacctaccatattgggtccagttacattgctcgggtgatgggtaaaccaaaatctcagaaatcacaactaaagaacttatccatgtaacgaaaaaccacctgatccccaaaaactgttgaaataaagttgctcaccagaagttatgcatttatccatacatactggagaagctcagtaaactcatgtctatgattatataagaatcactgagtaagagaatagaaagaagcagtgcaatccatgcagtcaccttctagattcagtaaataaaccacctgtattcgaataagaatgatttgatttttcttttgttcttttatctttttttttttccttgtaggagacccggtgagcctccattgataaaaggttggcttccttatcttggagtggtcctgaacttacgaaaagaccccttaaggttcatgaaaacacttcaaaagcaacatggtgacactttcacagttcttcttggtggtaagaagcacttctattaataccttatatatgtcatcatttttcacttgttctttaatgtctttctgtttttctctaggcaaaatgtagaatatttgtatatttttattttattttgtagagctaatgtgaaagaaaactattatttttagttcagtgatcctcacattaaaaatcaaattatagaactctcttcatggtacttagggaacccttctttccagccatcacctgtcattttggtttggtttagtttggttttaagaatggtagaaaaaaaaatatatatatataactatacaaaagctagaatgtattttttaaattaatgctctttatttgtagaggagttttaggtttacagaaaatttagtagttcagagagttcccatataccccctccccccaatcacagtttccctgattgtatctatgtagtatatttgttacaactgatgaaccaatattgatcaatcattaaaaatccatgatttacattacagtgtactctttgtattgtgtagttcgttgggttttcacaaatgtataatgacatgtatccaccatcacagtatcatatggagtagctgtactcttctaaaaatttcctgtgctccacctattcattcttcttcccctgcctctgagtctccagcaaccactggtcaagaatgtatttttcattttaaaactttcattgcacttcagactttaataaagtaccaaaacaccaagaaaaatgaagaaaaaaacagcagaattgctacacaccccaaacattctaggactgggaggagaagctagactgttactagttcacaacattttttaagacccaaactatgtagctgtatcagctattgattgctgagtaacaaatccccaaaaagtttaatggtttaaaataacaactggtctggcctgagtcacttgtgtggcttttctggactctggatgggaactggatgatccgagatggtctcatcacatacctgggtgggctgcctttccacacggtctttcatcctcaagaaaagtttcttacatggcagttagtgtctcaagggagtgagagaaaaagcttcaaggtctcttgaggcctaggctcagatattgcaaaaccttacttccaccacatcctattagttagaccaagtcacagtgcagtccagaatcaagggcagggaaagagactccacctcttcctggaaggagtagcagagtcacattgcatgggggcacatgtagagagatggaaggaatacatcatagctatctttgtatacaatcttcaacatcagtttatggcctgggctagctattccctctctttgcttttgcatgtcctgtctgtgctctgtaagctgatctctacacactagattacccacactcctttgcttgttgagtgttgccagtggcaggaaaagaagaggctgagtctcactccccactctcactggggctctggtaacacagttcactctccttccttcacaaggtaactgaagatccagtataatctcccttagatccccatgtatctaccaaatgtacctacttttctcaatgatttaccatgttttctccaatttcaaagaatgttcaagacactccatctccctgtccccatgaccctttcttcttgccgcctctggactggtacatctagattcattcctctcacacatgcatcttcatttttttctttcttgggctcttaccatcacttataaccatgcttaaggttcccctctagttactttccacttttcttcttttcttttgcattcagctctttcaagagagttgcatatatttgctatctctagttgcatatctcccagagccctcctaactataaccagacttcagccttgctgaagttattccctggtccacctacctagacctctctacctggtttgacaatgctgatctcttgttccttcctgaaatactctgctactcctttactctctatactcccccttctagttctttatctaaatcatctacatgcatgcctttttcttagctcaacccttacatcttccttcaaccagccttggaagtttatgttctattcttagagagccagtaatttttttctgcctgtaactactttgctgagggtcagaggcaacctttggaaactacagtgacttaatttcaatgctttattatgcaaataatgcattttatgcagtattatgcaaataatgcattttatgcagtattatgcaaataatgcattttatgcattattattcaaataatgtattttaatgcagtatttgggagaaatgatccaactggaggaaattatcagcatgattgagttctcccatggacagacagtatcagtttcatcacaacttactcctttgcctggaagctggccagtctgaggcgggtggatcacgaggtaggaattcgagaccatcctggccagcatggtgaaacctcatctctactaaaaaaaaaaaaaatacaaaaattagctgggcatggtggcatgtgcctgtagtcccagctacttgggaggctgaggccagagaatcgcttgaacccgggaggtggaggttgcagtgagccgagatcgtaccactgcactccagcctgttgacagaacgagactccatctaaaaaaaaaaaaaaaaaaaaattgtatgcattctgatttcagaaaaattgaaatggaaaaaaatcatgcatcttagaggaattatattatatacagtagtcctcatgaggctccccaagatcaggtctccaccagcctttccagctcagtctcttgctgctgctcgccttgtgcttcacacaccatgaatgcaccatgttgtttgaaatttcctcctcacacgccatacctggtggggcctctgggttttctttatcttgctgttctttctgccagaatgttattgtttacctgactgacatggactcaacttttgaggccagagtcacacattgcttcctctcaagagcctttgctgactcctcctatatttggtgcctcttctccagggtcgagttactcccagtatcacttctgtaggagcatttaatacattgtgaagttattaccaactgacttatctgtctcccttcattattctgttagcttctctattgtcaacatttagtctagagctcagaactgattctcaacgaatattggatggggaagcccctaatttcttagagctgatgaaacactggaatactgtacagataaaagcctgagctggtgcttctcctctaagtgagccttgggctttatggtaccaaaactatattgttcacttaaaaagagtcattcttactttaaataattaacactggtgtttctaatgaatagatagaacaagtgattgaaatgttcagtttttctttttttaataccaatgtacaaaaataacctaagatgattatgcagaaagttgtggcagatttgaatcactttattcacttttcaaaaaaatagccaatttctgctgatgcttgatttcttaatcttaggtaccaagaagcttgctgaatttctaacatctgaataatttgaccatggttatgtttgaactcaacagtagacaaccagttaaatgtgcacgatacctcccttttgcttcttactagaatttgaataaattcctgtcaagaaatcctgttaatgtatatggttctagtgatcagtttgcaaagtagctcatttagaaaatgtgaaatgaagaacaaagtcttccgctcttgtctcataatgtgatttcactgagtatatgttcttgcatgatgagcaaatgattgtcatccccaaaagtctcaagggacacggatgtcatcttaataaagaaattaaaaagtacatcttttcatgagaaaccatgtaaattcttgacctgtcgcagaaaatagttctctaattggttttgtgtggtggtgcagtggaatcgttttccctagatgtcaccccagcaaagcaccactgtacatcattgtcagcagctagtgaaatcttcctaataagcggggggatatgtacatgtggccatcctcataaagtacaaagttgactcatatttcactcttccaaccgatattttcagcttgagattaaaaacttctattgtaaaacaacctaaacacagagatgaaaagcttctaattatgaaaattgttaaaattcaaatttgtctcttctttttttagagataggttctccttttgtcacccaggctggagtgcagtagcataatcataattcactgcaaccttaaattcctgagttcaagtgatcatcccaccttggcttcctgagtagctgggaccacaggtgtgtgccaccacacctggctaattttttttaaggttttttgcagaggtggggtctccctatgttgcccaggttggtcttgaactcctggcctcaaatgatcctctggccttggttatattttttttacaggacatttctatgccaagcagccaattctcatggatatatgtatatatatctatatctttgtatagcaccaaatatataaaatgaaaacaccaaaattcaatttataatgacccagatgtcaaaactttttgtttgacattagggtgaatgactgaatttttaaaatacatttaccaacatactttgaattatgtagctttaccttcctaaagaattaattttaacggaagtggaaaggctactgaggtggtaaagtctcttatgcagcttatacaggaatgctacagttaatattgtaaggccagttagctcctaaaaagggaagagaatgaaatgattggcaaggaagatatcaaaaatttggagctgacttcaaatttactgcatctaagaatgatttatattgtatttttcttgcagatatcagccccactttgacatttatattttagacaaatgcagactttgaaattctttaaatcaatatttcatatcaactgctgacagcattctcttctctttggaaaacatggcaaagggtattgtttttaccttgtgatctttgtaaactaggtaacatgcctgctgacactggccattcatttacataaaatcaccctggagcaaaagttaatgttgctgcaagaatacacggccttcagaataccttttcagaagatttcctttgttaagaaatttaaattcattttatgaatgtatatgagttttcctaactgtctgattaaagatcacaaagaaactctggttttgcatctcacattagcagatggtggacagatggtttaaattaatattaattttggaaaacttagcttaaattgtttatactgaagattaaaagttggaaagccagctaacatctccagggttattagtacttccaaacccacatgaaaagtaaaatccggaaaatcaaaacatcttcttctgaaccaattcacatctcaataaaaaagatagtaggtaaaacacaatgccttgatattgaaggacactgaaataagaatgagaaagagaaaatacagatcctagactgaaaagagccttgaaaggagtgagattagatctacaaacaaatgaagttaacagtactgatttttataaagaactgatatacaaacaactgcttatatttttaaaaacaatttattagtaattggttgctaacttgaaccattttgtccacattcaacttttattccttttatttgaaattaacctcattgttttttcccatacccttattcccaagaggatggggataggagagaggaggaaatagagagacagagggagagagggagagagagagagagaaagagagagagagagagagagagagagaaaatgaatgtgtgtatttgtaatgattgtagacaaaacaaaaattgtaacatgtgtacagcctctacttcagtaggcccaataacaggtagctcatgctgtcatgtctgaatatattttctgtttccatttagatttagatgaatatagaaaattgtaggaaaaaattcaaaatattctctaaatattgtgtgttttactaactgaatcttttatacactctggtaatattagggaataatttaaaataaccccaaagatatttagcaaaatccttttatttagtgaaaggagaaaagtatgaatcaccacctgtgaaaatacacaactttgcctaaaattatatcttttgcaaaataagaaaattgatttttttcaattatttgacaggcagatgctggcaattttatttaattaagctgtgatggtaaagcaggtgtcataaaatatgcctaaattgggttgaatcctttttgctctccccagagcacatacacacacacaaatttagtttaccttgtagaagacagctttgggatctgaccagaatgaatagccacttctagctttactggcatcctagatccactcacattattgaattaatcaaggggaaaatgagtgaataaaatttaagtcatctgagtcatttttagaaaataaatcatagcacatgtatattcatgtatattaaaaacttgtgtttcaaaattgtgaaacaaaaacatatttatctgtttctaggatgaggttgaaaattatttcaaaactttatttgaaatatcttgcaccaaattgaattaaatttctatgatgccgtttgagttaccataaataacaagtgagaagttgttccgctaacagagcaacacacacacacacagacacacagacacaaacaggaataatgacatgaagacaataaataagtagatgttaacgtttttaggatcatctaaagtttatgcctgttctgtacaggaaagacattaaatgtcattatttattactatctgcttaatatttctaattagaaggaatcttaaaacagcactctagtgagaagacaaagaatagtgcatggtgagtaacttctcatcaagggtctaccactgaaaatggcagcatgatcttgacccgtaacatctcttgactttcttcagctttatcaactgataaatgcagatggtaaacaagcaattctccaaggtctctgccaattttgagagacagactatagtagactgtgtccttcaaggtgcatccttataagaatcacttgaggacctcatcgaaaaggacactggtaggaccccctccaagccttctgaatcaaaatcttgcaggaatctgtatttttcgcaagcatcccaagtttttaaattgataagtttgggcaacactgatatgttgaaaaggtaaatgtcatcacctcaaagagaccttggtgataactccaggctgactgaagcagactctactttctgctttccttatgctgtgtttcacccctgccgtatcacaatccatagggatgcaatgatttctatacataattgtatctcaaaaagaaagggatccaaccaagtttccagatcttaataaatgtggtgaatggtgaatgacttcctgaaggaatggatgaatggatgtgttctagtttggaatcctgtgtcagtcacaagtcaatatgtgaccttgaacatgttattaaatctcccacatccataaaagtgaaaatgctggcattagtggatttttgccagtgttgaattagacatttatttgtgagtacctgctccatacagtatggtcatttatttgagttaaaattgttgtatttgaacaaaactcagatgacacctaagcatgaaaaagctctttatgaagtataaatactcagaaatggaatggcatgttgccaatttgttttctgctttattgagggaaatatatgagaagtatttaagtcaggggattatgagaatatttaaaggatatttaaagtgttcaggtactttagttaaaataaaaattggaagagtaaaccatctttgcaaaggttagtaagaacttcaggatatttaacttcacgtttctagagtgttttccaccatctttcaaaggaaacatgtagtgtaccttcgaatgaaatggatttgtattaaactttttgccttagttattagggtctttctaattttgattaacatattttttaatttgtggtgtttatttctgttttattaacaaacgaactcatattttctctctctttttttttttctaggaaagtacataacatttatcctggaccccttccagtaccagctagtgataaaaaatcataaacaattaagctttcgagtattttctaataaattattagagaaagcatttagcatcagtcagttgcaaaaaaatcatgacatgaatgatgagcttcacctctgctatcaatttttgcaaggcaaatctttggacatactcttggaaagcatgatgcagaatctaaaacaagtttttgaaccccagctgttaaaaaccacaagttgggacacggcagaactgtatccattctgcagctcaataatatttgagatcacatttacaactatatatggaaaagttattgtttgtgacaacaacaaatttattagtgagctaagagatgattttttaaaatttgatgacaagtttgcatatttagtatccaacatacccattgagcttctaggaaatgtcaagtctattagagagaaaattataaaatgcttctcatcagaaaagttagccaagatgcaaggatggtcagaagtttttcaaagcaggcaagatgtcctggagaaatattatgtgcacgaggaccttgaaataggaggtaagaacttctgaatgagcacttgcctaaaataaaatcatttacaatagacctctgaaataaaaagacaaaatggcgaccttgaaaattttttatgctctttctaattggctaatgataaaatgttttactctgatataaccctctataattgatattttttttttttttgctgaggtggtaaaacaagatacttaatggtgataatgagaaagagtataactaagctgcatttactcctcttatctcatcccccaccacaccgccccccccatacacattacattttaaactattctcattaagcagaaaattagacttcagaagcctattggttctcattagcatgcactgatccttggctgggtctgtgtcctaacatcttttaattagcacactgcaaatctaatcagtgtaataaacgctattaatcttccttttcacttattttctcccagcacatcatttaggctttctctgggcctctgtggcaaacactattccaactatgttctgggcaatgtattatcttctgcggcacccagaagctatggcagcagtgcgtgacgaaattgaccgtttgctgcagtcaacaggtcaaaagaaagggtctggatttcccatccacctcaccagagaacaattggacagcctaatctgcctaggtaatttatttttatctgttatgaagaaaagaaggtacctctctgcaaactcggtttatcactcatagctgtttaccaagaggtagaggacacagctgcctaattgacataataacacccatttacatcaattataaattatgtagtttatagccgtagatactctcattgcatgtaaacattaaggcctaggtaattaactgtgcaaggtatgcaaaaggctaaaccaaagctttacaattatttgaaaaaaagtttatgcctattaaatcatttgattctgagcatctgttgatgtgctaatgctttccaacactgctgcaccatcttgtcaagaagtatttagggattgaaaaggaaagtattgcaaaaaaggcaccctgtgtgcaaattgtatttcttccctaaaatgatgtctatattttcaaacacaggttagacgttttatggagtgtgtgattctcaaaaacacagaaaacagttttccattggaagttcgtgatttaaacccacaaaaaaggaaaagagggaaaaaatagaaaagaagaaacggaggagggacagagggaaggaaggaagagagaaagggagaaaaagaaaaggaaaagcaacaactacaaactattcctgtgaaacattgatattttataaaatactcaccgactcatgagatatacatggtcactatttcaagtatgtttgaggttggtagtgactaaggtttttttctatttctacataggtctgtacctcaatgactggagcttttaatcgcagcagatttcgtttaattagcacgctgcaaattaaagatttcgttcccctttactactttgagaaggctgttcactaccattccctgactgaacttctactgccaaagttaaattccataccaatgagttattctctattctctctgtattgacatttcatcctgcggtatcctttagggtacaatattccaagtttctttagacaaacgcaggaacaaatgttcacatatttctgtttctttattcctttgacaatgtaggcgagcattttagcctatgttggtctcaattttttatcttttaaatatgttccaggttctttaatgggacctttcaggagcaaaagtcctcccaggtttggtcaatgttcaccctcagtggccattgaggaaaatgccccaagtgttctagagattgttctcacttctcaggctaaggcccattgagacaatgccagaaagcatgccttatactagcagtcaatttggaagtttgtagtttgtgtctttagcataggttatcaaataaattttatattttcttttaaaaaaatctcaacattactaaaatacaaatattcttttatttttctttgcagaattattggggaacaaattcagaaaatttgtgtaaaattttgggtagttgctccacttggatacacagtattttctggcatatttgtaatttctatgaagatctaggttgcatttcccatacattcaagcagtttccattgcattttatgaataagatgacgcatactgggaagtaaggcaaatacactaaaaggaatatgtgtttgtattctgtatagttattactcttaaaaaatgtagttgtaattcatccactctttttactttcaactttttgctattaaaaaatcatttttaaatttcagtattaaagcagaaacatttaaatttattagaccagaaaaaatggcagattctagaactataatttgaatccatttaagcccatagctagagctagagattttcactgttggatccctcataaattgacaagtctcctatcattgacaaatgaataaaaacaataaaaatcccaagcaagtttagatccacctggataaaggcagtaccttcagcagcctggatggttcatcacgaccttggttaccagcagaggccagtgttgttcattacgagaatttaaaatgatggggctgtttgtgatctagaaaatagtgtgtatttttttctttcaaaagatagaaggttttatgcagatcagagcaaacttatatgtgaattagttacacaacaaataacctctgcacatagtcatagctcagttgtatttctctatatcaagagagcatgaagtatatgtacaaaagcaagacttacacagttaaatatttaccatgtgccacgtggtatgtgtgtatgtgcttatccttcttgtcttcttaaggaaagagttctatgtattttaaatgcaatgtcttaaaaaaaagtttaaacttttatccttataagaggaaaaaagattacaatgataaaatgattgctgtactttttaccaggaaggaggatttgggcactattacagtaaagagaaaagaggttcttctttttacagaaattttgcatgtcagcacactttgattataaagcagggtgagaagaaacgttagactgccaaagtctgtttaagtaatttaaagcaatcatctgctgtaagaggttatgatagatttgtccttttttcaatgcttttgagaatctctctttaaaactattctactcttattttaggcaaagaaaacacaactatatattttatatatttacgtatcttgttaagattctgcttatgacctcagtaaaacattttatctattaataattagttaagatctctataattacatttaactgaaaatttaaaataagtagatataaggtttcagtaactgttacttggggcttaaatctcaataggaaaaaaattgctgatagaatggaagtttgagaaactctgagagaaaagtaagaatttttcagttatctcagaaaaaaatctggggtggaggtaggatttagaactgcgggtttagatataggaaaaagaaaagtataaaagataattcagaaagacaaagataagaaaaaaagataatgcaagcagtaaaagctctcaaaattggaattttgatagatcaattgcaaataagcttgatgaataccacttcttaatggtttatttgaataatggataaataacttagtataatggtacacggtataggctcaataaatgttatctgttgttatcaccaaaatgacatttaacctctgcaatgtccctatgtagtttatattgttttcttcatttgcaattatttatgaacatcatgctcaagtctaccttacctcacaggagcgctctttcgatgactcaccagtgaaaagagcaaacatactctggaaagtcaaggtaaatcagaactgccacatggctcaggtgaattgtagacacctaatgttgttgagtgacgtatcctcaaattgagaaaagttgcaaacatggtccaggtgagggatgttaaagtaaagggagatgccttaaaactggaactgggcaaaatctgtaatacttttttaaaaagagaatattaaaaattataactctagaagtatgagcttgcagtgagtccacatcgaaatttgatgaaagattttgaagccgattgtgagtagttggtgtgggaggagaatacagaaaggaaaaaattaaggtcctttaataacaaataataatgataattagatgcaatccatgttaaatatattaacgatttcaatatttcaaagcaatcttatagacattgtttcatgtcatcagcaccaggatactctggaggacagtgacagctattattttgtcactttcacagatgagaaaattctcagggtgctaaataccccgtctaagatcatggaggtgattaagaagaaaggcaggtctttaactcaggttttctgaccacgcccatgcttttcccctcaggcctgtctgataccagagcccttgagatcttttttcattatcccagctgagagcggagaggaattctttgtatctcagttctacaaagccaggcatgatgtgcatgtggacaagatcaggcaacatgggccagaggatcatacagttggctgaatttttagcttcaggataagatattatgaatgataatattaataattattatttgaatatgtgcctgccactgtgttaagtgttttatgtatattaggttatttgtcaagtattatttttattcaattattgaataatgaggttcagaaatgttgctaaactaatgcaagtcatacagctagatagtggcagaaccagaagttgatgccagatctaactttaatgcctacccataatgactgtcgcctcagacaaaaatgctctagaaatggactggagaccttgaccagtattttttataagatatatattactgattctcaaatgcagttgggtttaagggtaaggatagaactagaggttcacattagaatcttgtgggtatttttttaataaaaatgaactttttattttagaatagttttagatttatagaaaagttacaaagataatagagagcattcctatatatcccccacacagtttcccttatgaacgttttacattagtgtgatatgtttgtaaagattatgggtgttattttgaaaaagctcgttcaaatattataaaataattgtgtattcaaaagcttaaaagattacataattcagacagtagtgaagttttgcaacatcctctcttctaatgaggatttacagaagacataactttatttaggaacttctaactggaggaagtgggtgaagcatcttccacaaagaagtacatcagaaactcagggatgtaaatagtgaaaattttatatctaatataaggaaacagcagttaaaaagtgaaaaatactgatttcgatgttcatcggattttcaactcagcacaaagctaaggtggttagataatataaggaatgctggaaacagaatctgaaaggattgaaaagcaactttaattaaaatgcaaattattgtatttagatctaaatatcaactttgtaagaataggatgagaaacatgtgactcagcagaaaagggtttgaagcaatggttcttagctttgattgctcattggaaccacctgggaggctttaaacactttgcataccttgccccacccttagagattctgattgcattggtctggggtgcagactgatggctttaaaaaaagctccctaggtgattctaatgtgcagccaagattcaaagcctctaactgaaaggttttagttaatgcagtggttctgattccattagactggaatggggcatttatttttttaagcaatcccaggtgattctaatggccatccagggttgctgataatctctggcatatcagaaaatttaaaacaatagtgatattatttcaaaaatctgttgctcatctgctcccaggaaatagtaatagaagcatggtgtctagggacataaattaataattctgtacttttccaactaaaatagtacacacctagttgtgccaagtcttaagaggcacattgactaattgaattcatccagcatggcaaaggctaaacaccatatcatctctgatacacaattagaaaatggcatgatagttgtctttacatactttgaaagggttgttatgtggaagaatgattagacttttttggcctgtgtgttttataaagggtggaaattaaaaggaggaaaatttcacctcagtatgaaaaatggctttctactaaaatgggctttctgaatgctatcattggagttatccaattagaaaatgtgtagtatcaaattgccacaggagtagattttaagttttctcaccacaaataactgatcagtatgtgaggtaattgcatatgttaattattggacttaaccattccagaatgtgtgcgtatttccaaacaacaagttgtacaccataaatatatccaatttttatttgtcaattaaataaataaaagcaactgtgcaatatcttcagtaggatcttgggagcattcctgtttatatgtattttccaactttgaacttcctagattgcattgtccatgaaggccaagtccatgtgctgtgttcctttttcacaccagcagcagtggcccagtgctccaagcagagtagggccttaacaaacatttatggaatatatgaacgccgaatttacatgtctgtattttagcagtgaaccaaagactgtgtctgagatgcagagtgaagataggcatttgtaccaattcagatttatttttaactttacttaagatgtacaattgttgagccaaagattaattattttgcctcaaattatatgattatcacaatttcttatttaccttctcaactgccttgaagacacttatgtagaaatgcacatacacatgcacacatcatgagcttcactccattccatgacaccttccagagcacaccacctccatacccaacccctctcccccttttataaccaccaccacctccatacccaacccctctcccccttttataaccaccttctctttaagatcacccagtgttcagccccagtgactgcagcaggttctggctgttcatttcactctatccattgctgctatcctctgatcaccatggctaatcaaatggcatgccagcctgcaccaatcattaagatgacccaaattaacagcctggccatgtcacagtacattcattccacatatacagacagggcctaagtgtgaggcagaaacccagatatgcttatttgtttttgtgttgtaacatgcattattgattgtcataagctgctttagtgctgtaaatctgcaaatgagaatcatccatcctttattacagccagaattgagaactgagagcaaaagagaatatgtgcatgccttttttaaccataattttttatttgttatttttcttcacaattgtgttgtaaaagattttagctcaagacattccctggcatttcacttagaagggatacttaatcaaaataattttgtatcctgaaaagagaaagaagtcttccctagccaggtgaagaatgtagtgcatgctctgaattgtgagatcatagagggaattttggaatccaatttcctagcatatactggtcagtaaagctcagttcttaacaactcacaggcagccttatcttaatcacagttgcagttgttggcagcttgcagtgcctggtgtaaattttatctcaaaatatttgcattcttgatggtcatttttcgacaatgcattctaataattagagtcctattacctgctaaatgttagtataaattaacaatccattatacacaataagttttataaaacatttacagatagagatcatctttaattaaaattaacttccatatgaaagccaagtgcattaatgactcacaatgaccttttattacctgcagtcccctgttttggctggatgattgacagcttgctgtttggctaccatgttgaatttcagctgacaagacttttcattttaactcaatttgcccgcctatcacaagctggtggcaggccagacccaagtcacccagctttgcctcagcagcttgctctagttctcattagtacgcatttattcagtggaaattggaagacaaatgcttgaaggcatgtgaactaagtatagcaaattaggtttaaagactgaatatttataagtatatggaaagtttttttttttttttttaattctagaacgaattgagaactgagtgctagctttggtataaaagaaattaagatagaagggggaagattctaagaataacaatactataagctttttctttccactttggaaacatgtaaaatctctctgacaacaccttatcaaataaaaacctggcttctctttcatggagtgcttgcacaaagaagtttagcacctcatgtgtgagaagggggaaaaaatgagggtcatgttcatttgttgcttggttatcccttggtatgttttaaattgccttgtttgttcggcactagcacagaaacagatgttgctctaccgtgcaggataatttactgtacctcctggtgcagcatggaagtcctcccagggcccagctggtctgtcagtggcactggctggtgtctgctcaactatgacaactacaagtagaggctgcaatttttttattgtgcagttgtcattcttctcaacgtatagctctgcctgcattcgtactggggctggtggaaaagctgctcgcttttgtgtctggatgttattctgcagagccacgtaagctctactctccattgttgataataacgcaactcattacttttgtcgtctattgattatcggcatgatggctcagagcgagagccaacctcatctcgcacacataactggtactggaaggtaaaacagatttgtcacttactatctgaccgctaagccacactttgcgctccattattgtgattaacttctacataagatatgcttgcccaattgtcatttgtgatactgcggtgggcgcaagctgccatgcttcccgagagcacatcagccaatcagatttgaccatgttattcggactgttatatgcctgccctgtcacagcagccatcccacaattattttgcttttgtgtttcttcttcccacacccctactggacttgttgagtgaatagcattgctacatatgtcagctaccatttcacaccacaagctaaaaggatgctgtgctattgttgctccaacagagccggcagcagtacatgggaggccgagccttgcttttcaccacagaaatgttggtccttggtgttctgccagctgaaatccatcgtgtcaggtgcctcgtggctatctgcagtagagcccatgttccaaaaccaaagttcttttctggcctcatcaccaacaaaccgatttgactctgcctgattataataacgaaggcagtccaagagaatatgcactgcctcactgtacgtcacattgaatcaccacactggccacacaaagctgaccgcagcctcatttctttagacaaatgcatgcttaaggaaaaacctcctgggagaaagcacccaaagctacttgatagccttatgcaggctgtgcatagatttaaattttactgaaataacatttatttttatttttggctgatgcaagccctcacggatgggcctgcctttaataatctaataattgggtactctgtgtttcagagctttgctgaacactgagaaacggggctctgtgtgtgtgtgtctgtgtgatttctaaattgcaagtcataaacacgaccatttgttatcatgtgaagggggagaaaactccatttggggcttttttttcatattgctgattagagagaatcaagctttatattctaggacccattcacgctggtggaaacatagtcagttttgattatgaagggagagatgcagacctagacaggagctacacgctgatatgcatgctatcagaatgatttatgcaaattatgcatattattcccaaaggaattcctcctcaaactgccaggataaattgccggaaattagccataaaatctgtcgtgctaggagtaaaaggtgaaggccactgggaaaggaaggacattaggcttctggaatcttccaggatatgatggtgcctgttattttccctggatgctgagaaaaatgtggttttcttctgaatcctctaaaaatattttccttttgaaaattttccagcaaatgttgactcacattttatttacagctagcataaaagaaattaagtgttaagctgtctcagaaagcactactacaattactttactattaactgcctaagtggttattaaatggctaagtctggctttaaagcatcagagttctaaaggtttgtggaatgactcaccagctgtgtattttaactgggatatggttttaatttcaagcatatatacccataacacaacattcctctctagcagatcaccctctcctacaaaatcttaatgactttctgcccaggtacaacactgctgccttctacctgtgaaatgcccccaagccttgctggagccagaccaccgcccctgctcacatcctgtgcacagccacccttggctccctcttggtgctcaatgtatgtgatgaagaaacagtttccttttcaatcaaggctattagtaatgagttttattgcaaactgagagcagttttcaggaccagccctatcttaataagctatcgtttgtttttttccttcagaaagcagcatttttgaagctttacgactgtcctcatattcaaccaccattcgttttgttgaggaggatttgactctcagttcagagaccggggactactgtgtgcgaaagggagacttggtagccatctttcctccagtcctacatggtgaccctgaaatctttgaagctccagaggtaagtaaacatcaagcctatgattgctacttcttagatcctgtgggcacattcctcttccatccctatctcttcctcttgccactttggtccagaaggggtttgaggcagcttgatggcttctattattcctcctaataagaaagctttcctctttactgaagtgttccctaaggatatctttgaaaggttccatgatctataaagagaaatacagtgatgagactaaatgctagttgcttcaaatgaagtggacattgcgccttggccactattacgttttggccaaaattacattttgcttggtggagaattattgaaaaccatggagggctagctattgacaggtggcttagagaataaatgatgataactattttgctaagtgtttccaaagtgaggttgactgttccaaagtcaaatagtatcattgctgtagttaagcccatatacttttccacctcttatgaaaggtatgtgccccttcttgatcaattagtatggcattatgaacttgagattgtaaagctgctgctcacgggtgaagctctgagggtaattgtgtcatctccctgtgtttttttctgaagctggagttaatgaatatcaaagactggaaattaatccaccctggttcatcccttaataccgcttcagagattcaccacctgcatgcaaattgaatgcagtcctattctgcctgtgtttcttaggaagtaatgttgctgcagtagtttttgtgtgtaaaatgccttttttcaaagggaaactttgctgctcttttttagcagttcatagctggaccacctctaaatctaattgctaagatagatgttttgcatccaggctggattacgatattgttgaattttgaaaattaacaagaagagagcagattcaaatacaattagaaaatttgcatttatttcagcagcaaaggtgaatgacttaagtgtggggggagtgtacatatagtttctgtgtgtttcaaaaggagggacattgtatgaatgacaataacaaataggttgtagagtattagcaagtgaaggaacattctgcaaacaacaggctttatctccacatttgtaagtatcaaagaacaaaattatattcaataaacagggcaaatgaatagccaatagccaatatctggaaaatatttttaatttttatttttacctacaattctgcatttatttaatttcaacttactattttcattatgtgattattccactagtcattaagtttactattcatatcatgatggtaaaatcaacattagtgttatcaagaaacaataaatgtttaccagattaccactgtctttatatcactgtgctttggactcctatttcttaccctcatgatgaaaaataccttgatttagacttaggaacttaaaactcaaagttaaaaatcaaaaatatgctaatttatatttttttcttttggaatactcaatagcaatgcccaaactttacataataaatcaaatagtaatcagaagggcttgccttatacaaaatctgtggcagaacaaaattgcaatattgtgaatactgatttagcatcattagggtagctttaacttgagttgatgaacactctctattatttactagatttaacattagccaattatgcctgactaatgttaaaattaactaatttattgtcacgccattgtttccttgaaattagttggagaatgctgataatacctggcacagaaaaaaaatgatatagctcagaaccagttttatagaatttgggaaggttttatcattcattgtataaacattttctgagtgactaccactctcagacatatcagttattcctttgattcttaacaacttcatatggcaataagtagatgctatagatgctcttaaaagagatgtccatcccaagccaccatatattgacagtaaagaaaaggagattgttctagaaaagtctaccgtgagccatttgttgctgagaacatggttcaggagctcatcagagacacattcattactacctgccttttgtatccaacataccttgaatgagaagatcaagcctcagatgttgataacaggcaataggtgttaggccaaaaatataaggaaggcagctacagggatagttattcttggaagacagagagacaagagcctcagcagaacatagattctcccagcccaacaaggcagggtttcagaatttccaacctccaaaagactctaaaatttggcatttcaaagacaggccatggtcttccaacatacttgagagctgttggatctgcatctccctattcctggaatgcccctccttatttgtgcacccagcaggcaccaaactactccacaggaatcacctaatcacctctttgttgacagtgtgcctgatttccacctcattcctcagagaatttgccattgctcacactgtggcctgtgtttaactttgtaggggggcataacacacagtattttgcaattatttatttacttgtccttgctcccatatgctgtaagctccagaagaggaaggactatgtcattcccatctctgtattctcagtgcctagcacacaggaagctgtacactacacataagttgaataaataaggggatgcttggatagataaatgtactgagagtgaaaatatgcttcagttataattttaaatcaggacagatattgcacattaacatatgtactgggcctaaatagatcaaataaagaagtgatttgtgtataaatatagcaatactattagaagtgttaagaactatggcaaaaggagatgctaggagacatctaaataggaccactggctacttctgaactagccctcagctcttgcaagcatttagacctagtttggtgaagtcattttgattttttatttaaaaaataacctgaaaaaataggcttttgagtgaaggtttgaatttttaaatatttggaaaaatgaaatttaaaacacaatatcttacaataataaataaaaggtgtttgggaacttaattgagcctataagctaccaacatgcaacctctatattaagaattattatttccctgaatattggttgcttaacttattgtaatgttagccattcaggtggctcagtagtaaatagtgatgatttcttttctgccacaatgcaagatacagaaccggagctatagagaagctccatagagaagatcaaatctaaatctgttcgttggctttcctaggtccagaggtactgagggataaagggagacctggtgacattgtggggtttatagggaaaaaacgtcagacatttaagatggcaatgcattatataaccatgtaggtaaagaaacaatggtgaaataacaatgtaattccaaagcctttggaatatcccccaaaagctctgaagatggaagatcttgtttgtttaatctaatgcaattctgccctatctacttcttatagttgttgagataataaaatgattaataaatttgaaagcccttgaaaaaattctaaatcactaaaagaattgtggtaccaattattattttgattattgccactgttcttagaatgacatggcagataaagaagtactctcaataattttttatctgtattgcaaaatggaatagagattgtgccactagtagacttaaaggaaacaaacatatatcaattaattactatccagaaatcactttgatgggcatagtgagtgacaaagaaataaaaaggtcccttcccctacaaacttgcagtatagggactcagccctgtcacatagctgatttctcatagtgaggtgcttcctattgagaaaagttttctgccataccaacaaattgacacttcatacctaccatattggaactagcagtgtgctggtaaaccagggctctgagccctgatttgtagtgtttgtcaattttcgtagtataaactacccctttggccaatttcatgttactaatgtgaagaccctaaacacagagtcactaagagatgtgcacactctgacaagctggtcaaactgtctgcagcacactaccaatttgaacccaagtcatgaagataaaaagggacttctgtactctgccatcttgctaaggggcaacagtgtagccccttagccatgcattcaaaacactgactttttttattatgagaaagtcatatcttttgtctaatttatatttgtctaatttatattcccatacccaaaattatgaattgagtggattcaagacatgatcctattgtgtgtcacctacttcagcaagaccatgttttatgccttgtaacttcaatgctttacatacaggaagtgctccaaaaaaatctgttgaactgaactaaacatagtatttggagaacacaaattagggtgttatgcaatcttcctttgtcacgaataccaaaatcttttctctatccagaaaattgtgtcctctatccaaacttgatttctagtgcttcaatattatacaatttcctactatttgtaaacactgaatattcatcgactcatcatactctacatatttatttactcattcaatatctatgttttcttcaaaagcttgaaaatggtttttaaaatatacttttttctcatgtatttattcattaattcaacaaacatatatggaacctctactatgggaatagcattgtgttgaaggctttaaacatgcagagataaataagaaaatgtgatagctccaaactcctgggatttcttggcactgccatctcctgtaggttagctctgtctttagcctgatagcagttccagacatcatagtcacacatgatgaggtccagaggaggaaaggtaatcaaccatttctttttgttttattttcttcacagaaaggggacttctcctagatgtccccatagatttttcccttgtagcactcaccagattgtttcacaattctatcccaaaccagtcagagaccagaacaatgtaattaccaagattagtgcctagacaaattttattcagaagaacaatgttggggagtcaactgcaacaatcattagaggaacagtgaggaacttccgtgtcttataccttctcttgtgatttttctattctcatctatttaattggctctctttaattgtgaagcaacatgcttattatggtcactgtaaagaatttcaatcagcggccggacacagtggctcacacctgtaaccccagcactttgggaggccgaggccggcggatcacgaggtcaggagatcaagaccatcctggttaacgcggtgaaaccccatctctactaataatacaaaaaattagccgggcgtggtggtgggcgcctgtagtcccagctacttgggaggctgaggcaggagaatggcgtgaacccaggaggcagagcttgcagtgagccgagatcgcgccactgcactccaacctgggcgacagagcgagactccgtctccaaaaaaaaaagaaaagaaaaagaatttcaaccagtttgatgaattccaagtttaagtttttccaaatgaatggatacatcttgagcttcctgtacctttgttctgtgtcactgtgaccccagaatctcagtggtgagattattataccccttcctttttcagctaaaacaaaactgtacccctagcagctgacacaggcccttcttaacattggttcatgcttaggttttccatgcctaggcaatagggcaaattgcaaataaattttaactaaaaatatatttatgctcctgcaccctttgaacttggtgttggtcacagagctaaagacagtggccatttccattttagtttcataaaataaacaaccgaataggaatttctaagatgtttactatgagaaaattgaatagaacatcctggaaactagagggatggtgttgctcgttgagtagaaatttgagggaactgaatataaacactagctgaaggtcatgggtaaggagcactcctgcatcacgtgtttgccgtgggcctctcagaggttagcacattcattttcacaaagaggaaccagaaaaccatggtgatttctggcttatttatgatatcaagacactaaaaagtcataatccaagctaagttttcattttgcgtttgctggcttaactagtggggctacagtgagaggcttcctaataaatcataccatagcaaagctcacttagactgatttgggttaggtagatagaggaccagtctcctcagattggtcagcgtgaaggaggaagcagcaggactaagctcaggcaagcaggcttgagccccaggaatggaagaagttccccaggagagtgttacatttagtaactctatctccagtgaccctgtatgtcaacaaagggtgtccttgttctttcagcattgattaaataccgtttggatacatcccagaactatggtaaaatacgtgttttaaagggctcaaatattcactatcaggaattgagcagttataaaaatgcagataaattttgccattatcattgcatccacttgcaagttggaaggaaatgggaactactgagaatttttctaagctcaaatacttatcaaaataagtattctacataaatgaggacaaacctaatacttttaaaggaaatggttcactgtcattaacaacactggctttgagtgagaaaagtaaatcatttgtgatgaattcagaatctatccacatattgcaaggttttcaccttaacctgaaatgctttggatctgacctacttttttgcattcgtcttcatgtaggtcatatcaaagttgtgtgtgagcaggtctaatgttaatgagcaccaactacaggaaatacttggtcgtttccatgcaagccacggacattaatttaatcaatggcttaattcaccataggctaaaataaggtcactcagtcccctctaagaaattcaagtgagagttgaaccataaccctttggcagcaaggcaaaattaagatggcaggcccaacactctaggtaaagcagtcccatgatttcctgtaacaaactaatataactcatttatgaaaacatttcagaaacacctgccaccctagagtaaactcagagagctgattttaatagaactttcatagaagaaattaactacaacatcaaaaaacaaacaagattaattttggggcttagttcctctctagtgctttatctgaatcttacgattttatatttgtttaatccaaacatcagcaccggatcctaaactcatagttctcatctatcagtagctggtggggaagggataagagaaactcgaattaggaatccacagttaggcagctcctgtggctagttaggattcatcagacccgggtaacaatggcagtctcaccagagcccttgccttctacctaacattggtataatcaagtgcccatatgtcaggacccaccttagggagcaaaaatagtgatgttgccactctacttgggaagctcagcttaggagaaaaatacaagtggagaaaaaaagtcatacagcttttcagatttcactttgatatgggagaagtaatttcctagtaatatttgagttttttgaaagttcatgcttaatttgcactcagccaagtttttctggtgttcacctgattaaaaggagctttttaagacaggcagagagagctagcaactttgtggacttgaactcaaactatttcatataaaatgttaattttaacactattcttccttacaggagtttagatatgatcgttttatagaagatggtaagaagaaaaccacctttttcaaaagagggaaaaagctgaagtgttacctaatgccgtttggaactggaaccagcaaatgtccaggccgattttttgcacttatggaaataaaacaattgttggttatacttttaacttattttgatttagaaataattgatgataagcccataggactaaactacagccgcttgttgtttggtattcagtatccagattctgatgttttatttagatacaaagtgaaatcttagagaagctaaaaggaaagaaaataaatctatcaaaattaccctaaacatcctaagctcatctatttctttttaatttctgcaaatgtaattgatttatttgtttaaaaagcgctaatttctatttgatctgatatcagtccagtttgtccttagtcacaaagcccatcataatataaaacaggatggtggcaggaaaatggacatcaaaatcaacttaagggtaggctcaaaacagggttgttgttgtttttttagtttctccttgttgtgattttcacctgttataataaatgtaccttcacaccaatagattgggcactgtggaatttaaatcactcaaattgttctctaatatgtaaaattacactttgaactactagaaaattgtgctggaaatggacacagtctaacaaattccaaattctcacagaagaaggaaattgaatttccatgagttacactggatgaaaatgttcccttcaagtataatattaataatacctatatttccagggtatgtgtgcattaaatgagtttcacagtagattgaatgcttcaacttcacttcaatatttaatcatgcataaatgttccttattactttgtatactatggctcaatagaacaaaatttctggttacataagacctttcatgttcaagttagatactgataagatttaatgtataagaaaacacagaacctattatatattcagaaattgccctagacattagtattaggtttattatgggagcaaatgttgaaataattacagcattgattatatcatttggctttagtataaactatacaggttatgcaaatattgcaattaaccctttcctaaatgctttcatatatataaactgagaagctagatatagtatttggttttgatgtctcaccttttggatttggagttcatgtgttctattttgaattacaacatcatgtaatgcagtgtaatttcatatgacacatgcagcattgtgtcaataattcaaagattttttttcaattgagagagtatctggctgtgttgcccaggctggtctcaaatcctgacctcaagtgatcctcccgctttggtcccttgggaacctggactacaggcatgtaccaccaagcccagtgattcaaagattctaatatcagagtaccacatgattggcatctgatataaatgatgatgcaatatataagcaggcaaggcaggtaataaagtccagttaattcatgcttcgttaattggaacttctaatatttcagaaatttgctactgttttgagaaaaggaaactgactttaaaaataacattacaaaatatttacattcttagtaagtaaataagacagtctagcatttattttatccttcctgaagtacatgttctgaatgttccttcagtgaaggtctgctggtgcaaattctatttttgcttgatttagggtgtctttatttttactctccttcttgaaagatggttttgctggatgcacaaatctagattgacagttatttcctcacagcactttgaagatattgcccgttcttaaggtatccattgttgttattgggcggatagccgttagtgagtttaattactcaataggtagtctgtctcttctctctgactactttaacgtgtcctctttgtctttgatgttcttagtttctttctgtttctcatgcttgcatgtcctgctgcttcttgaatctgagcacaggtgtctcccatcaagtatggaatcttctcagccattctctctgtgaatattactgttctcacactctacattagatcctctcactctacatacatcctttgatcttttctcaccacactttgtatctctaacttacactccacgtaatttctttagatgtctcttccagtttcttctttgaacagtatatctaatctctccaactcatccactgagtttgttttttccttctttttgttttaactctaggttcatcgagttgagtgatcactctccttacactctttagttcatgatacacaattataattggttctaataaggtccctctggctttatttacttattctgttttgtccctaatacccactttcataccccttcctaatatcataggcaaatattctaatgtgtttgatgcatatcttggtatgtatatgttttcatgtaacatatattatcttgagtacctattttctgtaagttatattcttcctaattttcttatgaagctctgtgattttaaagatatattcatatttctgtagtatatacatagtatactactatatttaatctattgcttctaactgctgcacagcaatccataatgtgcacacattatgttttaatgatctagttacccagtgatggacactgtcagcaggacagttattgtgggacagaggccaaagcagaacttaaaagcttttccatcacctatcctcacactactgtgcctaaccatctcagcccagggctgctaaatgccttgtc

SEQ ID NO: 16444 - DNA, 27752 bp, Human
gtcattttactacatccttgacttattatcaaaggcttacatttttgtcaatttacagaaacctgcttccaaagatggaggaagctgggagaccaaagaggctgaccaatcgaatttctcagaaagaaatacttagtagagacaaacagaagcgacccctgcacttgccctccagaaagtatgctttatttagcaagcctctagggtaaagacaagtgcaactagttagctcttagactattgtgatcactggggacgttagataagcatctttatgaggggttatatatgttatgagcattgtttaaagacctttgctgcagaacacctcggtatgctgtgggtcaaacatcagtccccaggatagttttgcttcaagatggtgtcactcttgccaggaaacaggctgtttttctacacagtctaatggatgtgacatattatcttgcatttttctgatgactacagaaagtttggtttgcttttcacattctttttccatttttctattgtgtcatttttcttattatttcttcgcatattttagaaatactttatattttataactatattttccaagtttgtgctttaactttaattttcttatatagtcaatttttaattaacatttttatttttaatgttttatgaaactcttccaacagcctaagttaggaagatatatttatatattttcttatcaaagtataatattttgctttcgtatttacatatgcacttcacctcgagtttatttttgtgtgtaacgccgggtaaaaaatttttcctatgtggatagtcaattattctggcaccacaagttcatatttacaaggctacttgtctatttaatcatgctcaaaaccagctcggccctttcatgtctttcatcacatcctttgttgcttacctctcaccacacccttctacagaagcgttattttcttgttaaaccagactattcactgcatttactcttcttgcaacatgctaaaattgttcctgttgtctctacgagtcacgctttctgccttttttccttactgaatttaaacctcttgtgaaaaagactgtccaatttacgttttcacccttaatactgagcattgatgtagcaggttttcaaatattcttgttttatgctgaatttcagttggcccttatagatggaaactttcactgagtacaagctatatatccatgtatttaggaacaatcaacagttttaacgaataggaaccagtcatcttttctgccccggtggataggcttagtggtggtcggtggatggcgctgaccgcggttgatcagaggaagctgacgccgtttgcaggcgtggcctgggcgtgcccgcttcaaagtagacgcccggagttggcccagttctgaccctagtgatgcgcctgtgcatgtgttcctatcgccgtcccgtcttcacttcctacagatgccgcgaccccccaaatagcaagtgtggacattcacattcaggggcacaggctgtccgtacagcgaacgttgtcaccattcccggagatagggccccgaccttcaagggggcggtgcggttggcgcgcagttctcaggcgccttctagaatcccctgccagcctccccgctgcctggttaccaaactcggccggggacacccaacctcccctctcgaggacctgggttggccagcccagctttgtacgggtgactgaagtccacatcgacgtaacagttgaaagggaaggacgcggagaccacccggtacccgccccaggcgtttccagagtctccgcttaggcggcccgtgggggtcggggtcgcggtcgcggtcgcggaccggggacagagcaatggggcgggcgcgcagcgccggctgcactcccagagcctcccaccgccgccccacggccgcctagcgcgcgccgggactgcatttcccataggcccacgctgcggagcaccgcccacccgagtctcacgcgagtgcgctgccgcgaggtgtccctgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggtaaggaggctgtgcggggccgcagcagacggggaggagctgggtgttggcgctgggcgcctcccgccgccgcgctccagctggcgcgtcccgccgggaaaaacccccagatgtgcttcgcttttggtgcaaggaggaacccgggctgggcaccatttaggtcgtactgaaatgtacctggttgaggtacctcgttcattcctttagactcatatgactcttaaaggtgggagggaggagggtgcaccatgaagaatcctgcggattttctttttttgtacacagctaggaatttctactaaaataaaacatttccttttcgcacatagttgggaagttttactcatttacatctacaaattctgtacatgcattgcattcatcaaaatgtattgatggcgtatttaaaataccagtgcattgtaatagaaaatcaagaaattaaggtataacttggattttgtcatgttcagtagcagaggacaacagtggctgatatcctaatgtgagttctatttggtgttaaaatgcagcccacaatttttcgtttccaacatatttgtgttttaaagaggtagtaaaatcagtctgtgttaccaaaacacacatttgagacaggcccaaggaaagctacctaggagaaatcatcctggggttaaaatttgcccaaagaaatttgtgtgtggacattaagattagttttattttggctgtaggattatgcctttcatactatttttttctatgaatattatcactgtattctgtaactaaacagaaagtagatgaatgttttttcatataggtagtgcccagttttcaaatgggttgcttactaatatttggaacttatttcatagctgtttaacatggtgatttgattctccacgaattaactcaagctgtaattaatgtaacaggttgcatattgtgtgtccagagaagagaaaaaaaagcagaggggattcttcccctttcctagaatcaggggtagccctgcgtcaaatatttaaaaaagggactttgcttttggtcactgagatcagcacaacatcgttaactgagtaccgactatgtacacaatcttgctctgggaagtgcaaaggattgaaagatgacaagccacaaaagttgtgagatggccttaaattattggtggaattttggtcatattttgagggacagggagaacagcttgagctcttttcccagggatgggaaaagtgaatatgcgtgggcccaggggaaggggagatgttggtggaactcactctgatgtacttctctttctggtacccttgtgctctcatgatgccccatgtctcctttgtggtacctcaccccatgtaccctgtaccactccatttcctatgacactcctagttcttcgttccctagccaaactttgttattccttagtgaagatgatcttacctaccagtaaggagaaaaagttttactgaacaaattttggcgtttgacatgttaatctgaatacctgatgaatgccaattgtaagaagctgggaatacaaaagtgagtaatacagacaacagctcttcctatcaggtggcctacagagacactgaaagtgttccaaatgctgaagtgctgaataggagtaggcacaggtactcacccgacagacgtgttttgatgtatactggttgctatactctgctggggctgggtttcactggtaaaaggaggccagagagatgggtggggcagagcatacgggtcttacagagtttattaaagtttagggacccactgaggtagttaaacaaagtggtgacacctgcttgctgatctatcgctacctgatgtcctttcctattgctttctgctttcactcacctggctctaataatatggattccttgcaacgtgacaggcacaaatctgactcctggcctttgcacttgctattcctttgtcctggattgctcttttcccagatatatgaatgtggtttactctgtcacctctctgaagtcctggctcaaatgtcatgttttaccttctcagggaggacttgcctggccaccgtgttgaagagactgtcctttcctacatagatgggctctccttccccaccgtctttctctccttagtgcttacgaccagccatcactctatatattatgcctttttgtcttgtttattgtttgtcctctttcccctccctgctacaccctcgaattaatgcacacagggcaggggcttttgtttggttcactcatagtcatgtgtccccagcagctagtttgttgcctggcatgaggtatgattcaacagtatatattgaatgactgtaggaataggaatggtgatatgatccgatttgcttctacatggggagctgcttggagcttgggggggtttcttaagaaaagatataacaagaccttctaagagtctattatgatagtgtggtggggagagggtagatattgatagcttgggctaaggtaatgttggagaggtgtggatggaagatgttttcactcctttgcttcgttgtcagggaatcagtgtgtctgtgagtatgtgtgggaaaggagtgacagccttgtaaatttaaggatctatattctttagatggattctaggtctacagttgtgtgaaggctgcaagtgctattgtaagccttctttgggggcttatttggcctccctaatgaggtgagagatagatctacttgaaagtaagatcagcctcccctgctgctttcccataggctatgggtggacttggaggagagacttcctatttaattctgtggattgaaataataaaatatgatatttttgctgtgatatatttcagtttctgagcaagaagaaaaggaatttgcttgaaactaaacttttttttgttattaggaatattaatgcaaaaatgccgtaataaagtcatgaaaaactatggaagatactatattgctgcgtcctatgtaaagtacttggagtctgcaggtgcgagagttgtaccagtaaggtatgattcagtgttttttttttttttttactctgtataaaaaattgctgcgtacgggtgcggtgcctcatgcctgtaattctagcactttgggaggccaaggcgggtggactactgaggtcaggagttcgagaccagccaggccaacctggtgaagccctgtctctactaaaaatacaaaaattagctgggtgcagtagtgcactcctgtaatcccagctactggggaggctgaggcaggagaatcgcttgaaccagggaggtggaggttgcagtgagttgagatcgcaccactgcactccagtttgggcaacagatcgagactccatctcaaaataataattactgcctaatatctctaaaattcgtgctttctctcttatgattacattgtttaaatgcagtaacattgcacctgatttttgacacaaacatgttgcttagagtctctcattgaattgtttaatgtgggaagctgtgtgttacctgtaacgtcattagaggtaccatatgtcatatgcattaacatcaagaatgaaatgatagtttcctttatcccagaaaaggtggttctcacagacactatgaaggtaatggagtaaaataatctaaagtggttgggggggcggggtgagggataaaaaattacatattgggtacagtgtacattgctcgggtggctggttcattgaaatctcagacttcatcactatacagttcatgcatgtaaccaaaaaccatttttaccccaaaggctattgaaataagaaaaaaattttaatgaatctacaatttaaccagctttgttctataatattaggataagagaacagttagggaatgaaggaggtttttagaagatgacttttaaaataccttcacactctactttaaaagtttgtaaattaccagtgcattagggttgcttcagtgtggattataggtattgcagttttaaaggcactgcattatttttgtgataaaatgttcctataagaataaaatgattcatctcattttcatttagaactgaattcttcccatatttttcatctggaaggagctaacaaccagaatcttataaggatttgtaatgtcttgtcagctaaaattaatgtattttagaatctttgagcacctcatctaatccattttgagtgatttcacacataaaacactatttattctgtacagcctgtttttgcaaacaattcctcatcaaaaattataacaaaaatactgttcaaatataatactactaataaaatgcaaatattacaatttagagaattgtaccacaaaatggctttaggtttagatttataagaattgtcttcttgtatgatcttttacatttaaattaactgtttctacaccaagattgccatttgcttttgatattagtctttaatattttagtagcctatctaatttttcaaacgaaattttatttgaagcccatataacgccagagttttagagctgaggaagaggctccagagagtcttcagaacagtgtttcaaagttttcatcagggaaactttttaatgcaagctgttcttctgggatgttagtgctgaccgtgtggatgggagatatatataaaaatatatatatatttttatatatattatatatatatataaggagagacatatatatatatatataaggagagacaaaaggcagagcagccataaaaaagaatgaaatcatatcctttgctgcaatgtgaatgcagctggaggcccaagtgaattaatgcagaaacagaaaaccaaataccacatattctcacttataagtgggagctaaacattgggtacacatggacccaaagatggcagcaatagatgctggcggctactagaggaggagggcaataagggctgaaaaactacctattggatactgtgctcactacctgggtgacaggatcatttgtaccccaaacctcagcatcacacaatatacccatgtagcaaatctgcacatgtaccctctgaatctaaaataaaagttaaaattataaaaaataaatgaagtaaaatcataactgaaagaggagacattacaactaatgctacagaaataaaaaggttcataaaagactacttaaactatatgccaacaacatgtgtaacctagaagaaatgaataaattgttagaaacacacagtctaccaagactgaatcataaagaaataggtaacaaacctgtcactggtggagagattgaaatggtaatcaagagcctctcaacacagaaaagcccaagaccagctggcttcactggtgaattctaccaaacatctaaagcagaattgataccagtccttctcaaactcatccaaaaaattgaagacagtacaattccaagaatgaaccccagtgtaaactaggtcttgggcaattatgatgtgtcagtgtatttttatcaactgttacagtgtaccacccaagatgttaatggaggaagctatacatgttttggggcaggggttataaaggaaatacttaaccttctcttaattttgctgtgaacctgaaattactctaaaaaataaagtctttaaaaaaataaaacaaaatgcctaaaggcaggtagaccagtttagaggtagttgcagtagtctaggtgtgaagtgttgagggcttggcttacactggtggtgtgggaatgataggtaagtgttgtttaaaaaaatcaccagtacatgatgactaataaaagggcacagggaggaagaaatatataaggatgatggaagttttgaaatcatgggagttttgaaagtggatgactttgcagaatattggtatttatgagagatgctgagaacacgactgtcagcatacaggtttatttccaaattgggttctcagagttcacttaaggtatattggaatcatgtgatcttgtagaaacagtgtaatacatatggggtgagttcatagactagcctgcgaaggattacctgatgcaaaataagactggatcatgatgatgttaggttcatttctgaattttggatgctgggagtcaacttctgtggtttagaagtgaaaaggaagagatgggagacctgggaagcattctgaaatagatgcagaaatttgtctttggtttccttctgccttctttctgccccttctgtctcaggcgcttggtgctctcaggttgtcataaatgcccaatgtgggactagtggaaaagagaatgtcctgcttcctcagaggtagcatacaggagcccatggactgctgcttttggtttaaaaacgtgttttgttcacacagcgttttaaaacatgaatcaggctgggcgcggtggctcacgtctattatcccagcactttgggaggctgaggtgggaagatcgcttaagttcatgagtttgagaccagcttgggcaacatggaaaaacccctatctataaaaaatttttaaaaaatgagccgggagtggtggcgtgcacctatgggcccagctactcaggaggctgaggtgggaggatcacttgagcccaggaggtggaggttacagtgagctgagatggcgctactgcactccagcctgggtgacagagccagacctttctcaaaaaaaccccaaagaccacaaatcaaactttataagagtctgaatttttgtttcttttgaagacagttatctagattgagttttaaatggggcaaacactccccattggcaacaatgccttaccatccttttcatgctgctaaagctgtgtgtcatttgccatcatcaccaggcttaagccatttcgttacagttaaggagagagtaaactgttcctcataccttgttgaaagggacttttgtttcaaaaaatgtctgacaacatgcaactaacagctgtattctctgccagggcccctaggcaccagagttgtgacatggcacactccttcccctgtgacaattaggtctcttaatagagataaatggggaccaaaactatagtcatggacagtgtgggagccatttatttagaattaatgaaatgactgaaactagcttgcaccgctagctggcaggaatccttggagtgcagctgtgtgatctaaatccattttggtccctgatggcgatggttgcccattttggtttaaatatccatggggagaattctgggtcctgactggctggttcctttttgttgccacaatctggggagattagactggcagaatactgggtacatgtatattgatatttcacctccctatcacttcccaaggcagggctacctgtcagtattttctccacttaagaatggtaagcaccattctggtatcacccattgctttgtggctctcgccaggaagagattactatgaacttgtgagagacctggacttgcaaagcttgtttggacttagagtagatcccagagttgtttgctggcaaaacacagcctgtgttctggatatcacaggtgtctagttaataatgggtgtgagggactttacctccccctaaaacttctttgagggcagaaatggactagttgacatctaatcataagtctacttcttttagggcaggttgagaggacaggtaccatttattctgtcacagaaacagaaggctgctaaatgtgggagagttcttgcaaggatttcactaacttggtgctctcttcccttattgttgcattttattgaactttcgggagagcagatatctgtgacttagtaaatgttgtcaccatatgtcacagattaagcccatcttttttttctggagaaagggaataaagtcaccaataacatggcgattgttaggaggcccttaaggggtgtttgatcaagggtctttcagagtaattacctgggcagttaggctgttctacagtcatctctctgtggtcctcagttcagactagatgtgaaccatcctgactttgaaatgcagagtagtccctagactgttgcaactagtttgttggggtgggatcaggcagcgacttggcatttatttatgcattttttaatctgccagagcttcctgtagttaaataggcatgataaataaagttatttaaaggagtctttacataaaactactgaatattcttacatttctttttgtagttcttggttagtagagaaattactggtggccaaatctcacggtctttactgtttttgcatactaacacatacttcacaatattaaattgcattagatcacagaaaaacatatttacttgtctgattagcaaaacaaggatagaatgatgtggctttcaagtggtttgcaaaaatgcctctagaaaagtagagaggtaatattgtctagtaattaaaaatttgtttttatttggctttttaaaagtaaatgtggagacttcatttagaggtttacttctaagtttcacaaatgtaacaataacttttattgttttcaggctggatcttacagagaaagactatgaaatacttttcaaatctattaatgggtaagttggcagcattggtttcatacggtatatgagtggtctacatatgtctgcttttgtaaaagaaatcatataaatattatacatgtttctatgtaactgtcttagagtggtatagtattagtgttctgagttcttttataggatttattttcttgggagatgcaaaagtccttcaaaagaggaagaggcaggttaggaaatgtataattgttacatagtagacacacataatttttttaaatgtgtgacttaatctttgttcttttaatgcttgtcttaaatgttttgaagctaccttgaatggcgtggcatactgcttgcatatggggtttataagtccaaagtctgaggatgttgattttttttttcaggtaaattgggaaaaaatattcaccattactcttaattttaggaaagaaggctaattacagcaatcaaaaacatttaattaccatgttggcagagatcagaaaatttgcttatactctatggggcctgtgaggaaacaagtgtgctcatactttattagagggaatgtaaatcaggtagtcttttttggggtaatattgcaatacctattgaaattagaaacacgtataccctttgacctgggaacttgaggaggaattttattttataaatatattcccaccttgcatgaagacttagactcaaatctatgcattgtattagtagtattgtctgacagtcaccccgtaatccatcaggtgagaattggttaaataaaacagactatgtacattcaatagaatactatgcaggaattaaaaaatgcggctatctgtagatgctgacttagatcaccattgtcctatgaacaatgtgatagtgttatgtgaaaaaggcaaggcacgtgatggtgtgtatagcatacaccccgtttgctttttgttaaaggtgggggtgaagagatatgcatatttctaccaaatcaacacagcagattttaatggcagttgtttctgattgggaatagggtggaagtattttactgtaaaatgtttttttaaaagagctttattatttttacttctaaaaccatgttaatttattgtttcttttaaaaagctatgtttagaaaattatttgccttcagttcagtttggttcagtaaatatttaccataaaatcagttcaatttagtaaaacatttacaatgcccagtatgtgctgtgtgcaaggtactttggcatggacaaagatcattaagtctaggctagaatataatagtagaacctcaaaaatagaccttttgaaacacttcattttcttcccaccctctccccagttgcattcctgtttggagaggaatctgaatcaagtagcagtgtagacaggaatacatactttggggagctagcctgtccagatgctcagtatgtcttcatgcaaaccagcaaaaggagtccattttctatcttcctcactcgttttctgcattgccactaattgttgctcctgtaggccccttttctctctcatgtagtcactgaaagctgcactccaaagtgggttaaattaggggccttatttatatctctgagtgtcaccagaaaatgagccgtattctaatgtgacttcaaaagcacctttattgagtcactgttatgcagtggaccccatagtattttgcaggggaatgcagagatgaaaagacagagccatgctttaaggagtttgtcatataggagggacagtcaggttttgctgcatgaaaggagtttggggttagacataccgtatttggtcataggcagctttttaaatactaagttaatgtctgtaagctggagacctgggatgcaaaacataaaaattaaaaaaaaatactgagttaatggaaagagagaatgctaatgagtcttcactaagccacttttaattgttggattttctgcttggatttgtggtagatattctcccactcagatgcttatatgttttctaccagactgtgatcttcctaacagcaaaagccactcatgtttgtctctccaggcaagtcgagtctagctcatggaagaaacagaatatatttcttgaataacaacaatcacacaagtgatatttcacatatctcaagctcgtatttaaatattttcaaaattttaatatgattaataccatttttcttacctcttttgaatatccttggttctttcaagaccttgctataaattttaaatttaaagtttaattttaaaagttgatataaaaacatggtaaaatatttttctatatttcacctttataagtgtgtaaaataatatcaaatatttttgactgccttcttttcctaggctttttctagaatcgtaattatgtttcttgaaaaaaatgttctaatactgtgcgtatttctgaagagactcggggtgataagaattaaattcttgtagaaatttaattctagcttaaatatatttttatgaccagcttgttctttatagttaaattatttgtgagctaaaacctacccataattatggacctgcaattgatttggcatcacagatcaccttcatttaaacctggctatacctggaattttgtctgtctttgatgtctagctctgtgtactcttgcccctcccctacttatttacttttaattttcccacactctatttcattaaataaattttttgaagaagtttttggaaaatatgcactaaagtgttgttaactgctgtagtttctgaatgggattgtaaatattttatattttcttttttctttacttttctaattttcttcaaggatcttattgcatatgtaataagaaaaattgttttaaaataaaaagattgttttctgtgtgtgtatgggtcgggggtggcaaaatacaccctatttgatttatgtaacgttgtttcagaatccttttccctggaggaagtgttgacctcagacgctcagattatgctaaagtggccaaaatattttataacttgtccatacaggtaaatatcagttattgcttattattccagatgggtttctgtaagtttttgtgcgagtggttcattttttaagcagatggtaatgctcccttcaaaattacccttagcctcatcatacctttaattttgaggtgcctgttcttggctgctcccgcctattttccatgtgcttcatctaatcctgggcttccagagacccttcagagcactgctgactgcccctctcttgatgcttgttaatgtgaaccgtgtcctcatgtagtgtagacattctgatgtctctctctgtcctattttttttttatgggcattgtttctatgttattaattctcacctcttcttgaaatctgttcttcttcccaactcattcaatcctattggaactttcttcacagttaccatagactccatgtcaagcagagcttctgagcctctgacttctcctttgtaatgttcacagtgggactgcctttgtaccatagctcaaacctttgctgtttctctcctcaactattaacagtgatttttaaattaatcttgctggccctagaatcttaccaatcccccttacacatttccctaaataactgtttttagcctttgaaatacttgtttcaaacttttaatagctaaggtcagtaatctataggcttttatagtctttgggtcaagatatacagtgtgtccacagctcatgttttccagcctgtgtgggagcttggtctgaagagagattaagtgatagcctacttatggatcctggagaattcttcagaaatccatgtgtaactcaggtgcctatttggttatgacaaaagatatggctaatttttattttgaaaagtttgaataaacttagttttctctttttccacttgcaaagagttttgatgatggagactattttcctgtgtggggcacatgccttggatttgaagagctttcactgctgattagtggagagtgcttattaactgccacagatactgttgacgtggcaatgccgctgaacttcactggaggtaagagtactcttttcaaccctttgaaaaatatttgctgggcaggattagtaagtagcaaatatgaaagtaaaagtgcttatttttattttctttttagccttttccctgaaggaaaaaatgcttatgacattagcatttaaattatttacacaggttgaagatgtgaatgaccatccttgtactcatttatgaggatgacttaaggaattgtgaattttaataactcattgcttctagtgatatcaggactgtgtgtgatgaagaactctgaaatgggatctggttttgactcctagctttgtcacttttaccttgaggaaccattttacctctctgaggttcaatgtctgcatttgcaaaaaggtctaataacgcttaggggttttttttgtgaatattaaataagatttttttttttctttttaagacagagtctctctctgtcactcagtctggagcgcagtgacgcaatctcggctcactgcaacctctacctccagggttcaagggattctcctgcctcagccccctgagtagctgggactacaggcaccctaccacacctggctgaattttgtatttttagtagggacaaggtttcaccatattggccaggctggtctcaaactcctgacctcaggtgatccacccaccttggccttccaaagtgctgggattagatgatctaccgggaagcgctatatttactcagcaaccaggaactccagtgagttttggtgtctagagtttttactggaacgttattatgaaataattgattgaatctttgcctgtgtgattgaactcaatctccagcccctctttcatacttggagattgattgggctggctcgaagtttcaactttctaatcatgaagttagtttttctgatgattagtcttcatcctgaaataattgagggacccaccttgaattaccacattagcataacaaaaatacttatatcattccgggaattccaagggttttagaagcttcctgtcaggaacccaggacaaagaccagatagattcttaatgatatcactctgtataaatagataatgattattgtgggttacttgatctccgaatgcttagaattgaagccaccagctatttctgttctcatagggattttgcaaggaaggtagcagtcatacttaaaacttgtagaatgctttgtgcttttgaaagctctttcttccattgtctcacttaataattgcaaaaacctggtgggaagtacatgtattaggtcagagtactttggttgtgtgttgccagaactcagtttatacagaaaaggaatgtttcaaggtgctgtggttttcatggaagtctctagtaagaataaggggcctggtttgaaacagctggcactatcgccttgaaaacgtcagtttcttttttttcaaaatctgtttgttggtgtttgagtctgtgcagaaccttcagggttgaccactaagatatattgctttttgatctgtttactgagtcaaaatttcttggcttggttcatgttcttttctacattgtttgtatttttatttgtttgtcccagatacctctgaaaatatgttatatttgaaagttttggatactttcctgggcaaatacatacacccatggaaagttttaactgtttttcagaatagtctgtggaaatctagttaagattccctgcctgttctttagcttgccaatactcatatcggaagaattttacttattcatgttaaaattctagaagaagattacttatagctggagcatatttgagtttatgttaaacacattttgtgacttgattggaatacttctatggaaatgatgtgttttgcatatcatttggtcatcttgattatgtcttcataatggcttctctttgggtgcagtaagtgacttcagtggattttatttttttgtgtttaaattatttctcttgtacttaaattatttcaggtcaattgcacagcagaatgttccagaattttcctactgagttgttgctgtcattagcagtagaacctctgactgccaatttccataagtggagcctctccgtgaaggtatcacactaattacacaatgaaattaatatgtttagaataactgcagaagtaatcattttgttttattttcgtattctagaattttacaatgaatgaaaagttaaagaagtttttcaatgtcttaactacaaatacagatggcaagattgagtttatttcaacaatggaaggtatatcactataacatgtatactttatttcacttattttatatttttaaattttgattttatatgtctcatcaataaaatcatattactttggggcttgaagaggggtgttagggcattttgggagacaggagacatgttttgtccatgtttcaaattaattgcagttttcctgggtattttcctgaatggggtggtgaagaagaaaagtaaaagaataaagggggcaaggatgaagaaagaaatgaagaaaatgacttctgtttctagcaatattgcagattaaataccttgacagactttcctccagccaacaacaaaataaatgtgggtgatagagaaaaacatagtaaatacgttgatgaattggcaaagaaataaagatactcaggtccaaaattttaagagttgagtggaatatttaaaccagtgttattatggaatcaggagaacttgagacaaagtcaggactctctatacgaatagtatctcatggagcgggacctggatggctataccagcaatgtaagggtgaactcaaaatacacctaaaatcccccctacagaatggcaaggagaattgcccatcctgagctttggggctaagggagtggggtgggggacagtgaataaagccttgagtgtttataatgatgggctgttctcctagtgtggccagcattatactaactgggaagttggacaaatcttaagtaagtaattttgttcaaggttgccttagactggtaatgctctcatgtgtgaggctgaagcaaatgtaaatagtttttttgagaggaccagacattcatcccaggcttcaaggaatttcaacatatgaagtttgaaggaaaatgagtgcttcacagccaaaatactactaatgcacaagcaagcactgtgaatgagaacttgcagagataacagatgtggaagcagacctgcacaaatgttagatattagtattatgagataaagtataatatattttaagttttaaagaaagaaaaatgcttgaaaatataggcatgaaacaatcagatttgaaaataaccaaattcagctattagaaattataattgaggccaggtgtggtggctcatgcctgtaatcccagcactttgggaggccggggcggatcacctgaggtcagaagttcaagaccagcctggccaacatggtgaaaccccatctctactgaaaatacaaaaaaagaaaaaaaaaaaaagctgggcatggtggcatgtgcctgtagtcccagctacttggagttgcaatgagtcgagattgtgccactgcactccagcctggacgacagagtaagacttactctgtttcaaaaaaaaaagaagaaattataattgaaataaaaccctcagtagacatgttaatcagaaggttagacacagttgaggagaaattaatgaactagaatagaagatagatgtgaaggaaacattcagaatccaacatacccagacatgtaaatgtaaatgccaaatgtgtcagaagaaaggttggaatctggagggtaaagtgatttctaacttacctaaccagaactctagaaggaatgggaaaaagtaggacagagacagactcttttttccatattaaaaaaaaaattttcaggtggataaaagacctaaggagaaaggcacactacaataaggttttagaaaaaataaaggagaatgtctttatgatcttgtttgagggaaggagttttgaagacaaaatataaacaaaccataaaggaaaagattgatgaattcaatcaaatgaagaagttgtgttcgtaaaaaaaaaattacacagagaagaaaaaagggaggtatttgtaatgcatataactgacaaaggatatgtgtctagcttatataaagtaaagctgtgatttaagaagaaaagatagcttattaaaaatggatatgaggtctgggcatggtggctcacgcctgtaatcccagcactttcagagaccaaggcaggcagatttcttgaggtcaggagtttgagaccagcctggccaacatggcgaaaccccgtctctactaaaaatataaaaattagccaggcgtggtggcgcacgcctgtaatcccagctacttgggaggctgaggcaggagaattgcttgaacctagtgggcggaggtttcagtgagctgagattgcacactgcactccagcctgggtgacagagcgagactctgcctcaaaaaaaaaaaaaaaaaaaaaaaggatatgagatttgaatggataccatccaaaaaaacttgattgtcctgtccacttatggcttggtgagataagttgctcagtgtaatttctgatcagggaatgcaaatggaaaccaaagtaaaaaaccatttatacccatcagattggcgaaattaagaagcctgctgataactagtgttacccaggatgtcgcacagcaggtgctgtcatgcacttacgattggaaaacattttggcatttcttagtaaaatcaaacattttccagttttgttacctggcagttttattcattggttaaaaaatatcttaatgaaataatttcatgtagatagaaatgtacgtgacattttgttcataccagcaaaaaaatggaaaacaactcaaaagtccagtagtgcaaaggataagtaatactatacagctattaaaatcagtgaacacacctgcatgtaccactgaatgaatcatgaagacaattttgagttaaagaagcaagtcacaagggaatacatgctgtatgttttcatttatatgatgattaaaatttggcaaaaaagaaacaatgttcggtggtaaatctaaggaaaggttggggtgatgaataattatgagagtccttctcactgggctgaaggggtgggagggacagtagaagggctttggaagtattaatcatgtttcgtcctcccaatccgatgtaccttgctacatcagcattaaccacctgccacctggattgctgcagcagcagcctcttaaggcttccacaaacccatcttccagccacccactcgtggtctgctgaagtgccagtctgatagtattgcctgaacaaaactcctcagtggctcctctgcattggaggatgaagtctagatttatgagcttatttcctcatgccctctccctgccttcacctctagcttgtaccctgcacgacctgtttgctacacacagtccctccacagagccatgcttcttgcctctgcactgcttctcatgtgctttcctcttctctgaaaagctccccctttcccctattcctttctcctgatgaactcttagccatctcgaaaaacccaggccacttgtcatccctagaggccttttctaccattattcctcttctccacaaccttggtgctttgtgctgtgtgggaacgtttcttaatgcatgtatttgctcttgttctgtcatccctctagatgaaaagcttgttgagatcaggaactgtatcttactctcctttgtgtttctagggctcatagatgttgaatgaatgcctaattatttaaatgatagaatattggattggaagttaggaaatcaggttccatgttggttctgcttttgactatgccataccaggctcatttgaaaattttctcccacctccaaaataggaacacttgagatgctttattatttgcatattttctttccactcttgatacttctgtctaaatcagtgaggcagggcatgattcctagttttcaggaaactgcactggtcttttagtaatgcagtttactaaagaagagtaaatctcactcgttactgaatgtcagtgacttcaaaaagtttgtgggaaaaatggaattaaaatataaaaataaaaactgtaaactttatttctcaaaataagctctatcaagtttaagacacttttgcccatgatgataccaaccttttagttcatccctaaagaactgagggtcctgtgaattgaaccacgtcaaatgcggtcttttacattattaacagaaatgagtgccctttaaagatttttttaagattaggaaacaagaataagtcagaaggagccaaatcaggaccataaggtcctaatggcttcccatcaaaatgctcactaaatagccctcggatgaaaggaatgaggaggaacattgtcatgctggagaaggactctggtgaagctttcttgggcgattttctgctaaagctttggctgactttctgaaaacacataaaaagcaaacgttactgttctttggttctccagaaaatcaacaagcaaaatgccttggagcatccaaaaaaacattatgacctgtgcccttgaccagttcactttggctttgactggaccacttccatctcttggtagccattgctttgattgtgttttcaggttcatactggtaaaaccgtgttttatctgcagtggcagttcttcaaagtaatgctctaggatcttgatcccacctgttaaaaatgtccattgaaagctcttctcttgtctgcagctgatctgtgtgcaatggttttgtcaccgatcgaatggaaagtttgctcaactttaatttttcagtcaggattgtgtaagctgacccaactgagatgtctgtggtattggctgttggttctgctgtttatttgcgatcttcttcagttaagacacgaacaagatacatattttcctggcaaattgatgtgaatagtctgccctgagggcttcaacattgtttcattccttcttgaaacaagttatccatttgtaaactgctgatttctttgggacattatccccataatttttttgtaaagcatcagcggttttaccattcttccatccaagcttcaccgtaaatttgctattttttctgccttcaattttagcaaaattcatattgctgttacaggggttcttttaaaactgatgtcttgtccttcttagtgcctcatactggatcctgttcatacaagttactacaagtttattttggtgcaaaaaaatggtgaaatccttgcataatttttttcataatacacgttttccatgagctttttgaagatttcttatatatatgtatcttttccaacgcatgaagcattattgaggacaaaaatagtcttaaatcataaaaaagatttatatccaatatactagaaggtctgcctttcaattaactctatgtaacaatttcctagtcccccagcctgtgggtctcttgctggtagcttcacaggtagtcccagaatagaggggaaaaacggcagtgtcacacggaagtgggggaggcagggagctgagtgcctggagctgcatgaggcaggtgtttcctctcgtgaatacccacaaaactgggataaaatgtttcccttctgtggcctgctctctagtcagaaagcttactgggatgagaacagacagtgctcttacccctagatatctcttctttcattaattcacttcatttctccaagtactttctgatggtggtcatggttacaattccaaagcagaaaataatagaggggagatttgttttttttaaatcaaaatgaggaaaggcacatctgaagaagagacaaatatgtacatttttctgaaggtaactattacacatattcactttttttttgaattgtggaattgttcatgagtatgtaaacatagagagagtaatatgaaccctgggtgtctatctatcagctttgacaattgtcaacagctctgtttcccttcttgttttatgtctgcttttaaacttctaaaaaatattttaaaaatttataccacaaagtcatcagtcattccatagactgagagagagacacagtttaggcagtttaggcagggtgtaaaaggataccagaagtgctgccatacttcattctcatatgaataagtcattatgggaggacaggaaagcatgctacaagacgggagaaagagacccactgcggaagaaacttgtatcaccaataaaatgtgcatctgacttttggacagggatagattcctcagctcagcttctactttgctatgagtatctcgaaaagcaaatcgtcctacagattgtaaaaggttgctaatcagtgaaatacgttacagggaattttcacattgattatgaatggaaattattttgtgtctgagagaatatgtacaattttaccttgtctgataaggtgaattataaaatgttttacataagaaataaaccaatttcattataagtaacattttaaaccattcttagtacttactaatttgtgttcttcttacaggatataagtatccagtatatggtgtccagtggcatccagagaaagcaccttatgagtggaagaatttggatggcatttcccatgcacctaatgctgtgaaaaccgcattttatttagcagagttttttgttaatgaaggtaatatgagggtacataattttgttattctggggtagttttgaagaaaattgcccttatctgaacttttgcctacccttttgctctataaatgttttgtaagttctataggtttaactttaaagaataatacaaatgttaaataatgtgaaagccctaaaatcaagatgtaaggtattctaataaaaccaggacagttacttcaattatcatacatgcttcagtgggcagaattcttgaacaacagtgtgaagaatgttgagagttttttttttggtttctttttctttgttatttgttttttgacaggatcttgctctgtcgcccaggctgaaatgcagtgatgtgatcatagcttattgcagcctcaaactcctgggctcaggggatcctcctgcctcggcatcctgagtagctgggactacaggtgcagactaccacaccaagctctttcttcttggatacttttaatttagattcttccccattactctccatttcttagaataatgctttaattctaacagtgtctgagaattaggtgttacttttccaagacagtgatacaaattgaatatatacccaccagtttgtgattttaaggctacctctctgtaggcattggcatactggagaaagcaaataaactctgcctgctgtttggtgatgaaaacacagacatattcatgctgtgttatgtttgtgggaaaaatcgagaatttggttgtagatgcctatttcttagttgagcattataggtacagtaagtcctacgatttaagcagaactgtgtgtagcaggtccttgaacaacactgtttactttgaagtcgtttcattataacattgttagaaaaaaattggttttgttatacatcgttgtgcttaaaagtactacaagaacctatcgatgacgttaagtgaagactagctgtgtaagacagaggtacaaaaacaacttgtaaacggtagagatcactttggtgaggtatagccatttaaagacttaagtgaactttgctttcattccatctccaagcttgccctaagtttttatcaactctcctgccattgctgggaagtcaagtacttcctactgagttcactctgctttagaatcatgcagagctgagtggatggttttatgacaaaaactccaaattaaaaaaaaaaagtatcccatatacagtattagtccaaaggaacattttcatgagtgcgtggagtgaatgagggcagcagtggcagtgccgcatttgctgcagtagtagtcatgtggcatttggtctatgtggtcttttatcttccaacattctttctgaaaatgccgtaagagcctgtatttactttgactttgggagctttaggagctctcacctcctcacattccagctttcatcatgccaaacttctcactgtgcctcctggtttttcataatgctgccttaccagtgaaaatgtctcacttctctgtctgcctcagcttcaccagtttctccatcttttttactcttgtagcatccagtgatgatacaccatataccataaaaacatttttatcatatgattctgtgtggttacgaggctgagctttttgagtgttaggacctgttctgtttatatttccatccccaggctgtgttatcaagtcttgtgtatttgataggtaggtatttgaatgagttgcggagtgagcatagcatgggatatgctgcagggggagtacagcacagctgctgtggccatgcgcgactgtgccataaatcgggcactgctttatttggggaaattttgtcaagcatttgcctccctcccttccttggttccttcttcttcttctttttttttttttggaaagtaagtttgttagagaagtaaagaaaaaaaaagatggctgttctataggaagagcagtcgcatttctcttcttgttgatattttcccacttaataatgctgattgcaggaagaaatattataaaatagtctcttgaagattttgtcatctgatctttttaaaaattaactttttttcttgcagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattctgtatgtgactatttatataacattagataattaaatagtgagacataaatagagtgtttttcatggaaaagccttcttatatctgaagattgaaaaaaataaatttactgaaatacaaatattttttctaattgatttgcttgggaaataaataccatcccctacctgcccactccatcctccttgctgaaaaagaaaatagtcttttaaaatcctaccaattgttcatcttgttcattgtgatgtctccgtcctttgggtctgaggagtatttgtgtgtgtgtgtgtgtgtgtgtgtgtaggtatgtgtgtataggtatgtgtgtgcatgtgtgtatctacttttctgccctgtgttaacttcatatttaaagcgtacacatcctgaaaacagagtctgtgtcttgaactttttatctttcacaatgtccataatgtctagcccagcaggccctcagtaagtaattgtcactaattataagtttttttcccatggaaaataatttaaaagctgtcatatatttattttggtacactttaatgtatttttctttttttttttaagatggagcatctctcttgttgcccaggctggagtgcaatgctgcaatctcagctcactgcaacctccgcttcctgggttcaagcgattctcctgcctcagcctcctgagtagctgggattacaagcatgtgccatcacacccagctaaattttgtatttttagtagagatggggtttcgccatgttggccaggctggtctcaaactcctgacctcaggtgatctaccagcctcggcctcccaaagcgctgggattacaggtgtgagccactgtgcccagccaacattaatgtatttttcaatccgtgctactctcctccacccctcaccatcccatataaccctcagaagtatgaaatttaggaactccttgaggacaaccaagctgctggaaggaagagagagagggtttgctgagctgtgtctggtaaatggtgtttatgcatctgttctctgtgggcttccagagcttctgcaagagaaggggaaacaggaaactgattgggaatgatattggagggcatcgtggatgattttacctgcaacaagagaagaacaatcacctgcagacactgagctaagccataatctttggggaatgaggacaaatagcacatagaaattggaagagattaatacatttaattaaccaagaaagaaccttactagaaatgtggcagatttagtttctgtccatgaatatgaagattctttgttgagtcttactgttgaatgtgtctggctaagtttttgtctcccacctctagaaaaaggtagtgacactattattgctcacggtgccagggttcttcctagcccatttgtgttgaaaccatatagaactgcttgtctctgcagttcccaagaacaacttcatcctgactctctggatactcatgatgctgcatcctccatccttttgccctgaagactggcttccaaagattcttactgtgcttcatagaagatgaccacaaatgcaagaaaatgtgttttctgctcatgttcagcttattgtttttcccctcatgtattttttttttgaagactttgtttgctagatcactttattccaagaatggaatctctttcaaagctgaccacacccttgcctctgcccaccaccaccagcaggaaagataggccagcttgaaggcaaatgaggagagcagtgctgttcagaagcctggcgtccctacaccagcggaggcaggagaggtcgtcgattagaggtgcctgttgaagttgctgggcagcagtccggaaagcccttagagatggatagccactcctggaggacggcctgacgtggggagcctggggaggaggggagatcacagccctctgtcagcaggagagggcagaggctgaaagtgtgactgagggagcaggtgtggattagaaagaataagaagaatgaacagaaacaggaaggactgggtgggtatggaagagatagctaatgtgtacccttccccagccaaagctgacttgagtttccaagggtttttggagagcgattgccaaagctcttacctccagcatttccaattctc

SEQ ID NO: 16445 - DNA, 42094 bp, Human
  misc_feature (1)...(42094): n = A,T,C or G
ttagttgataaagcagaggcagggtttgagaaaactggattgactccaattttgaaaggtccactgtgggtaaaatattatcaaccagcatcacacgccatcaagaactctttcatgaaaacaagtcaatcaatatagcaaatgtcattgttgtcttattttaaggaattgccacagccaccccaaccttcagcagccaccatccagatcagtcagcagccattaacaaggagcaaagaccctccaactagcaaagaatatgacttgctaaaggcctagatgattgatagctttttttttttttgagaccgagttttgctcttcttgcccaggctggagtgtaatggcgtgatctcggctcaccacaaccttcgccacccgggttcaagcgattctcctgcctcagcctccctagtagctgggattacaggcatgcgccaccatgcccagctaattttgtatttttagtagagacagggtttctccattttggtcaggctggtcttgaactccccatctcaggtgatccgcccgcctcggcttcccaaagggccggtattacaggcgtgagccaccatgcccagctgatagcatttttttagcagtcatgtattttatttacttgtttatttttagagacaaggtctcactctgtcgccaggcaggggtgcggaggcacaatcatagctcactgtaatctcgaacctctgggctcatgcgaccctccttcctcagagcaattaacaaatgtatatatactttttccttcctctctcccaatattttaaattaaggtatgcacattgttttagacataacgctattacacgcttaatagactacattataaacatgattgtatttgcactgggacatgaaacatttgtgagacctcactttgtcatattgcggtggtctggaaccaaattcgcagtatctccaaggtatgcctgtactagattttctatgcttgagtttagtccatatcgtaaataccttggaggcaaaaggaacacggcagagagcacaaagaggacaatacatatttgctgaaaaacagtaggacacagaactgctgacgacgacagccttgccctctccagttgactgcagcaaatgttgccaatttgccagagacaagcaattcgaggagagaaaagctgcttgccttttcagttagcaagaaaagtgctgggtttgtcttctgccgagcacccgcaacccagatcccgacccgagattcctgagacacactttcggtggagggaactcctagcagcaacgcccagcccccggcgtgaccctccgaccgcacttgcctcccagcctgggaaggtggaagaggccgcccaaagtcccctcagttggccagtgagtgacccctgggcggaggcggcgcagtggcccccaatccagcctcggggcgagaggcggggcgcgccgcgcgcccccgcccatcgcgggcgccccagccctgcgcgccaggcctgcgtgtcctcgcgccgacccctccctcgcgcgcctcgcccggcgcacgcgcgtggcctcgcgcagggcggggagaggcggtggctgtgggcgtccggccccgaacctgtcagacctggggagccggcctccagcagcgggcgcggcgggcgcgagcacgaccccactctcctgcggccgcgggtggagcagcgcgagcccgcctcgctgagccggccgggggcggggagatgagttgcggccccgcggcagcgccccaggtattaaatagatgtgccgccccctcgcggagccccggcggagcgtcggggtcggccctgcgacccgccgccagcggcttcggaacttgaggacagggttgggcgcctttaatttataacgtgtttcgttttccacaggatggggagggacgcgcggcactgccctcgagaactggcgctccggtgaagtaggcgccgccggccgtccgcctcccccaagccgttccgcaccgcggccgctcagcctctgccatggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtgagttgtgttgccaactcactttccgtttacctttcctcgagagtctttgtcaagctgtagttacacaggctttgaggtttaacccatcttttcaggaagtttgtatttatcaagacactgatctcatgtgaaaaggccacacggttccaaagtgcagctcaatctaagtacaatataaactccccgagataactttgactttctcttctagttgttcaaccactgtcatctaccgtaaagttaaggacgttatcttcattgtatgtcatgtaacttcctctttttacaaaggtctggtaaaataccaggttaattttcgcaacgtttaaaatagtaaatgatcgtaaataacttaagatcatagaattttacagtatgaagggaccttactgaacacctgctccacctcctttttttttttacatgtaaggatttccagggcacaaaccagtggaataagtcgtgagggccacttagggagttaatggaagagccacatctacagtcccagcatttttttcctctacatttgacctaagtggtttcttttatacgatttccttttgtatttatagccaagagatttgcaaaattaattaccaactaacatgaaatttttgcctcgtaagaagggcctgaaatgaaccagaggactccgccaaagttctatgagcctggttttcttgttcattttttaattatacgaacaatccgttctcaatataagatacattcttagtttagaggttattttcaatcacgtcagtataactactaacttctcagtgacagtttacaaagtgacataaaagcagggagatgattcttacatgtcatctcttaaatgatgaaccatgacaaaaacaggtggcagtccagatttaagatgtttgactggagggttctatgtgggaaaaattatatacatttcctaccttctttcataacactcctccccagggctcgcttcagccatgctggtcttctttttcctcttacaactcacaaagctctttttgcctctaaggcgttcaaagtggctggtccttctatctcagtggctttcaaacattttttgacctcactgtagtaagaaatacacttcacattgtgactcatttaggcatgcatgcatacatatgtatgagaatatacacaggtcacatgtgtataaatatatgtataactgaaacaaaagttttccttcatgtgatgtatcctaatagtttcttcaattgtggtcccagctcactaaatggatttcgtgtgtccactgcagtaggtcagggccttagcttgaaaaacactgctttacatagactgcctttcccaaatcttttcttggccagtttcttgtcattcgtgtcttatttaaaaagacaccccggccgggtgcagtggctcacgcctttaatcccagcactttgggaggccgaggtgggtggatcacctgaggtcaggagtttgagaccaccctggccaacatggtgaaaccttgtctctactaaaaacaaaatacaaaaattagccggacgttgtggtgggcgcctgtaatcccagctacttgggaggctaaagcaggagaatcgcttgaacccgggaggcggaagttgtggtgagccgagattgcgccactgcactccagcctgggcaacagggtgagaatccgtctcaaaaaaaaataagtaaataaaataataaataaataaataagtaataaaaattaaaaaaacccacacttttgagagaccttttctgactgactaaagtaaatctcttttgttccctgttccctctccaactttcaaagtcctcagcatctgagatatcttatttatttactcatttaatattacctgtttccactgaaatacaggctgaattcctagcacctagaacagtgactggcacaaagtagatactcaataaacttgttgaattaattcatttttattctgttagataattataaatgcttgagctgtaaagaaattaaaagacaggagacaacctgtgccccagataaagcaccatggtctcagcagactgagattcggtgacttgcccaaactaacacaactagaatattgagtcattcaggtttaatgatttttgaagttaacgttgaatatttgaagttaaaataacaatcacagcatccccccttaaaatgattaataattcagagtttatttcacctaagtaaaaatcattaagatataattgtcttgacttctcacttctgaaatctgttatttggtaaatgttgttttatgaaagccacaataagtatttcctttcaaatactgactttattgtcaaatgtggaaatattttgttaaacaatacagagatgatagtagtacttagggtaagcattaacaatattattcaaaatgttatatagagttcaactgtatacaatagagcatttattaaagtgtgtccaaagcgcttataaataaagcatcttcgaggcaggcggctcacttgaggttaggaggaaagcagactggccaacatggtgaaaccccgtctctactgaaaatacaaaaaaattagccaggcgtcatggcgcacctgtagtcccagctactggggaggctgagacacgagaatcgcttgaacctgggaggtggaggttgcagtgagccaagattgcaccactgcactccagcctgggtgacagagtgggactctgtctcaaaaaaagaaagaaagaaagagaaataaagcatcttatgtaggaagtatggagaaataaaaaatgaagcaatttggccaggcacggtggctcacacctgtaatcctagcacttctgggaggccaaggcgggtggatcacttgaggtcaggagtttgagagcagcctggccaacatggtgaaaccccatctctactaaaaatacaaaaattagccagaaatcgctttaacccaggaggcagaggttgcagtgagctgagatcatgccactgcactccagccagggcaacagagtgagactacattaaataaaatatatttttaaaaaatgaagcaatttggccaggtgtaggaagtatcttatgtaggaagtatggagtaataaaaaatgaagcaatttggctgggtgcagtggctcatgcctataatcccagcacgttgggagcctgaggatcgcttgagctcaggagttcaagaccagcctggcaacatgatgaaaccccctctctaccaaaaaaaaccaaaaacttagcctgacttggtagtgcgtgtctgtggtcctagctcctctggaggctgaagtggcaggatcggttgagcccagggggtggaggttgcagtgagctgagatccggctgctgtactccaccccaggtgacagagtgagactctctcaaaaagaagggaaaaaaaatgaagtaactaaatgagctgagatagacttggttggctttaccacttaccttgctctgagaccttcgtaaaggtccattcttttctcttctctttggaagtgtattttgagtacttacactatgtgccaggcactgtgctacatgttctgaatgtacaatggagaacgaaactattatgatccctactatgtggagaatttaatggaagagacaatcattaaacacgtaagtaaatttaaaatttagatggtcctaagtactaggaagaaaaagaacaaggtactataagacatagtaaccagtaggacatagtttatgcatggaccaggtacatttaagccaaaaaaaaaagaatagtaggagttacccaaacagagtgagggagttttccaagagaagagaacagcatgtaccaaggtcctaaagccttcaattcttcgaaaggaattagaaagaaggccagtttggcttcaatgtgtaaccatgagggaaagaggcaggaggaagagatcaggcaggccctggtaggccatgttagatgagtgtagtttttattttaagtgcaatggaaagccagataagggttttttttgtttttgtttttgtttttattttgagacggagtctcgctgctttcgcccagcctggagtgcagtggtgtgatctcggctcactgcaagctctgcctcccgggttcgtgccattctcctgcctcagcctcctgagtagctgggactacaggcgccccccaccgcgcctagctaatattttgtatttttagtagagacggggtttcaccgtgttagccaggatggtctcaatctcctgacctcgtgatctgtccgcctcggccctccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgttgatagctgcatcacttcgtacgactctcaagagatccaaaattaaggaaagctagttaaacctatttaaaagccagtcagatataatagtaaaattgtataattagtatactcagagataaaagatcacgtatccatgaagcaagaacagactactttaaaatagaaattcagggtgggcgcagtagctcatgcctgtagtcctagcactttgggaggctgaggcaggaggaacaaacacttcagctcagaagttcaagaccagcctggtcaaggtggcaagaccctgtctctacaaaaaaaagaaacaaagaaagaaaaatagtagggcatggtggtgcttacctgtggtcccagctacttaggaggctaaggtgggaggatcacttgaggacaagaagttgaggctgcagtgagccaagtgtttgtgcaattgctctccagcctgggtgacagagtgagactctatctcaaagaaaaaaaaaaaagaaaagaaattcagggtaacgaaaaaagcttctgcacaataaaaacatagttgaaatttctattatttattatttatttatttatttatttatttttgagatggagtcttgcactgtcgcccaggctggagtgcagtggcgccatctcggctcactgcaagctccacctcccaggttcatgccattttcctgcctcagtctcccaagtagctgggactacaggcacccaccactacgcctgctatttttttgtatttttggtagagacgggctttcaccgtgttaaccaggatggtctccatctcctgacctcgtgatccacccgcctcggcctcccaaagtgctgggattacaggtgtgagccaccacgcccggccgaaatttcttttaaactccatagaaaagttagaagataaattaagggctgggtgcagtggctcatgcctgaaatcacagcactttgggaggctgaggtgggaagatcacatgagcccaggaattcaagatcagcctgggcagtatagtgagagcttatcttcactaaaaattgaagaaaaaaaaaaagccaagcacggtgtcatgctcctgtagtcccagcaacttaggaggctaaggcaggaggattgcctgagtccaagaattcaagaccagcctggacaacatagtgacaccttgtctctaataaaaattaaaaaaaaaaaaattagcaaggtgtggtggcacatgcctgtagtcccagctacaaaggaggctgaggtggaaggattgcttaagaccaggaggtccaggccacagtgagccacagttgtgccactgcactgcagcctggacaacagagcaagaccctacctcaaaaaaagatgaattaaggtactctctcacagagttgagcaaaaagatgtataattggagagaaagggcaaaaacaatttagaggccaggcacggtggctcatgcctgtaatcctagcactttgggacgccaaggcgggcagatcacctgaggttaggggttcgagaccagcctggccaacatgatgatacaccatctctactaaaaatataaaaattagccgggcgtggtggcgcatgcctgcaatcccagctactcgggaggctgaggcaggagaattgcttgaacccagaaggcggaggttgcagtgagctgagattgcaccactgtactccaacctgggtgacagagtgagactctgtctcaaaaaaaaaaaaaaaaaaaaaattggaatatcaatctaaactccaaataacaggaaggagtttgagaaagaaagcaaaggctacgaaatcatcaacactatagtttatggtttaggaagttttcccatagctggaggatacacatttctataattttttttttttttttttgagacagagttccactcttgttgcccaggctggagtacaatggcgcaatctcagctcaccacaacctccacctccccgtaacctccgcctcctgggttcaagtaattcttctacctcagcacccgagtagctgggattacaggcatgtgccaccatgcccaactaattttgtatttttagtagagacagggtttttccatattggtcaggctggtctcgaactcccgacctcaggtgatctgcccgcctcagcctcccaaaatgctgggattacaggtgtgagccactgtgcctggccacacatttctagattgaaagagcaaattgggggaaaagagatccattccagggtagacattgtgaaattttctgaacacagagaacacatcattgcctacctcaggaagccgcagtgttagttgcctctgatttttgacaagcatgggaagatgggggctgttcatacagggcaagcttcaagtgtccagtcaaataaaaacatccttgcacgtcctttagggaactaccagcaggtcaaataatgacagttctctgggaatggggcattgaaggagatccaaactcattttgtatcctccagtggctgccaacctgaggttttcactgtgattgtggcctgttggttttcaaggctaccatacagctggaggacaacaaatgggtacagcgcaaattaaaacaccatgaagataactgttcttgctgatattcagctatttttcttgaataagtgctatgtgtataagcttttggctaatttccaaagttctgaaaaagctgattttgactatttttgtccatgttttcattctttttgtgaagatgattttcagaggtccttactttttttttttggctgatgtcaccaacatgtagctttttaagtttaggttaattaaaagtaaataattaagcctaggcaacatagcaagacctcatctcctgaaaaaaaaaaaaagataaaaagattagctgagcatggtggtacatgcctgtagtcccagctactcaggaggctgagatgggaggattacatgaacacaggaggttgaggctgcagtgagttatgatcacatcactgcattcctgcctgggtggcagagcaagaccctgactctctaaaaaaaaaaaaaaaaaaagtttaattaattaaattccttagtttcactaaccatttttctttttctttcttatttattttttggtagagatggggtttcaccatgttgcccagtctggtctcaaactcctgagctcaggtgatccgcctgcctcagcctcccaaagtgttgggattacaggcgtgagccactgcacctggccccatttttcttttttttttttagtcaatgtctcactcttgtcacccaagttggagtgaactggtgccattatataaagcttactgcagcctcagactcttacactcaagcagttctcccacctcggcctcccaaacagctggtattacaggcataagccactgtgccccaaccttactagccattttttaaatgctgaaaagccacatgtgactagtggctacaccattggacagctcagatacagaacatttctatcatctcaaagttctattggacagaattgctttaaggaattatcctcattataaaatgataagtatgctaaagctcaaaaaaattaactcattcagactttctgagattccaaaacttcatgttgtttaacaccaaccttctcttggtgctttccagctttttcatgccggggaatacataaaaatgctatttgtatagagcactctggggtaaatggatgtgactaaaagatcatcagcccctagtctcctgctcttgtctctacacacccagctcaggaatgaggaggatcaacagctcagcacacttacctgatcatgcagttctgctgtacattataacagtgattctcgaagtgtggttccaagacttgaagcatcagcattacctgggagcatgttagcaatatacattctcaggtcccatccccatcaccatcccagacctaccgaatcagaaattctgggagtagagttaagcagtttgtagtttaacaagccctccaggtgattctgatacacataaaagcttattcagtgaatagtgctaggaaaattggttgtccattatgggacaatacagacacacaatgaaacaatgtataatatatatattaaatgcctggaaaatcgataacaaaaattgtatcctaaatactaccttttgtacccctcttcagagatgttgctaagtgaatcagttaatttttacatattttatatcgaactaatgtacattttgtaggttttctcagtttaattttatgttccaacgcccctcaacaagtgaacacccttcttttcttcagctttgttgtaatatttagatatggttattaattcactaatagtagaattagtaagttaagcaaaagcttcagtaccaagacacaaaatcactatatatttgccttgtggttcttaactttctaaaggtcattgactccttgcagcatgtgttactagaaatggatattctggctggacacattggcttacgcctataatcccaacacttgcaaggccgaggcgagtggatcagttgaggtcaggagtttgagaccagcctggccaacatggtgaaaccctgtctctactaaaaatacaaaaattagccgggcgtggtggcacgtgcctgtagtcccagctactcgggaggctgaggcagaagaatcacttgaacccagaaggcagaggttgcagtgagctgagattgcaccactgcactccagcctgggcaacagagtgagactctgtctcaaaaaaaaaagaaaaaaagaagtggatattctcaccagaaaaatgaacctatatctaatattttgaatgaaatttcagaataccttgatttaattgtaatgggataaagatttagttagaagttcatgttttgtaggatattgcatatttctagtttgattgcttgcttttttaaaaaattaacttgttccttttttctcctacttgtaactctaaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttaggtaggtagttggtgtttcttttgctttataatattttatagtaaaaccacaatgaactataaccctgattaactgaactcgttccagtgatatcttgtttgaacaaagcaaatgaaaatagataaacaaaatttattcagaaacatcttttccagggtacatttagcctagtcagctaaacagtttacacatataaaattatatgatgatcattaatcttcaaaggttgctccctatgtcctgaagatatcatcagaaaaaagtttactttcagtttattgaacaaagcaaaaccacatgggtttaacccgttaatgagcattagcttctctcttttacttcaggtatttcagccaaagctaccatagcttagattttaagcagagctatcacaggtataatgtatgctgtgtggctgaacttgactgcagccatcgtatcaacataattctgcaaatgcacacatttttatttgcctgttttgaacaaattttaatgtttaattataaagagttaaaatcatacattgctatctacacagctctgcttcttactgtattactgtttttaaattttttgcttattttgaaaatatgtataaaataattacctgaactattatatgaagtaacatttacccagatgtcagactcaaaagtagaacccaaaagttgacatttaagtagcttcagcaaaacttgcctcaaagaactagagttaatatctgataatttcattttgtaggaacactgatgctcctggctaatatatcaatcaattcctcatcatcttttttattttttagcctaaaaaaacttagactgtagattttttgtttgtttctttacctatattttctttgtatttgttttttgttttttgcttttaagacagagtcttgctctgttgcccaggctggagtgcagtaaactttttgtttctttacgtacattttctttgaatttatttctcgtttttgcttttaagacagagtcttattctgttgcccaggctggagtgcagtggtgtgatcttcttgcactgttgcccaggctggagtgcagtggtgtgatcttcttgcgctgttgcccaggctggagtgcagtggtgtgatctcagctcactacaacctccaccttccaggctcaagtgatccttccacctcagcctcccgagtagctgggactataggcgtgcactagcatgctcagctaatttttgtgatttttgtagagacagggcctacctacaagggggtcatcctttgcccaggctgatgtcaaactcctgtgctcaagccatcctcctaccttggcctcccagagtgctgggattacaggtgtgagctgccatgactggcccacagcatccaggacctcttacttagtgactgggtcttctggtgcaaaacttgacactgtacctaaatggtgatattccaagtagctatccaggtcatcaggttggaaaattatctagcatccccacccctccgtactctcagctactgtacaaaagagctaaagccccaagtgaagtttttcttttgttaagctactgcataatgcatgtgaatgtgttcctggccaggcacggtggctcacgtctgtaatcccagcactttgggaggccgaggtgggcggatcacctgagatcaggagttcaagaccagcctagccaacatggtgaaaccccatatctactaaaaatacagaaattagctgggcatggtggtgcacgcctgtaatcccagctactcaggaagctgaggcagaagaactgcttgaacccgggaggcggaggttgtagtgagcctagatcatgctgctgcactccattctgggcggcagagtaagactcttgtctctctcaaaaaaaaaaaaaaaaaagaatgtgttcctaaaggaaactccactgcttctcaacatattatatagtcatttgtttactggttgccttaggatttttaaacagcttcaaaattatttttaaacattaatttttttgagatttaaacacctgcagttaagatctaagatgtaaacatatcatcatggaatgggaatttttttaacactgcttgagagagtacatttatatagtcctgtggttcttaaactcttttaggttataaaccctttggaattctgatgaaagcagtgaaacactccctcagaaacatgcaataacagaacacagaagatgctacacatataagttaagaacccataataatgaaacttctattaaatattaaagaagtacttagtgtttgttctacatagtcactttgcttcttcgtaaataaatactatgtaaaaataagagacaatagaactgaccggtcctattgtgtctctggaattttctatagaaagtcaaatctttccctttccttaaaagtactaagttccaagaaggtagaccagacagcaccatttgattcctgtctctctgagagtccattaagataaaaacatagaggtaccaaaacaccaaagagaattacatgattgggttaccagtaaacacatttccagaaatttttggaagttgtaaagtacatatgagtgggttgaaggagaaaacaagccaagaagcaatgtgtagaacatactctgaactaggaactggaccagcccaacagatcttaaggcttagggacagagatgagcagaaatgagaattggggctgaaaacggaagattaattgaataagtgggaagccgttcccagtggtcactatgcccctacctcccttcttactcctacctctactcaggcagcctacactttccgccaagtaaaacaccacatagttcttctagaaagaaactgaacaaaatgttcagggaaaactaagaattagtgtggaagttgatgctccaaaataagtcttacttttaccagaattcagatttctaccacctcatatcctgattctccacctactcatcctaaaggaatatagttatcctctgccctgccctacaccccatattaataaccattttaggctggacatggtggtttatgcctgcaatcctagcattgtgggaggctgaggcagaaggatcccttgaacccagaagttcgagaccagcctgggcaacataggaagaccctgtctctaccaaaaaatattatttcaattcatttctggcttatccttccagcatttcctttttacaaaggatagtttccctatccttctgccctaagtatgaatagacaaccaagaatcttccagcatgtgggaaaaaccagcaccatgaattaaaatgaccaaaactaaactaatagaaaaattaaccctaaaggaaagagaagtaacttaaagaaccaggagaagctgggcatggtggctcatgcctgtaatcctatcactttgggaggccaaggtgggcggatcacttgaagccaggagtttgagaccagcctagccaacatggtgaaaccctgtttctactaaaaatacaaaacctagctgggcatggtggtgcccacctgtaataccagctgcatgggaggctgagacatgagaatcacttgaacttgggaggtggaggttgcagtgagccaagatcaagccactgcactccagcctgggcaacagagtgagacaaaaaaaaaaaaaaggaaaaagaaaagaacagaaccaggagaaaagtttttaaattatcttattaatatgctcagaataataaaacagtaaaatgttttggaaaaataaatacaagaaatagctctttgaaattaaaattattcctgaaatttattatttatttatttatttatttatttatttatttatttttgagacagagtctcactgtgtcacccaggctggagtgcaatggcgcggtctcggcttactgcaacctccacttcccaggttcaagtgattctcctgcctcagcctccagagtagctgggattacaggggcccgccgccactcatggctaatttttgtatttttagtagagacgggatttcaccatgttggccaggatgatctggatctcccgtcctcgtgatccacccgcctcggcctcccaaagtgctgggtttataggcatgagccaccgcccccagccaagccttactattaagaacctcagaaaaatagaacttaaaaaataaaaagaagtaaccacttaatgcatatggtatttctttttgaggtgttgaacatgttctggaattagtagtgatgatggctgcacaaccttgtacatgtactgaaaaccactgaattgtacactttaaaatggtgaattttgttacatgaattttatgtcaatttttaaaagtcatctaaaaaaatgaaagggagggaattgttaaagatatagatagataggtatttcctgagctaagaaggtactcaagcttcacactgaaacttttgggatcttcttttttttgttgttttgtattctgaaatattatgaggggatatctagatatagaccttatttcacttattctgctctatgaaataatggtggaaatttggaagaaaaaacttagtttgcttgaggaagattcaaagatacatagaatttgatgaataaagctgtaaaccaaagcagttggtgtccctgagttccacagtaccattgcttcagagtaatctcttgaagttctatggggagagatatatttacatttggacacacttaagtagggtagctcttgtgatctctaattccagacttggagattcaggtcctgaaaacttcacagagggaatccccacaagaagcttggtttgttaccattcttgttgaattttgttttgttttgatgacatggtggggtgggacagggatgggttttttctctgttgatttattttgtaaatatgcaaaacatgttgcaaaagtcaaattttattttattaatttatttatttgagagtgggtctcactccgttgtccaggctggagtgcagtggcgtgatctcagccccctgcatccttgacctcctaggctcaagcaatcctcccacctcagcctctcgagtagctgggactgggactgggaccacaggcatgcaccaccatgcctggctaacttttgtattttttgtagagacgaggctttgtttcccaggctggttgcaaactctgcagcctgtttcccaggctggttttgaactcttgagatcaagtgatccacccgcctcggcctcccaaagtgctgggattacagagataagccatcatgcctggccaaaaattattttttaaaagaaaacacagagaagtcttgctttcattcccctccactccatctccccataccattccataagagtagacccttttaattggtttctagcctatccttccagcacttccttttgaaaacataagcaaatacatatatatgttcatatcctgcttctcaccacccttttttatgcaataggcagtatactgtatactcaactctagacctggaggcagtgattctatatagagttccacctccagatcactttataacagtacatagaagcttctggtttgaaaatgtcagagcttaaaggaggagaacaaccacttaactattcagatagaagtaatattcccttgctccttttgaataaaaattgaaaacaggatattgtcttgggattctgcatgaggaagcagaaaattagatttcctgggaatttcttctacactgaagaatgaaattttacactctatctgacaatagtaaatatcaaaccatagcttagctgtaattgccattttagttgttatatggatgtgtttctgctttaaaagatcacattctctgtaggctttagattggtttatatttatttatggactattgattgtagcctttttttttcttttctttctttttttttttttttttaatttttgagatggagttttgctcttgttgcccacgctggagtgcaatggcgcaatcttggctcattgcaacctccacctcccggattcaagcgattcttctgccttagcttcccaagtagctgggattatagacgtgtgccaccattcccagctgatttttgtatttttagtagagatggggtttcaccacgttggccaggctagtctcgaactcccgacctcatgtgatcctcccaccgcagcctcccaaagtgctgggattacaggcgtgagccaccatacccggttgattgtagacttttgattggtatttacaaggacccatgagaggcaacaaagagaagttgtcaagagaacagaccctgagaccaatagtttggctcaagctctggctccctaacttcctaccagtttgaccttgggcaagttacctaacatctttgtgcctccattttctatttgtaaaaggaaactaatagtagtgcctactttataatagagttattacaaatattaaatgagttaatatttgtaaagtaattagaaaaatgcctggcacttcaaaagcagccttcatttattctttggaaataattttaaatgaattcaaggtttatatgtagcttttaggcatatatacataaatgtcactgtaaactgcagaatatccgatctttaaaattttttggttaaattttatcataatatggtaacaaatcacatttattgcttttaggtgttagcgataaaacagagtttgtcagttttagtctcttatgtaatggaacagaaatacgatgagcccagtgggagaaagcaggaggagttcttgtccgtctctacttatactttttgttttttttaagttactaaatatttttgacactgatttttgcttatgaatagttttgaagtaccaatgaaaatgggttctcacccaagtgagaatagttttgctaaaaaggtagaaataaaagaaattgaaggagcaattctacttgatggtaaaacagtgatgttgttatatgctattcacattttagttttctcctcttcccattagttctttctgtacagtttaaactgaatctggaattttcttatagagaattagctttacatgatcaagtactgtctatttagttactctggaggctattacttcccctctcagttcctccaaatggtctggagtgaagaaggaatcatttttgtttcttctgtaacccaaagattagctattttttcttgtttttaaatttttatttatttatttatttatttattttggagactgagttccactcttgttgcccaggctggagtgcaatggcacgatctcagctcaccgcaacctctgcctcctgggttcaagcgattctcctgtctgagcctcccaagtagctgggattacaggcatgtgccaccacacccagttaattttgtctttttagtagagatgggatttctccatgttggtcgggctggtcttgaactcccgacctcaggtgatctgcccacctcggcctcccacctcccaaagtgttgagattacaggcgtgagccaccatgcacagcctgtttgtttttttttgttttgagttcatgactttttttttttgaaatggagtctccctctgtcacccaggctggagtgcagtggctcgatcttggctcactgcaacctgcccctcccagattgaagcgattctcctgcctcagcctctcgagtagctgggactacaggcgcccaccaccatgcccagctaatttttgtattttggtagagacggggtttcaccatattggccatgctggtctcgaactcctgaccttgtgatccgcccgcctcagcctcccaaagtgctgggattataggtgtgagccacaatgcccagtgagtccatgaccttctaaaaggattagcttttattgaataaaatattaaatgaggaaatgaaaattaatttcaggtcttcttttgtcctgttgatctagggtaaatagttttactgtgcctttgcttctccttctgtaataaagagtttttaatatttacttatattgtggttaatgtcaaattacagctgatacatgtatctaatttggattatctagtattcaataaaagtatattacacatgtgaaggtgtatagaaactgataatagacaaacaggcagatgtatttctgaaattcgtgtgtaaattatctttagatgaatggagtcttttttttttttcgagacacggtctttttctgttttccaggctggaatacaatgacaccatcatagctcactgcaccgtcgaactcctgagctctagaaatcttaccctcgcagcctccagagtagctaggactgcatgcatataccaccatacccagctaattttttaattttttgtacagacatggtcttgctttgttgccaggctggtcctgaactcctagcttcaagctatccttccacctcagtctcccaaagtgctgggattacaaccataagccactgcaccaggcctgatgaatggaaccttttaaagtcactaatagtccaggcactgtggctcatacctctaattgcagcactttgggaggccaagacaggaggatcacttgagcccaggagttggagaccagcctgggcaacacagggagatcccgtctttataaaaagaaaaattagcagatgtggtggcacacacctgtggtcccagctacttgggaggctaagataggaagattgcttgggtccaggaggttgaggctgcagtgagccatgttcgggccactgcactctagcctgggtgatggagcaagaccctgtctcaaaaaaataaaaaaatataggctgggtgcggtggctcatgcctgtaatcccagcactttgggaggccgaggctagtggatcacctgaggttggatttcgagaccagcctcaccaacatggagaaaccccatctcaactaaaaatacatgtggcacatgcttataatcccagctactcaggaggctgaggcaggagaatcgcttgaacccgggaggtggaggttgcggtgagctgagatcatgccattgcactccagcctgggcaacaagagtgagactctgtctcaaaaaaaaaaaaaaaaaagtaaaaagtcactaatatataatatgtaataaacaattgtttttacaatgaaatcacccgtgtttgatttatttatgagtttggattttttaaaaaaaggattcgtgtctgtgaatgatagttagatattagtagtatcatcctctatgtcatgttctcataataatttatatgtggttagcagcatttatcacatcttttatagctatttttatgaaactctgtctcctagatgatgagttaaatagggacaggaacaggtaatattaaactctctgtgtctggcactaattgttggataggtgtggtggctcactcctataatcacagcattttgggaggccatagtaggaagtttgcttgagcccttgagtttgagaccagcctgggcaacaaagcgagacccctatctttacaaaaactttttaaaaaattagccagccatggtggcatgcacctatagtctcagctactcaggaggctgaggcaggaggatcacttgagcccaggaggtcagggctgcagtgagctatgtgcacgccactgccctccagcttaggggacagagcaagactctgtctaaaacaagacaaaaacataaatttgcgtattcaggctgaataaataagggcatgaaagctgtggaacagacaatttagaacaatgcataatccttaaatcatttgttttgggagtaaatgaaaccagttaccaaactcagagtagtggtgtttttgtaatttgggactaaatatttggaacttgaaaacatttttccataatttttttttttgagatggagtttcgctctgttgcccaggctggagtgcagtggcacgatcttggctccctgcaagctccgcctcccaggttcacgccattctcctgcctcagcctcccgagtagctgggactacaggcgcctgccaccacgcccagctaatttttttgtatttttagtagagacggggtttcaccatgttagccaggatggtctcgatctccggacctcgtgatctgcccgcctcggcctcccaaagtgctgggattacaggcgtgagccaccgcacctggcctagttgaaatattttaaagtaaatcccagacatcataatatttctcccttaaatatttccacatacaagctctgaaaaagggagaggccatttaaaagatatcccgccggccaggagcggtggctcacannnnnnnnnnnnnnnnnnnncccagtttggggacagtccaagctttgtctaaaccgggtaacacaataaattgggttttcacggttaataattagggcattgaaattgtggcccagttatttagacccctgtatagccttaaacccatttgttttgggattatttgaccccttttacaaaacgcagattaatgttgttatgtaatggggactaaatattggaccttgactctttttcccataattttttttctgagatgtattcccgttttgttccacaggctggattgcagtggcaaaattttgggtccctgaacgctcggcctctgagtttaacgccattctcgtccatgagcttcccgattagctgggactataggcgttgccacgacgcccagcaattttttttgtatttctagaagagacgggtttcacattgttagccaggatggtctcgatctccggacctcgtgatctgcccgcatcgacatcaaaaaagtcttgggattacaggcgtgagcctccaaagtggccacatttttctatattttaaaactgtggtcatgttcacagaatagctgataaatatactcacgcgtgtaatcccagcactttgggaggccgaggagggtggatcacctgaggtcaaaagttcaagactagcctggccaacatggtgaaaccccatctctactaaaaatacaaaacattacctgggcatgttggcggccgcctataatcccagctacttgggaggctgaggcaggaaaatcacttgaacctgagaggcagaggttgcggtgagccaagatggtgccattgcattccagcctgggcaacaagagcgaaactccgtctcaaaaaaaataaaaaaataaaaataaaacaaaaacatatagatagatagatagatagatagatagatagatagatagatagacagacagacccttaacatagctggatagtactgttgtactggttgtacacctgacttaaaggtccattttgggtatagaaagaaatttgtcagaagggaattttttcttccttatctcagtgaggggctgatcctatttgtttgctttagttcttaccacttagaacttcgtggctaaatcatcttttgttcaaatctgagatccatctatatgaccttttggagagtaagttactctcttgaactagaagtttcttcttctgtaaactaggaataatatttgtattgcagaattgtgaaaagtaaataatgtggtaaggaaaataaagtacctaacatggttctggcatagagtaaattcccaataaaagttagtttcagccttctgtttttccttccctcttctacctgcctgtatatcatcttacccagatttttcatatctctcaagatgctccatgctccaaaatggcctaccgttcttctcccccagtcagaattcttagctaaattgtaggaaaaaagatgattcactctgatgattaaataacagtttttcaagacatgctctttaaactcataagtctttggtaatttatttgcaatgtaacagttcattttagcaaaaatcagtcaaggtgaaagaagggtagtcttagatttgtgggatacagtggctattccaggagtcagttctgttctgttgctacttttccttcatgtgagaccatagattgtataaaatcattcaggtttttatttttcatctattttctttcattattgttttataataaactacaatcagctttttgtaggaagatggagagcaggttaggggccatatgcgagttatttttaaatgcctggatttatttgattgtgggcatgctatcttattctggaaggtaatacaattttgaatgtaatgaaaccacactgtaggagaaatcccacaagttctcaggaggaatagcattcttttccagacaaagaggaaatgccattctaaagagaacaggctccacccgcttgcttgctttctgcctctatccttctatccttctgtccttctggtgaaagtaattgactatatttatatggttttttttccagacggtgggctgaagaggttgtgcgaattagataaagataatgctcatgtgaaaggactgtagtaagcagagttgtttgtatttgaaataaaaagcaagatttgcactatggtaataaaaatcatcagcctgagccagacacagtggttcactcctgtaatcccagcactctgagaggccaaggcgggcagatcacgaggtcaggagattgagaccatcctggctaacatggtgaaaccccgtctctactaaaaatacaaaaaaattagccaagcatggtggtgggtacctgtagtcccagctactcgagaggctgaggcaggagaatcgcttgaactcaggaagcagagctgagatggtgccactgcactacagcctgagtgacagagtgagactccgtctcaaaaaaaaaaaaaaaaaaatcagcctaggctcatggctaagtgacagtataggatagatgtctttcctaatgatacatagttttactgagcagaaaccctggcagagctggctagatgatggattgtcctgggttaggtacctggttacaatgctaattccatgtagttgggatttttttatcccctcttgctctatggatagaaaactatttagctaagaagtcttcccgcaaacacacagccaaaaataacctataatctcctagttagtgattcattttgacaacttcctcccaccactgacaaaagttatgcctattaattattcacatcttagaatttaatcacatcaaataaacatctataggaaaagaataaattcctagaacttcctagggatgggagtttttattgaggctgaaagaagacatgagtgaggtagtccacgctggatagctagacgtcagcttgagagtagtaggcatcttgggtgtgttgtagggggagcaataagcagaagtaggagattatttataatggaaggggagatcgaaagacaaactttggagtttagcttgccattctggtggtgacagtgggccactgaaaatcctctatgatgtctttagcctgagttgaaatacaaatacaggttgagcatccttaatccaaaatctgaaatgcccctttgagcatcatattggtgctcaaaaagtttcaaattttggagcatttcgaattttgaattttctcattaggggtgctcaacgtgtactagtttagaagtcctaggcaaatccaatatagcccactctttttccttctgtttccttcctatcctctattggaagaaggtagaaaagaaaaatagcacaaaaggaattagaagagaggatatagctccactctccttccctattcatttttatagacctctgaaacctgtcttcagatatttgctatatatagtttttttaagcaatggaaagacaagtgttacatagtttaagtgaaactgtaactgagttttgttaagtgaacaatactcattattggcatcatagcattagcaaagttaacagttatggtaggccagtacatttatacaacacccatgaaaataaatatgtttgggttgtgtgtggtttacatagttgaagcaaatattgttatagtgcctcatagttacttgttgaatgaatgaataatagtataggtggggaaataggtagtacatatgtatacaaacataaaaataataataaattgtaataaatcctaggaagagaaagaataaggtacttgatggaaaataacagaggatgacagcgaaggaatccagtgtttttcatgtgaaccttgaaaactcctagttttggcaatttattgatgttttaaaatatgcagtaaacaattttcatatagtactattaaaacttgataatcatctatgttttctcctatttatttttttcttttagcatttattagccattcaaactgtttattctctatatatgaaattcagggtgtattttagtttttattagatcattgactataaacatttgtttgtatttcagccaaatgaaaagacccgtgatcttgtagcaaatacacatattaactcatcttactccctcctctcatgctccagttcagccaagtggagtgatttaattatgtatgtgtagacttagctggcaaaatatgttttaaaaactatattaggccgggtgcggtggctcatgcctgtaatcccagcagtttgggaggctgatactggcatatcacctgaggtcaggaatttgaaactaccctggccaacatggtgaaaccccgtctctactaaaaataccaaaaagttagccgagcatggtgacatgtgcctgtaattccagctactcgggaggctgaggcaggagaattgcttgaacctgggaggtggaggttgcagtgagccgagattgcgccactgcacttcagcctgggtgacagagagaaacaaaacaaaataaaacaaaactatattaatggttttgtagtattttcataaaaatcttttttttttctgagacagggacttgctctgttgcccaggctgaagtgcagtggcatgatcaaggctcactacagtcttgacctcctgtgctcaagctatccttccacctcagcctcccgagtagctagaactgtaggcatgtgctaccacacctatttattttatttatttatttatttatttatttatttatttatttatattttcagagatgggatttcaccatgtttcccaggctggtctcaaactcctgggctcaagcaatctgtcctcctcagcttcccaaagtgcagggattgtaggcatgagctaccacatccggccatttttcaagacttttaaatgctaaatttctattttgattgaaagatgaccattcaagttcacttaaagtggctgaggtgagaggactgcttgaggcaaggagtttaagaccaacctggccaacatagtgataccctgtctctatttaaaaaaacgaatttacctaaagctaatggggtggtagctttcacagaaatccagaattttaattgtgaaagttcctgagtctcttttaagaaaatgaaatagtaatccgaaatttactccttttgtcttggaaaactttattgtaagttatgtgaccgaagaccaacccagaacaagaatgagaaaattggagcaggtcataatttggttgttgattgaaagcttccctctctcttaaatgggggagtgggagggagcggaatcttgcccgtttttatctgcattccatcatgttaagaatattatgaaggaaaaatttttaaaccctaagttagtcctatttatggtatttcaccaaagcttaatgtattcaaatgaaagagctttttgttttatcagaataaatgattatatttctgctcttagaatttttagttagatagtattgtctttgctttatacttccaattataaatctcagccctaacaatctacttaaaagtttactttttttcccttttgcatttattactactctatcccagaagacattttgggatatatgtctatatcccagaagacatataactgttataaaagataacagactagtgtctttgcttttcaccaagggaacaacattccttattaatgaggcacattccttattaatgactagaaaagggatatcattgatagcagtatcttaatatgccattttgggagtttctagaaatcagctgaattccattactgttaacgtaggcaggtattagaatctcttatccttctcatgtgagtgaaaactgtggcatagagaactgacttttcagctgcaggctgccagaatatagtgggccttgtaagggtgggagtccttctgccaaggagctctgttcatgcgctgtgtttgactttcatttcactttatcttgaatgtaggtttgccttatctgagaattcacaaaaaggcgatttttaagtggtttagtaaaatcactggagtgtgggatttgccagatttagcatactcataggatgcctaatatatctgaaatactgcgtaggacatacttacactaaaaaattatttgttgtctgaaatacaaatttaactgggcatccaatattatatctgacagacctactagggtaactataatttatcatccaaaccagaacagttttgagagtgaaacggggctctattcataattatgccagaacagcaaacataaactaggactatcccagaaaaattggaaagtatagacaacctaattatataaggggttttgaagtaatttttaattatgaattttaaattttcataaccaagcacatctctatgtcattaacttatgtggctgtgaatctttataagtgtaaagtgtattgctttgtaattttttttttttttgagagacaggggtctcactctcaccctggctggagtgtagtggcactgttgcagttcactgcagcctcaaactccaagtgatcctcccgcctcaacctcccaagtagctgggacagcaggcatataccaccacacttggccaattttggggggagagacagggtctcactgtgttgctcaggctggtcttgaactcttgacctcaagtgatcctcccccctcagcttcccaagtagcagggattacaggtgtgagccaccacgtgctttataatttttatattaaaattttgattagggcaccttaaaaactatggtgagctaactgctagcttcagccttggtacttggttaaagttctcctggtggtaggaggctaccacaagcacatgagattctacagtttcgaatttttaaaattatttcttctttacagttttgttttgttttgttttgttttgagacagagtctcgctctgccacccgggctggagtggtgcagtggtgtgatctcagctcactgcaacctccacctcccaggtttaagcaattcttgtgcctcagcctcctgagtagctgggattacaggcagctgccaccatgcccagctaatttttgtacttttagtagagatggggttttgccatgttggccaggctggtctcgaactcctgacctcaggtgatccgcccacctgggcctcccaaagtgctgggattacaggtatgagctaccgcacccagcctctttacagtatttttatatgtgtacttcaccatcagcagttataactttgacaagaaatcccttgtgttttttttatttggcttacaccttctcttttaacttatttactttttgttttttggggtattaagtaataacctattattcatatttagcttcattttcttaattgtatagccttttatcatcttcccttgcttaacccttgactaatttcattctaaaaaatcatccataaatatttgaatacctgctatcaatgtgaactactctcctaagtactacagtaaatatgacatgtaataagacttggaccatatcctcaaagagtgtatagtctgtacttaatatagaggtctctccatagctttgtatatttcatttggtcttttctctttttcagcttatatctcttttaaaaatatattaatctctttcaaagtatgattatctgtatgttagaaataggtgttccatggtttttgaatagaaatggtatgtttttgttttattcttatatctgttctgttgatgcataggtttttataggagtgttttttttgtttttgtttttgagacagagtctcactctgtcggccaggctgggttgcagtggcataatctcagctcactgcaatctccaccctcccaggttcaagcaattctcctgcctcagcctcctgagtagctggggctacaggggcccgccaccacgcccagctaatttttgtacttttagtagagatagtgtttcaccatattggccaggctggtctcgaactcctgaccttgtgatccgcccgcctcggcctcccaaagtgctgggactacaggcgtgagccaccatgcccagcggtttttataggagttttaactacattaggtgtcttcaggaaatagcctataattgctagataatttttttgtgttataatttataaattgaaatgaaaatgtgtcagagtccaatatacttaaccaacttttgagcaatgagttgttccacataacagttttccagattattttacctattaacacttacaggattagtgtcaggtttctctaaaggaaaaatattccttaaattattttcttccttttattgtttgagggttaacgcttgtttcatataataatgttaattttcacccaggctgaagtgcagtggtgtgatcttggctcactgcaacctcctcctcctgagttcaagcgattcttctgcctcagcctcccaaggagttgggattacaggcacccaccaccatgcccagctaatttttgtatttttagtagagacgggcttttgccatgttggtcaggctggtcttgaaatcctgacctcaggtgatccgcccgccttggtctcccaaagtgctgggattacaggcataagccaccgcgtctggccttactgtttttaaatgtacttcacattgctctttttgttattttgaaaagatacaaaattattttgcttcatatttatatagtaaaaaactcaaatggtacaaaagcatatatagggcaaggtcatccctgtctcccagccaccagttctcctcacccaagataactagttttttatgagtattttgtataatccttctggagattgcatttacaggtgattatttatatattctcttttttctttttttttatacaaatggtaatgtatcatacacagttgtgtactttgctttttttcacataacactatgttttgggcattattccttaccagaataagctcttttcttctttatacatgcatagtattccaccttacaaggtccctactaatcacttttttggttgtttccaataatttgctattatatacaacgtttaattaatagccttcatgaaggcatgaatatttgcatgccttaagaaaatttttttagtctaaaggtaatatgcatttatggtaaaaacttaaaacactttaaatattaccaaaaataatgcagtgaaaaataaatcccctaaacttctagtaccacttcccaaatgtaatactttcttgtgattatcaatttgtttgattttttttcttcttttccttttttaaaaaataaatggttgtgtggtatccccactatatatgtataaatcataacttatgaagttcctctttggtggacatttaggatgtctccagagtttttttttttttttttttggatgctacagacaatgctacagtgaaagccttgtagatatctttgcacacatgcaggtgtttctatcaagtagagtcctaaaagtacaattgttagatcaagtaatgtacacattttaagttttgattagttttaccaattggctctctaaaaaggtaatactatttgatacttccaccggtagatccttgctaactctggctattatcaaacttttgatttttaaaaaaagtttgccaatttaataggaggaaataaatcttattcctatctgaatttcatttattatgactgattttgagaatttggccatttctgtttattatgaattttcttattgatttttttttttttgagacagctctggagaccaggctggagtccagtagcatacggttcactgcagcctcgacctcctgggtttaaacaattctcccacctcagcctcctgagtagctgggaccataggtgctcaccaccatgtccagctaatttttaatgtgttttttagagatagagtcttgatcctcttgtagttcatgagcttgataattaggtgttcacatacatgtgtgagacgtgccaccctggaaccttgttacaacgttggcacattacccatttgacatgaagggaagggaaaaaccaagagagacggagtctcactatgttgcctaggctgatctcaaactcatgggctcaagtgatccttccgtctcagcctcccaaagtgttggaggattacaggcatgagccaccacaccttacctgttactgacttttgagtgtacttttttctatcaagaaattagtctgtgatcacatacgtgacaaatattttttctcattttgtcattttctaccttgtgcatggtctgtaaatatacataatttgaccctggagagagaggagtggagggtagggagaggtaagggtaaattagtggaggatccatatcagtcaagctgctaaccactttttttttctgtaagtgctaaacacattttaaataagaaaaatgattagccaggtgtggtggcatgtgcctatagtaccagctacttggaggctgagatgggaggatcacttgagcctgggagatcaaggctgcagtgaaccatgcatgatcaggccactacattccagcctgggtgacagagtgagaccctgtctcaaaaaaataaataagaaaaatgacgtgacagaaacaatagagggcttttatctccttagaggaaagaatataaaaaagactatataatatttagttggtatgaagtgtagtaaccatgctgaaaatgtatttgttatatgtgtttttccctctagaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaatgtaagctctatttttttcacattaatattttcaagtactgtgaactcagagactattgcatatgcattcagtaatattcagtgatattttgatattttaaaaatgatataactcattaacttttctgataaatgaaacactatggacgttataaattcctcattagtttgcccaggtatattggagattgagtcaaaatcatgaatttaagtaggacaaagttttttgttcttgtttaacttttagaatacttttgtgttaactagattttttttcttaagctatcaatttttttcccttaaaactttttagggaagaaagttttgaaagtttaagttaggccacatacagtggttcacacctatagtcccaacaatttgggaggccaaggtgggaagatcacttgcgctctagagttcaagacagcctggccaacatagtgagacctcatctcttctaaaaataaaaattagccaggcacggtggctcgtgcctatggtcccagccacttgggaggctaaagtgggaaggtcacttgagcacaggcaatcaagactgcattgagctatgattgggccactgcactccagcctgggcaacagagcaaaaccctgtcttaaaaacaaacaaacaaaaaataataaagttgaagttaacagatttaatcatttagaccagagtcagcaattttttttctgtaaaaggctagatagtaaatattttaagctttgagatctatatattctctttcaaagctactcaacacttgttataaaacaaaagcagccacacttagcatgtaaacaaatgaacatggctgtgttccaataaaactttatgtacaaaaaaaaaatcagtgagccaaatatgatctaccagccacagtttaccaatccctgccctagtggcttctatttgtacttagaatgaaatgaatttttttctaaattttattattattatactttaagttttagggtacatgtgcacaacgtgcaggtttgttacatatgtatacatgtgccatgttggtgtgctgtacccattaactcgtcatttagcattaggtatatctcctaatgctatccctcccccctccccccaccccacaacagtccctgaatgtaatcaaatttttactgcagccttgttagtaagactctgtgtacctctaccactcatctcctagcacttttgctcactttattctggcccacagtggctgctttcttttttcaagtacacagagcacattttcatgttggggcctttgctctgctattcttccgcctagaacactcttccaccacttgctctctgacctccttcaggtatctgcttagagaaaatctgagaggccttcccttaccactctgcccatcatcctccatccccttacaatgctttatgtttctccaaagcatttcacattgcctggctataccttatgtacttatttgttggcttctctgccttctctactagaacataagctccatgggggtagggatatgtctatcttaccactgttttgacccaagtacctagaacagtactgataaataatagttgctccaaatttattaaataaatgagttccatgttacctcattagtgtctgactagtgacaaatgtttttgtcaatattgggaaaaataataatgttttcttttatttttaacagaatggggtttctgttgaaccagtctggtcaccgtcactcccattcccactccctgccttcaaattcccctaccagaggttctgggtgtgaacgtaaccatgggcaggatagcctggcagtgagagctgcatttgtacatgctttgggagatttggtacagagtgttggtgtgctaatagctgcatacatcatacgattcaaggtaatatgattggtaatttttctattttaaaatgtacttaatttcaacatgaaaactaaggctgattgtcatatcagtatactggacaccagtgccagttctattcattttacattgatgtaagtttacttgacaatcattatagttcttttgttagcagtaaacaaaatgatatcacgtcacagggtaacttatctgtatttggcttttgtagtgccttcactggataaatcaattttcttatttatttatttatttatttatttttgagacagagtctcactttctcgcccaggctggaatgcagtggcacaatcttggcttactgcagcctccgcctcccaggctcaagtgattgtcatgccccagcctcccaagtagctgggattacaggtacacaccaccatgcccagctaatttttgtatttttagtagagacaaggtttcgccatgttggccaggctggtctcgaattcctggcctcaagtgatccacccacctcagcctcccatagtgctgagattacgggcatgagccaccatgattgcccagataactcaattttaaaactcgtgattgaattactaggtagtaaaatgtgcactggactgaaaatccagagatctgagtgggttctagtcttggctctgccattaatgctttgaccttgaaagcaaatacctgaactctaaacttgagttccctcttctttattacaaggggcttaaactagtggctgctaaaactttttccagagctgagtacagtggctgtgcctataatcccagctgaggctggaggatcagttgagcccaggagttcaagagcaacctgggcaacacacacacacacacacacacacacacacacacacacttctttccagctctgacacacacacacacacacacacacacacacacacttacttctttccagctctgatattctagaacatttagagatggcacaaggaacaatagaacaagtgattacatttctggaaataggtcccatgaggcaagtaacgtaaactgtctaggatagagtgaagatgcttttcaattacaatatccaagttttaaaggtattctgtaattctgctaaagaaaatcaagcaagaagggacatattccttgctttgctttgcagtctgttttatatttgtctatttaatcataaattttgatctattaccctttagccagaatacaagattgctgatcccatctgtacatacgtattttcattacttgtggcttttacaacatttcgaatcatatgggatacagtagttataatactagaaggtaagatctcactatatcctcattatgagtttattacttccctaaagcagattgggagtcaggggacattctgaataggaattacatcttttgctttttactaataccttttaggctatataacagtaccttacatgtatgtaacatgtaagaattaatgaactctcccatcttttacccatttgacacttataatagctaagcaaagtaggtaaggcagataatgtggtaaattatccccatttacaaataagaaaattgaggttcagagggataacatactttggttaaggtcatgttgctaataaactgtggcactaggacaaaaatgcaattctagattatgtattaattccttaattcccacttaacttgtgactttgttgtatttactgcattcttcccttactgatattatgtgtaagcatgaaaataaaagttcttaacaataggcttattatcattatatgttcttttcttttcttttttcctttttttttttcttagtttatctgttaatgaagtattctggtttgattggcattcctttttagtgagaatgaatatgtttttaaagtatgtattaccctcttgtatatatcttacatttttaataaaaatatatgtgtacatggtttatcttgaagtattaatattttaaagtatttgtttaaagtgaatttagcaaagccatttgttttctttgataaatgtcatcggtaatgtaaaagttcctttatttccaaaataaattttacttagaaattatatattcctaataggtgtgccaagccatttgaatgtagactatatcaaagaagccttgatgaaaatagaagatgtatattcagtcgaagatttaaatatctggtctctcacttcaggaaaatctactgccatagttcacatacagctaagtatgttgctggtagtaaatgtgggcctggggttggtggacttctgcctttgaaactaaacatccctgcttataattatgtaggaagacttttctgctgaaaagatttgttttaagacaaaagcctttgtctttaaaaaacaaaggcttttgttaacagccttaaacaaaaggctctttaaagggtaagttgcaggtcagtattgataccagaacaataattttctatctctttgagatattacaaactgattttaaccttcagattaaaggtattaagaatatttcctgactggcatggtggctcgcacctgtaatcctagcactttggaaggctgaggcgggtggatcacctgaggtcaggagtttgagaccagcctggccaacatggtgaaaccccgtctctactaaaaatacaaaaattagctaggcgtggtggtgcatgcctgtaatcccagctacttgggaggctgaggcaggagaattgcctgaactcatgaagcggaggttgcagtgagccgagattgcgccactgcagtctagtctgggtgacagagcaagactccatctcggaaaaaaaaagaatatttcccggcctggcgcgttgactcacgcctgtaatcccaacactttgggaggccaaggtgggtggatcacctgaggtcaggagttcaagaacagcctggccaacatgatgaaaccccatctctactaaaaaatacaaaaattagccagtcgtggtgacacgtgcctgtaatcccagctactcgggaggctgaggcaggagaattgcttgcactcaggacacagaggctacagtaagccaagatggcgccattgtactccagcctgggcaacaagagcgaaactccatcttaaaaaaaaaaaaaaaagaaagaatatttcccatgctcttttctacataggaaaagctagattcttacatttttatttcttcaagtcatttcacagattgatgctattgatgctttttaaatcaaaataatacatgcatgaggtttacttttaatgtgcacaagatattttaatgacaggtttgtaactgatgtctggtattttttctctacctgagagtagactggagaggttagaataatgagaagccattaaggatgtgtaaattgacctacttatctaacagaatagcttagagagggtagaaatcagactaataaaaatatattcccagtatatttcagttgtttttttccctgtatcttattcaagatgtaactgtacaatggatagtaatgatattttcttgacattgcagttcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaattttatgtattttgggaactcctgccttatttatcctgcagtcacagacttgagagcaataaatgcaaacctaaatgagaaaatggaatccctgacagctgtgtccgtatcaagcatcagtctctcaaacagttgccccagcctgacagtgctagtctctgtttaatggtaaaaggagactttgccataattttcagatgaagatgtttcccaaacactgtttacagaatgagatgtgactctacagatacctcatagaagacaatccaagatcatacttcattaacttgacagagtacgtgtcttaaaggaagcatcaagaattcaatatttgcatttaaaaatactttttaaggccattttatattaagccagtgctggaaaactgaattttttttattatgtataataatctcgacacccagcttctggaattgctgctttctttttacagaaattactacccaacagatttcaggaagtactagtagttatcccaaaagtggaataagcatgtattcctaagtgtttcagaaatgttttatttcacacataagtcttaatgttattgttatgattatactttataaacaaccttttccagatgctacagggttttgaatctcaaagttaacatttttcattatttgtaatcttagaaccaaatctttatttattgtggtcactgttattaaatgatttaggaaatactttcaatattattctgaatggctgaagttagtcttaaactcaaattactatatgatgatttaaaacaaaataaaagagcgaggatgggggttggagtttcaggtttatgtcttcccgacatcacttttatcattcatgaaattgtcttaaaaaagcaagagactgcaaaatgtaaacagtaatcttctgtccctttaagaactgccaacaatttgtacaaaaaatgtggtacgttggttcctgcctccactccaggtcatctgtgtgtttagcctttcagggtaaactctagagggttcagtttataattcccacctttcacatatagttcaacaacattaatccagagagaattttatgttttatgatatgggttatgttttattatatattttatgttttatgatatgggttagggattctccatggactccagaaaccctaaaatacaattttgaggttttccaataataccatagcagaaatgtccaaggggttgggggaagatattactttgagaaaacagaaatgtaaaggatttttgaccttatatatgtgtgtggttttgtttttgtttttgttcttgagagagtctcactctgtcacccaggctggagtgcagtggcgtgacctctgctcactgtaacctctgcctcctgggttcaagtgattcttctgcctcagcctcccaactagctgggactacaggtacaccacacccagctcatttttttgtatttttagtagagacagggttttgccacattggcctgtctggtcttgaactcctgacctcaggtgatccgcctgccttggccttccagagtgctgggattacagcatgagccaccatgcctggcctgtatgtgtgtgttttaaagcactagatagggatggacattaaatctgtgttgcagggaaactaaacagaggtttccaaactgaaggcaacctaattgtaaatgcctgtgttaaagaggcagcttgactgttcatgtttcattttgcaaccattggttttgagattatcttttatgcacatttggagtcccttttcaacagtgacagtttcttacacgaagaatggatatggttattgggctcctctaagaatcagagtagggtaacaatgtaccaggcaaattgtaagttgaaattctagataagcatgcagatgacttacaatataaatgaagaataggaaacattttatcttcttaccaagtaccttactataagtaaacctaagataagaaaacccagatttacctataagattgttgggagttaatggtgtcaataaaaggattgatggtccctctaatgaaacccagtagatgtttgttgaattgaactgaaaatttatgtggccagacacagtggctcatgcctgtaatctcagcatttggggaggcaaaggtggaagtatccctcgaggccaagagttcatgaccagcctggtcttttgtagagaccctgtctctacaaaaatataaaaatcagccaggcgtcgtgcacacctgtagtatcagctacttgtaaggctg

SEQ ID NO: 16446 - DNA, 12322 bp, Human
cccgggaggtggaggctgcagtgagccaaaattgcaccactgcactccagcctgggcaacagtgaaactctgtctcaaaaaataaaaccaatagagatgcctgttgatagacaagttttctttttttgacgtgcttgttacaactatagccatattggagatacacgtgtaagcagtttgaatgagaaagtctggaataaattatgttgcaggtgttggaaaacaggtttatcaggaaaggatttgattacagaagtttagaattgtaaaggacttcaaaagtgattagtggcagaattggggctggaatttaggctttctaactcacagttcataatattttgatcccaaaacacactacttgtggttggaagaaaacaggttttgcagatatgattttacaagtctgtgccctatctgtgaaggacatagtaagtgcttgatctggtgcttgatgcagtactcaaatgtgtgtttaggaagctaagaatgaaagtgatgaggtgacttaacacaggattttttttcatttaaaattcttaccttgtatcatactgtgtgtatatctcatcatacctccggctcacccccacttagctaccttacagcagggggtggtcctgatttatctctctgtcctcactgtgcccagaacaagaccttaataataggtgctctctaagtgcgaaaacagatttgtatgtgaaacagttgctacattctgacatctgaatagaacaattccaaaggaggaaagggacgtctagagttacctctatctgagcattccccgtgttcactcagttggaggttgggttctgtgtggagaaaaggagattgttcagggaaagtaagtctattactactgcattcgaattgccctgctcagtccaaggtaccagaggctctcttaataacattgagttctaagttcctggccggccctgtgtcctttaatcaaacagttctaatagataataggaaatgagagatgccactagattgggcagacagatgtgcctgattagggactgcgagagcaaagagtggccaatgaatgcctactaagttttaaaccctagcctgggagttgggctttacagcagtgaagacaacagacgaaaatctttgcgttcatggtgtttaaattctgcagggtggggagcggagaataaaaaagtacggtagatagtatgtcagatactgttcagtgttaggaagaaaaggaacgggaatggccaaggaaagcgtttcagaaaagataatatttgagggaaacaatgaagtgaagccgggcgcagtggctcacgcctgtaatcccagcacttcgggaggccgaggtgggcggatcagctgaggtccggagttcgagaccagcctggccaaccagcctggccaacatgttaaaaccccgtctctacaaaaattagtcggacgtggtgtcgcgcgcctgtcatcccagctacacgggaggctgaggcaggaagaatcgcttgaacccgggaggccaaggctgcagtgagccgagatggcgccactgcattccagcgtaggcgacagagcaagattccttctcaaaaaaaaataaaaaaaaaaaaatgaagtgagagaaagtagtatgttatgtgccataattgtcatatcaattatatatgtttagattctggttatttgtaggcagtttgtctcaatctggcctactcacagctcaggaaaaaataatgaaagagcttcgccaggtaatttgggaagttgaaagaaaggagtccgggcctctaaaaccagacagaaaataaccctatcttatccctaattctgtttcacaggagaaaagggaaaaatacccaaaacacaaacactcaaagcttcctggccctttaaaaatggcggttccgcactggtcaacaataccattggttacccgaggcagaagagggcgggagcgaaggggtggagggcgtgtcggcaccgaggaggtcccgcctcctacggcaagtcggaggtagcaagatggccgccgctgaggaaggctgtagtgtcggggccgaagcggacagggaattggaggagcttctggaaagtaagagcccatagtgggaaaggcccgaagagggcacgtgtgaggacccattctgggggttaagtgaacctgagatattagggacgggcaggagaggctctccaaaggttaaatgggggcggagagtctgacccccgagccccccaaaaatctctgggtcatcctgccccaccccggcgactggagctggggagctcacctggggtccctcagtggtccggatggtggatgtttccgcaggacggcgtttcatgatacctcttcaaactcctctttaggttactgagttcttaaagttcgacttcagcagcagtagcagcagcagcagcatttggttcttgctgggtagcgaactacgcactcactgattgcttacattaactcctagcaagctcgtggccggtccttgtgtgcctcgtcctgtcttccttaacacgaaagacacttttctcctcctagtccttttctctttctctcgttaggccccttaacagttctttcatcttgtcagtagctcaagcggactcctttcccttattttgagaaactgaggatgtggcgatttcaggggaaagcagttcaccctcctgaaagacgggggatgttttcttagcattactctccactcccctgttgacttcctgcccagagtagggccagtgctctctccctaggcctggcgaacagaatggtggtgaggacacaggcttttcagggcagaggtgaatttgtaatcgcttgctcaatcacggagatgtgggcaggcagaaaaatgaacagaaaccctgaggagtgccaagtgactgtgtaaattagtgtacggttatctgcagagatcaggccaaagggagctctagaaggttgttggggagcactaaactggagaataagagaagatagtttaatgccgtaccatggagtctggtatgtagtccctcagtctgtgctggtaccagtaccaacaggaagctgggtgggatgtcctgtgctttctcaccaagttattccttttagagctccagagtgagttcagagggatgaggacatctgtgttctctactactgttgggtatttgtatgggatttctagggaatcgttagggtgtggcaagggagacactatagatggagatgtctctgcagaactttttaatcctctcctcccagctctgagatggacatttgttccaccttaagggatttctttgcctttgctcacaataaattaggtaatccagaaggaagtaggaggctcattgagggtggtctggggaggtgggggactcaaggaggaaaattgaggaaagttggcaatttgaaaaatcatattcctaatgctttgcccagaaaccacccagccttgcttgcattctcatctgtcgccaacacacacaccatgtctcttgtctctgaaggtgctcttgatgatttcgataaagccaaaccctccccagcacccccttctaccaccacggcccctgatgcttcggggccccagaagagatcgccaggagacactgccaaagtataaattccacccccttaagggatggggaggggatgggcatgcagccctgagcagaggttgggcaggcccctatgggccagaggggaatgtgggagggtaccttggcctcacattggtgagtgctcttgccagcctcagtccttgtgaaataaggacttgaggttgagtgggggaatctcagagttccttgaaaaaatagtaggtttaaatggttggattggtatgccatcccataccctccttcaatgactagataccttttttgctatcctcattaggagcagtagttagaatgtccagtggaattgggtaggagggaggtgcatttcccatagccactgcctgtggcttctatcagaggccaggtgcagtgtagtcctaagtaagagacgcatttcagccatccttcccccgcaggatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggtgaggagaccccagatacatggaaatatctgaacagactcttaagtctttgttgcctgaaaacaccagaattcttagtgaagttgatagcaatcatgatgtcacagccaaggaacgggtaaaggcaatgagagaaaggatgggaatccctgttaatgaaaaggggtgagataggttggaaagtaatagaaaacattattcaaaactgaccatttgaaaggtcacagtgttattgtgggtatcatcatggagaataaactgatgcagagtccgtgtactaaatagatttatgaaaagactatgaagataaccatagggttttccaagattgggagtgataatgattcactagtaaatgcttcatatccaagctgttaaccagttcagtctaggcaaggaaacaaactcctaaatgacgctggcttttttaatctctcctaggcagtgatatgacctcccaacaagaattcacttcttgcctaaaggaaacactaagtggattagccaaaaatgccactgaccttcaggtgaggagaaagtagtaggggcccacaaggggtccactcccagacatttctccagcagagtctcaaaagacagatgctttgagtatcatcccaagtctgttgctgtcttattgtttgttacaggcaagtttagatagtttatctttgtcacctgagagagtggtgagcatcccaagaaggtagtatacctgctcacctcttacttgtcctatctagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaaggtttgtgaacttccatttctgctttttctcttcattctccatcacatcaactgatgtgggctattttgtctactcagagcctgcagaaagagtaactcgagtgtgctttttttccttctttatttatttgaggcagggagagttgggggttggggagagttgtgtctctgagagaataaagctgtcacacggtatgttggggtataagaggtataacgtttggggtctaagaggaaatccttcagttctagttttctataaactggttcaagactctgggattgttgtctgatcaatcttgcatttctgacttcatttctccagcaagaatttggctgggcatggtggctcatgcctgtaatcccagcaccttgggaggccgaggcgggtggatcacctgaggtcaggagttcgagaccagcctggccaacatggtgaaaccccgtctgtagtaaaaatacaaaaattatcctggcgtagtggctcacgcctgtgatcgcaactactcaggaggcagcaggagaatcacttgaacctgggaggcagaggttgcagtgagctgagattgtgccactgtactccggcctgggtgacagagcaagactccatctgaaaaagaaaaagaattaactgaggatttacttactggctttgtgatgtgaacagtgtaagcgtagtttaaatgatggtccctgccataaaagagcttatatgtgtggttgtatcattttgttttgagacagggtctagctccagttggagcacagtggcacgatcttggctcaccacagcctccccatcccaggctcaagtgtttctcccatctcagcctcctgagtggctgggactacaggtgtgtgccaccatgcttggccaatgttttcaaaattttttgtagagttgagctctcactatattgctcaggctggtctcaaactcctgagctcaagtgatcctcccacctcagcctcccaaaatgctgggattacaagtgtgagccaccacacctggctaaagagtgtatagttttactggagagataaaatacaggaatagaagcttttcagtgacatggggaaatgtgggtaagtgtgtaatgaatagtacagaccacgagtcagcaggccaagacctgggtgggacaaatccaactctctagcaaataatggtttttacatttttaaggtcatttgaaaaaaactacaaagaaaatgtgcaatagccgagcgtagtggctcactcctatagtcccagcgctttgggaggccacggtggacagattgcttgagcccaggagtttaagaccagcttgagcaacatgatgaaaccctgtctctacaaaatacaaaaaaattagccagtcacagtggtgcacacttgtagacccagctacttggggaggctcaggtgggaggattgcttgagcctggggagatcgaggctgcagtgagtggtgatcacaccatcacactccagcctgggtgacagagtaaaactctgtctcgaaaaaaaagaaaaaaaaaacacaatagagaccatatgtggcccttgaagcctaaaatattcactgtctggccctttacagaagcttaccaatctctggtgaccataaatgctaacatggccaggtgatctggttggagtcagtgccgcttttcatgatgaacttacttatttagcttttcgtttttctacgtccctttccctttcacattttaatcacattgttctgattacccatccatatccattgttcacttaattcttttccacccattctctcttttcttagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcaggtaaggcctcttgccttctgcccactggtgctgtccacttaggtgttcagtgaaggaagtatctgggaaggatgcaatactgctagacctaggtggaggagggatcctctcttgtgatctctctcagaagaaatagagagatcattcattagattcctcttctggatcctctgttgttttctgggcttttctctatttcatgttccattttccttattttctagctacaagatttaggccatcctccaaaagagctggctggagagatggtgagtatgtcttatttttccagattttaatttgagtccccaatttccagaattctttaacctctcaggattccacctaaggtgaaaattgtggctactggggatggatcttcacgtctgtcctaaaaaatgagcaactatctgagtcccttcatctcttccccagcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataattgggacattttcctgtgactctggaaggtcttgtcaaagccccatgaggcagttataatatgatgttaagatggctttggggagctaggagaaaacattggcccatattgaatgacgtggagacggcagaccatacaaaaaaggaccaaaagacttagaggaaatgggtatgcaagaatgaatgttatataacactggtaaacccaccagctgactaccccagaaagacctgggaattattttttaataaagacaatgggaaaggcactgatgaagggttaccagcatctttgagaaatttagaagtggctgtctctctagatcgaagctgatacaagatgtaaaagaaactgttttcctagtagcagtgggggaatgataggatcctgacatagcagaggccaggtggcaacacttaactctcagaagcaaggtgagtaaatttccttaagggtagcaaggtcaaagtggagatggctaacggaatgtgagtggtcctaggagcaggatagatgggcaaccaagaagagtattgtcttatatataagggagatcaagaatggttgaacagaaggctgaagtcagaaacttcaaagaaaagtccccatttcttgtccagtttttaagcctgagatagttcttagactcataaactatcaatggaaagagacatttatcagttaatcattgagtggaaaagcactgttcatcctctgttctcacaccacaatgagtgacacagaactcttctgtaatcacgtgtggaattccctcccctcaacaagcaagcaattctgcagtggataacagctggatatcctctaatttactttaattctgacactgtctacctggagacagtgtcagatcccacaggttgaccaatcaatcactgagactctcccccccaacttctgatgtcaattgcaattcctgggttattttgcctgtgctataaatcagggtgtctacagccagctccttgggtttggttaatttgttagagtggcccacaaaacttggggaaacacttacttacatatttcagtttatttaaaggatattacaatgaatatagatgaaaacatggctggacccagtggctcacgcttgtaatcccaacactttgggaggccgaggtgggtggatcacctaaggtcaggagttcgagaccagcctggcgaacatagtgaaaccccgtctctattaaaaaaatacaaaatttagctgggtgtggtggtgcatgcctgtagtcccagctacttgggaagctgaggaaggagaattgcttgaactggggaggcggaggttgcagtgagctgagactgtgccactgtactccagcctgggcaacagacagagcaagactccatctctcaaaaaaaaaaagatgaaaagatgtataaggcaaggttgcagagcttccattccttctctgggcatgccaccatttaggacagcggtccccaacattcttggcaccagggaccagtttcatagaagacaagttttccacagaggggggtggggggatggttttgggatgaaactgttctacctcggatcatcaggcattagctagattctcataaggggcacacaacctagatccctcgcatgtgcagttcacaatagggtttgcactcctctgagaatctagtgccactgctgatctgacaggaggtggagcttaggcggtattgctggcccacctgccactcacctcctgctgtgaggcccagttcctaacaagccatggactggtactggttcgtggcccaggtgttggggacccctcattctataaaccctcatgtgtttgacatcttggaagctgtctagatcttgtctttttgggtttttatggaggctttatatataggcatgattagctgaaccattggccattggtgattaatttaaaattcagcccctctgtcctccctagaggtttgggggtggggttgaaagttccaaccctctaatactgctttggtct

SEQ ID NO: 16447 - DNA, 13916 bp, Human
  misc_feature (1)...(13916): n = A,T,C or G
tggtcaggctagtcttgaactcctgacctcaggtgatccacctgcctcagcctcccaaagtgctgggattacaggcgtgagccaccacgccaagccaacattatatttttcatggatcaggtgtaaagttgttgctgagagacttagaggatttctaagtacggaaagatgagacctgagattagatatattttcactctccacagacaagtccaggaagtgttcctagagaatgtggcaggggtgtagaaagcagaaactatgtattcattccaacttgtagctatttaataaatgtttaataagtagtatgggcactaagctagtcttacaataatattgtggagcttactgtctagcataggtcagtggaaggccccggtctaaataatagctcctattttttaagcacccatctgtgccagtccctagagacttactatttctgaatctcagaagaaccctcagaaatagacattggcaccctgatctgaccggtgaggacactaaggctttcaggcataacttgcccaaggaatgggtggaactagcacgcagcccaaggcccctgtgtcttgttgcctccagacctgagcctttcacttagaaactacatgagtctcaaagatgggtcaacgaaatagtttttgtccctacaacacagagcaaacatgatatatacaaaggcaaatgattagtgtgtgacagggaatgctggggagaggaaacagcagagaaatgctatgaaacccagagcagcaggaacttgggcctcttctaggaatggtgtagacccaagaaaggaggggctcgtttgaggtttctggaggagtctctgccaggtaggaactgagatgagatgggtgatcctggaagtggcacaaacactgaggggaatcccccaacctgggcctgctggagttcctggcaggaaggacctacccagggtcagacttctttccagggccaaaccctgcccagagctgaggcaagaccccttaggctatagagatgggggtgaaaacagatgcttctccaattcttcctttcctcttttcagtctggctgagaatctgggggaggaaagtccctggggtagaggggaagtgagagctgccacattgggcctgggcagaggggcagagctaggagatggagctaagtgtggctttgcaagttgtctatatttgcatgctgagctcactgctgctctttttctccccagaaaataaaattacatcatggtagggggaaggcaggagtggggcatgtttgggaaaggtgagaggcacgcaagagggcctgaaggcatcatcctggaaagagaagatccagggctcctcaagtccccatgtggccccaacccctcactcccaatgtggataagtctgatcagtcattttccactgcgcccctgacccttaaggcaaggcaagaagtttttacaaatattaaagccagcagctaagagaatccagcccccaaaggctttccaaccccctaaaccaaacctactctgtgcctcccaggggtcctaggcaccgtggtcatccaaaggtcaaaaggggaggagggtgccctactgggtaagaattaaatatgagaattgtttcgcagttcagggggaagagaccgtctccgctccagccctccgcccaattctgtcccccatcctaggagtcttccagaaccccagcccctcggtcccccgccccctcctgcctctccatccctccccctccnnnnnnnnnnnnnnnnnnnnnnnnnnnnnnnnnnnnnnnnnnnnnnnnnnnnnnnnnnnnnnnnnnnnnnnnnnnnnngaatagaagtcctccccctcctcccgccattctccgcccccagcccctccccggctctgacatcaccggccagccgggtgaagtgagcggcgctgggctcgggctccggctccgcgggcggaagaggcgccggcgccggcagaagcggcggcggcggcggcgggagccgaggaggaggttccggacgctgcttaggaaccggggactcaggagtgcccgcgccctgagcgctcagctccagaggcggtgagaggggcggagaggagacatgtcgcggggaaggggcagatttcggggtctaggcttggaggggcaacgatctgggacaccgggggccagacggggagtgtggggaccccggacgagtccactttgtgtcaggcctcacggggtccgtccctcggtcggtgcgtcccgagcgccgagcgtgtgctggaggcggcgtggctccggccagcccgttccacgctgaacggcagtttgggagtcggaccggggcctgtggattaggatgcagcctgcttcccgcccagccggctcggccaggccagcgcccgcccctccctccccgctcaggcttcggactcgcctccgctggcggtctcccggcccagccctgtctcggttccgcgggcggctggtaccatgtgccctcacccccagctcactgcacctggggaagaggtgggcttggcggaaagcttgtccagagggaaggaggagctgggggtgtagagaagtgatgtatatctaacgtaaaaacccttattaatttcatataatccgtgtcaaaactgacagggaaacacgcacacctataaggcacgccagcacacacagtgacacacacccatgtgacttatacacatagtctagcacactccaaatcacaaacgtccctggactacgcatccggccgcccaccacacccccactctgtggggtggggcatcccatgaggagtcttctgaactgcgggctccaagtcatcagtccgacaggacagctgagtggacagaaagggccactgtccccaaatccatcctgattttctggcagcttttcccagccccatggtttcagattgttcctctttaaaactgtggggaaagatgggagaaaatcttggtctcattcctctaacacaaggagacaggattttgcggactaatgagggtaggggcttctggtggcttctcttcctgggtccagttagggcttagcgtgctgggagtggctagtttctgggtaagagtggccaagggatggaggaggagggggtggaagaaacggagaggaaaaagaatgggtatgagtcagccaagaatggaacccaagtcagagagagaatgagaggaatgtgtgtgagaagcagacagacatctccagagaggtctagagatagtcagggaaccagggagagggaggaagtgagagaaagagatggtcagagaagtgcaaacagtgtttgagagtgcactaaacaaattagggaggatgaaggttgggggagaccactgggagttagggaaagtggtacgtgtgtctgggccccaggctgtcagagcgattagctttaattgctcttccctttgtggttaaatactccattggggaaattgccagtgatgccctaggctgcaggcttccctggttgcctacttcctcaattccgtgcccatcatgtgtggatgtattatcatgcatgaagagggtcacagaatcacagagcgcctcactctctcacacagatcctcacgcacaatgtcatgatggatatcttcaccagctggtaggcagccaaccactgaatctccaagccactccgaccaaacttactctgtcttttgtagcagggatgctcaccccttcctaattgcagctccgaatattcagatggggacagtgaagcacagatctcaggagtcctaagtattcatggctaccactaagttggataggtgagtaggaaatgctagaaggggtgaaagcctatagaaaggaggaaaagagagactgaaagatgaagtagaaaggaaatgcatgacaaagagtgagagagatggagagagacagaaatagaagcagggagtgccacaccagaagagtggaaacagagatgggctggggagagtcctaggccccattcccctcctcgccatcagccggccctcctctgctctgcctgatccagtgccagctatctcctgatgccccatcttgggtctggctctttctagaccaagggctgaaggctaatccttgtccccatgcccaaaggtaatccattttgcttcttggactgaagtgaacattttagggcccagatgtcctgcctctcgtcacttccaggctgaccctggagcctcagaaccctcaatttccttgttacaggagtaaagacaaccccctcctcccccacaaagctggataaaaagcttaaagaagaaattaattgagaatgatattaaaggaaataaactacaggactgcttgaatttggggcccagttataatttaaaataggaaagctggacccctactctctcccttccaacccctctgcctctccgtgattacttccaacttcaggcagaagactgacagacttgagtgcctgggagtcccctcctgcccaatacagggacctctaggtccttgcagctgtctgggatggcccctcccctcaggcttaggcagctgcaacagatgtggaagagggacgggcagcaactcttaatcttcaggcttccttctcgaatttacagaggatttggaaccaaacgttagaagggataatctaccacgacttaatgtcaaaatgcacagaaattcttttggtgctgccacctcctccacaggtggttatcccaattgccaggcttctcaaagcactcccagggcctggctcttcttaccccagtgcccatggagctcccacctgtcccaccctaaaaggtcagtatataatggtccttacctcctgcccctcttccccagcatcctcagttggtttgacctttgtcagggctgtgcctggggccagcttggaaggagagggaggcaggaaggaaggaaggtgtgaggaagcggtgagcctagcacagaaagctgggagggaagaggactgacttcctggcagccggggctccggttcctgattcctgccctggtatcctgtcccaagaatggcctccgcccagactgcctggtgatccctgagcagctctctgcactgctccagaaatcaggaggatttttcagagcccagagagcagatttctccacgggccctaaggaaatctgaatctctggtgaggaaagtgacatggaggatgaaggaaacaagctctgccaagccccaccatggccaggccagaccagcccaggtacaactgttgatcagtgagaattgagagcagttcccctaaacaacactccctttgcttcttctgccatactaaggcctaggcaaatggatctctccaagaagggaggcaactgggctgcctttccttgtaccgtcagggggccttattcctatcctttctgtcccttcttactcaccattccctacactcctcccatctagtggtgtcatcctaacgactgggggtggggggcacccagaactgaggttgctatagtaacagatgagctgaggctacagccttctatagttgtggactgtatgctctcctccccctcgccccccatgcctcatttgcagccttagtctctttctgtctcccaactccagctctctttctccattctgtaggctcccctcacccctctggatgtgagcctgtggttatatgccttcttacacatgctcttggctggtttagacacatacaaacacacacatgacagatactcacagccagtgcacccacagccatatatccagtgctggcacatacacctccattaccagaacatccaaacacacccacagatacccagccactgcctcctccagagctgtgcccacaacccggggattagcatccataagatccgagcacacacacatttctcctctgccactttaacattcctacccccatctctcttaggggcctccttgtatctttcactctcttagaaagctcctacccactgcccccaagtctttgtgggtgagtgtgttacacacattaatctcttcccgcctacctcctctgtagatctgttttagattcaaagccctaaatctgaactcctcccgacacacacacacacacacacacacagacacacacacagatgcactctttcctcccgcaggatctgtaatatttacaaactctccttccatatgaaagcagggaagtataacccccaatcctgcccccttttccagctgagggcttggccccagagtttcctccactggggcagggtcttcttgtctcctgctgcgctttcccttccagttgtactcatgcccccctactcattcttatctccatctctagtcccctccccatcatccccctcacccgtacccccctccttctgtccttggattatcagtgaagtgaggggggttgggctccagagcttgctgctgtgacctagatttcaaggcagagacagttcctggtgctgacagtcagagagcattgttcctggcccggcctggcagggccactgctgggcccttctgtctggttgcacctgggtgtgcaactgagcatgcctatgactgcctgtttcttgcgggggtcatggtagccctcctgtctggctcattgtctgcctgtgtcatggtgcctgccaccaagggaggcttgtttattctggtccaggtagggggctgggaatggggacttctgggtctgtatctcttattttgtgaccaccatgccaatctcagttcccctgcagtagagcaagaaggaaaatgtgaatgtgtcaaccaagcccctttgatctgccacattcccagcctaatgctggggtgatttgcaggcagcctccgtcagggacaaggtcatcttgctgcttgcccaccccttggtctagtcgcatacagagtgtttatgatacaatttactttttaaaacatgctttacttttctgactaaaaggaaatagatactcattgtggaaataagttccatttttgagcttaccactagtgtcacattttatcaaatccagaaagtccattcaaacatctgaccttctttcttctgtcttagccacagttcctatcttagtggaaggaaggccttgaatgttctctacttctcacctaaggatcatgaaagagggatagggtgaaagcctaggtgagatctggccttgctgatctcatcagaccatgctgaaggtagtgccagtaggatgttgatacgatacgagaagggggggcagtccccttttgccattctcccaaagccgcatctaaagtcccctccccccaccacccagccagcctgggaactgggcagggggccagagccagttgcttggtattcttgggcacgggggctgcaggcacagcacaaagggtaggagagagagctgagtgggggcctggtaaccatcaaaggagaaaatgggctccacaaaggtgggggtggtccattgcttcccccacctcgaaccctaatgactgaatacaaggctagcatggtggggccaaggaaccatcagaccaagcaactaggcatccatccaaaatgagtcattagtggggtggtggggagttgaagtgagggacccctttgcctttgaggcagaatggggaagctagaacacatgagttcctaccagaccctccagctctttctcagcttctcactgccacagcaagcctcgccctggttgttttggagttttttttccctgacatggggaggggttggaagtgggtggggcgattctgaggggggacttggagagagcgggtgagaaagtcgggagcaggttgctatggtaaccgcctcctcagtcaggggaactgttgccagggttactgttagagggggaaaacagaagaaaaagatggtggggggaaggaggtatgacttgtcactctaggctccagcctggctcctagcttcccgtctaccctgactgcctcccctaggtcttccttttctccctccagccctagccacctccagcctccatgttccaggcacatgcctggtagggcagagtggggagtaggagggtagtgccagtgagtaaaccagactccataccttaagctcaactcctatccctttgtcgcctcccaaccccagtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaaggtgggggaggggagcacaggggtcctgtcatcagtcattcaggctcagttcattcagcaaatagagatgagctcaaagcttttacatccacaatgtgtacccctctatagcaaggcagaagagaggtgctctaagagtatgggggccttagacatttttcactgtgcccctcatcggtaaaaaatgttattcagatactcctgtgctattatcacatatacaacagaacataaaaacaatctaaaaatagtaaaattttaagtggcaaaaattgggaagaattctagacaataaaaatggaagaatacctgaatgaggggagaactcgaagtgtaatctaactggtaaatagtaatactaatctttgttaagcattttttaaaaactggtaaaatttaaaactacaagttctatcattttcttatccactttgagagactactgcttggggagtgggatctatggattagagtaatccctcacagctggaggctttagggaagaattggtgtttaagatggccctgaaaggtgagtgggatttctaaggcaagatccaaaggagggcatgccaggcagaggaacactgtcacagagtatctagtgtgtttggaaatgcaatcagtcctgcttggcttgactaggatgtagggtgtttagaaatggctgggaaggtaaggtaagactgtgttgtagagagcctgggtattggataggtgaggtgagtgaactcagggcccttcagatatactattctgactgctgtgtggctggcagggagaacgtataaaggaggacgtgttacagttagactgtatggcaacagtcagaggggaggagccagggaagaaggtctaagggcatctataatctcctggaattggccaagccatggacatcgtccttctggtggtgtccataccttctctcatttagaataacctttctcaccaggcccagaatctctcctgggttgcctagagattccaccctgctggtcctacatgtgctgtcagcaaattctgatacttacttggatggaaagtggaaaaggatgggggtgggggtggggtatctggaagtcaagttgatttttcttttgtcccctccccacaacatatgggagctagtatctaagctaaacccctcattctaaccacaatctagaaacttcactgaccaactatctgcccttcctgcgaacagtcctctgtattgttgtttgggtaccttagctttcttctcctggattagtagcccctcttcctccagtgttgtaccctcccataaccaatgtcagcaactcagctttggttccaggtcactagtctggtggagtaggggaagctgacctctacagcctagctctgaccctatctcctgccttcctccagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaaggtaagcggccactcctttaactagctgcacctctgcctcgtcccgttgactatccttggagtacttgagttttgggagagtggaggcagatgcccaatgggcctgcctggcatctcccacactgctgtccctggacacatacctttttgcccccagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaactgattttaaaatttctgtgagtgaccaggattttgcaggctttgaatcactgggaagggagggggaacaatatttatggcccagaataagggctgggaaaataccccaagtgtataccctcaccccacccaatctcctaagtatcactgagctaaatggagtgtatcctacttccaacagtctccaattggagcccaagcactggaaatacgggtctcccaaaatggactttctaacactgtatcatgtgcagaatgagaggggaaggctaggtacctacattagtaggaacaaaaaccatccattgtgaataaatggaccacataccacacagagcagcagtcgggagaagaaaagctttactgggagaaaatacaacaaattccagagtgcatggtttttagcccaccctatcaccccaccagcaataggaacacagaccactcgatcaccacacattccctacctcagggagtaagtacagcagccaacatctggtctcagagctgctgggaaaaggggcaggaggaagaagtatctgggaataccattctctcactcttttcccctccttcctggcctgatttagaagaatctgactgtcccaggatacagaattcttggttggatcttgtggaactgggggcaaaaaaatagcagcaaaagcacttaagggcaagaattcagctgggactttcagactcagtgaccagtgataagacaagtgcccaagctccagccactgtaatcagtccttagattaatgacttattcctcaatcctaaaatatcaagaggtggacaaggtttaagtcaaacccaggaagtctttcccttcactcttctataaagaagggaactggcatgaagttggatggcttaatgatcaagcagctaaaggtaagagagacagagtgagagagtgtgtatgtatgtgtgtggtgtgtgtgtacatgtcttctgtcacaaagtaccacaatagtctgcagtggtggcaccaccctaaagtagttaagttttaaagacaggccagcctctggttagaagagccatccttggaaccccctacaagacttaaggagaggtaggagatctgaggcagagctgagaggaatttcctgtttttcccaacccctacaccaaagcagggaaccaggaagggcagaaatgaggatccttccattctcaagcctcctaaaacctaaagggtaagtcccaatctctagtgaccatacacagaggtaaactgaccccaggtgtcacttccacaccattactcttgttcactcttaagtccctttattgcattcagagaatatataggtatttaaactttgacaataattttaccttgatacatccaagtttgacttgctttttaatatatttatagatataaaattaggcctctaacagtgatagggacagggagattgctgccaccaaacaatgtttcttaaaaaaataacagaagaggtaatatccttcctattcttccttcacttctgcccctcctcccacctcttcccagcctccctcacctgacctatttagggggtgatgggatgaagagaagagagtgaaggatatgtaatcaagtgcaaaatactgtggtaagtacagagaatgaataaggtggaaaggaaagtgaagagtgtgggatggttaggggctttaaggacttcccaggaaaataggattctgggatggggttgctgggggtggggggggagccaactgtcataaacttttaaaaaacaaaggaagaaaaggtcaaaaacctaaaccaaagagagagtggcactcctaccctccactctggccccttggtactgaatagccagttgttccccccacccctcccccagcccaagaaacaagggagattaaagaaaaagaaaccccattccctatcccaaaccagttaacaaaataggcttccctctcctctcaaaaagaggctttggggagaggccatttctgccgagtcctatgc

SEQ ID NO: 16448 - DNA, 13916 bp, Human; identical to SEQ ID NO: 16447
  misc_feature (1)...(13916): n = A,T,C or G

SEQ ID NO: 16449 - DNA, 9506 bp, Human
taggttggaggaactgaaattcttggagggaagatggagaaatcaagtccttgatcttgagatagaggtaacaatttcacacttttccttcccctgagaaaagtgcagtcccccactcaggaagacaggatgtgggacacattcaaaataaggtttacctagatccctggggcaatggagagtgagagagttctgggggtgatccgacatcggggttccttccccatccctgggcagagagatctgtctaggcaagccgactgggggtcagattacctaagaccctgagagaacatctggaagcccacctgggactaaagctaggataatgggagcagggtcgttttctgcatgacctggggtctctgagccagtcaatgcttactcttcctgaggacatctgagcttcaggaaaggaaaaggaagcccattgttgggggcaggggaaaccctaatcttccattgccatggggctcttggaccctgtgtcccctgactccatggacaataaatgcagggggtgcccctaagctcaaagccatttcattttgatttctcttcctaccttctctaccccaagacacacaaacacacacacacacaccctctccagagtgctgactgcagaggacctcaccccagaacataagatgctggagtgctaggtttagagtcacatacccaggcagtttctccccaggacctggtcaaccatccaggccatctgtggttcctatggcacactcctccatcccccacccactagccagcccacgtttccgtggagtgggaggagaggatcattcccaggaaagagaagggaaggtggaagagtcccaaatcctattctaaacctttccctgtatggtccatatctcctagaggaccctgggtgctttggggaagggctctggacctctctcagagcagattgcagctcagagagctcctcagaggcaagcatgtgaagaaaaatcaggtgggcttcgcttggaatgtgggctttggggcatatggcaggtgggggcggggctggtgttaggatagtccatgggaagtaagaggctgggggaaaatataactagagggagtggggaaataaatgtgggtgcttagtgcttcacctgatctgattccatgtctctcatgaagaataggatcccagagggatacgagcctaactctttataactctgggcttcctttcccaggcttctgtgttgggatcttccagttcccctccccatttgcaggctgtctccactaggagaaaaaacccaagggaaatgaggctggcccaagagcagcagtgatcgtgggtaggtctcagggaggatttctagtgggaatttcctaatgttccacccttgtgcactggagggtttccactgactttccacagctttcatttctttctcgtttgtaagcatgttgaggggagggaatggagcggagtgagtgaggtccaaggagggaagaatgagaaagactgtgtatcagtcttggggtgaacttcaaaacagcctgcgaggagagccattggtggctgcactggctacagctggggaagggatggtggaagtccttagggcagggagggctccattacccgcctgcccccctccccaaaaagcccccagtctattgatttcaggaaatcactagggggatctgggcctgggtctttggccccggggctgcccctgaggtgctgcacaccccagctggaggtgatggcaccaaaatatctggtacctccttcccctgaaaatcatcgtggaacttgcacagttctatccagttcaggtacatcattccatttgaccctcacaactttctgagcctggggggcagttagggctgaatgtgttattcccagaaatagaggccaggcaacacgaagggactcgcccagggccccccagggctcggtgctggccctgatgccccgtgcctccccatctcccgaggggccactcattcggcaaacctttattaagcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggtgcgagcaggcctggggaggggagcggggttggcagagggtgggcgggaccgaggaaggcaggggcgagactaggggccaggggagctggggaggatggatggaggggctggtggaggatgagacagtgaggtgagacaggggtcggaggcgggagtggaaccgagcaacgccgcagaaggccaagagaaagcttggaggaattctccgaaatggcactggcgtggggccctgggcccagaggaatgtgtcacttggaatagggacagtaataatagctagtgctcgcccagtattcaccctgtgtcatgcgcagttccaaagcactttctacctctgagtcgatttaatcctaacaagaaccctctgaaggtaacttcttgttattgtgctcactttttagagatgagattgctccaatgagaaattaaggaagttgtccactttcctaagccaataagtggccatgcctggattggacacaggcaatgtggcttcaatgtttagtggtcccgagttggaaggaggggttaggttcaggggttttctcactgcagtcaggttcaggcccctggaatttgacggtgaaggttttccattgcctgagttatttctaggccggatcttgaggggagtttaatacctagtctcacttgtacctcggtttcccaattcatccatttccactgacaagggatatagatgatgttaccttttctagctcttttccaaaaggaactggcaactcatctgtgatgtcaataagtccaacccagacctacacagtgaaggctttgggagcaggtgaaaaaagaccagtgttacaggagtcgcaaaggaggtcacttaggacttgagatctagaggatagatgaggatgaggaaactgcgggtggaggaccaaaggcccactagggggcgccgcagtccctcctctgacgccagagctgctgatgctccctgccggcttcgctgacaagctggtgccttcagatcctttccctggcccctttaggctgagactccgcttcacaccccaaccccagctccgcatcactgttcccattcctgcttcaccccgactctttcctcttcccccactcaccccgttccctttcctctctctccagctgtcactccttttctgccagtatctcaggcaggcccctcaccctccagggaagttgctgcccggccctcttttctctttgtacccccagccctgccctctcctcctcgaagcccttctctccccagtgtcccttatgcctctttctcttctctcccactggatactttctattccaacttcaccgaggaataccaatgtctcagcgccaggctttccgagttgacagccactctccggttagctaatgttcactcttctgtttccccttgttccgagatggatatgggttgggggcaagaccctgtggcagaaaggagaatgacctgccctgaggggtgcaccagcccaacaggaagataggacacaagccccgggcagggaggaccaggacagaggagatgaggataggaatctgtctgtttttctagagagataaagctggaaaggatggtaatattttgggtgagacagtcaggattcaaaacgcttttgaaaagcaagaataatgagccaaaacccagcaagatgacatttaaaatgaataaatataaaattctacatttaggctttaaaaaaatcacttatgtaagcacagcatggaagagcactggtgaaaaaagaactgggagttttagttggctacagtcttgatgtcgtagcaatgtgatgcagcctccaaaatgattatgtaatgttatcctgggccctattagtgaaagcatcatggccagaagagagagatggtgcgcgctctcttatgcacggagcaggccacagttggaaaatttactatactcaaaatgcttaaagggccctccttggccattctggcttgtaatcaaaaaagtagagttctggaaaaccaggtcaaatgaggaatcgtggaggaagccagggatgttaagtcaagagagaaaacatgagggaatctgagactcctgttttcagatactcagaggactgtgaagtgggaggggaatgaagccaagagttggaaatcccagggtacaggttttagctctgtataaagaacaacccaactattagagctatcatacaaaggagtgggccctttatgaagtggtgagctatcaatcctgggaggtaatcaagtataagctagatgcccattgttagaaatgctcctttggggagccctgtatggagtgagaagttggactagaggatccctaaggttagtttcaaggttaagctttttttggttggcatcaccaaatgacaggaggggaaaaaagagctggacattaagaggagttggggcaaatggagaagacacgagggagctgggtaagaacaggagctagggagggggggaaatggactggaccaaagggaggtgggagcccttaggaaggaatagaagggagggtgctgggagtagggttgtggaatgagaagaggagagggaagcctggagctgagattccccctgaccggtgcccctcctcccaggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaagccatcagaaggacttgagggggctcctggggaggtcggggggaggtggagcaggaagagttttaggggcaaaggacagaaccccttgtaggactggaggcaagattgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagcttcctggatagtgagggagaacaactgcaagttgagagaggcagaggggtggaagggacctgaagctggcctggagaaaagcataggcccaggagagcctgccctgggacagcgcctgtctcccacacagcagcactggcccagcaaggacctcctcccttggccctggccacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccacacctctcctcgccactgtcaccactcagggcaccactgtacagtgcaacaagtcaggagacctaggtcctactcctgacacttgctaattagctctatgactctgggcaaatcgcatatctgggcctcagtttcctcatctgtaaaaatgacagcaaactcgtaatgctcaataaatgtttaaataacaactgaaggaggcctgccagatgcctcttaaggtgccgtgcaggtaagaattttaggatcagagaatccttaggcaagaaaattcatgaaactcctggggcactggaggaggggtgaagctgaagggtgggagggaggagaccccagggtaggtacaggcaggtgaagcgggtatatgcaggtgtagtgggtatatgcgggtagagggtatatgcaggtacagcgagtacatgtgggtgcaatggctctgtggacacacaggccctcccctgactgcctgttgtcccagcctgagtatcagttgtgttctgaggcttctattctgctgctatgggtcagaaggaacaacaatttcagccccagggcctagtgggaggagtcaggtccaagactagcctgaccaggagaatgagacgtgggaagagttggggaaagtctgggaagctcagaaaaggcactgcccctggaggcccatgccctttaacatgggagaagctggtgcgggggtgaccacaggcagctggaacctaccctccttttctatgcttccctccccaagtaggagtccaatcaggagttgtctcagccccgacagttcaggctgcagatggaacccaggtgtcccctcctggggtgggtggcatggcccatggaggccagatggtgtttgtggtgggaagagaggcctgggtcatccagaataggttgtcaatccccaaccacctccctactatgcaccctgagcgttttacagtctcatggtagggaagacacagccaagcctgctttttataaaacaagtttattcacattttagaaaaactaattccaggacaggaaatggcctccctataggatccctaaga

SEQ ID NO: 16450 - DNA, 14600 bp, Human
ttgggggtacaaaaggtcagattcaagatggaacaagttttatgctccagcgtctctgtcccagtgtctcccgcctcccctggaatgcagaagtgagaaatcagggctggacatcacctagatcatctgcttctgggcaggcctccccatctcacctggctgcctttgctctggccttggggctttcccacgttagccactcttcagggagaccaggatatgggcttctgaggtctcttcagctccaacgtgctgtgcttaggctagctccaacctctcctgctacagtgacagctgtccctcttggcctcactcctgccatgcttttgagattttctgtggccttccgtgttcagctgtgtaaggtccaccacacagacatgtggaaaagttattctgctaacataattacatgaccctccctggatgcaaaacaaaacaaaaaaaacaccactgtccctctagaatcagagatacctcagggtgcagtggcagcatgtgactttgatctgaccctctatggtctccctcatgcctcagtttacctgtgcatagtaagaaccctggagggccatgaagaggatccttccttcctacgtatccagagttaaactcactactctgtcctcacccccaagctggatccagaagtttaagcccctacccgcccatctctgctttggatctcgggtgcacagaattaatcatcagtcttggttcagggcacagggttcacctcttcatgcttgcctaatgttaatttttttttgccctggtgtcaatacctgatcctctttgtcttgtcaaagacatgggaataaatagtagctattcactctccttggaagcatgcagcctgggaaaacctcccttcccactgtgccccagaaaaccgagtcccataggatcagggtagggagtgcacacacaggtggcaaccaaaggacagaccccttctcattgtgggctttataggcagagaaaccccaaacccacatctctacaggacaggatctgggccagccctgtccttccctgcattcccaagttaggagtgctgagtgaagcaaaggaaactggctggagctgagccaggttgccagtcttggacgcggctccatcttttattcagagaatgacctcatccttggtcctggttctttaaaagaaagtggagggggtctctttcctgcagcctggcttgcacttttatcgccccactctcctacatagtatcaaagaatcagaatcagacttcacctacagaagattcccaggctttaggacatagagccaataccacatttgtcccccttttgtcctatattatcaatttagcctctgacccagttagctcctcctctccactgcatttaacttctaattacccttgccccaccctcggccctccctaattacccttatacctcccctcccccagccccagcttcatttacctccgactcatctggtcttatttttagctccggcatctctccttttcctttcttaatatggcgatgagctcttaggccagtgtggggaccggggctgaggtgccctggacactggaggagggggagggaaggagcccctgggagcctggggtagaagtgtaggaggtgggaggattccggcccgcatggagctgtcctggcctcagaaggttatccgtctctcctgccaaccatggagacatatttagacaggaccaggtggggactgaggggtgccaatttcagggggcagctccggttccctccccgccccctgctcctattcctccacctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggaggtgagttgggggcactgcaggcctgcagagcatgtctagcccctctccggaatcccctatcctacacccatgtagctctttgaggatgggatctgggggtgaggggcagtgtggtaggaaccctgtcctgaccaacaggatgcaagtggcatgtggctttagtcaaatgagaaacagagtctcaggaacccaaaagtactatcagcgtcaggaaacctttagcaggggtgctgcaggaagagctcccctccctgctataggaggctggtagtatttgacttaggtttggctaggacactgagggtgaaaaagggaggtacttggagggccaggggagaacagcagtgtatattgcactcccctaccccacccatctgcttagccagaacacgtcctctccacatacttcaggggctgcaccccaaagagatccaaactgagtgtaaatgtaaatgttatgatacttgcatgccatgtttaaatatctcctagagatcatgcctcccattggactcccagtcccctctctcttccttccccctccctaattccccatttgtctccattggataagctggatgccctcactggaaaattcttatggttgcaggaggtgtcagaatgtcttccccaatcttctttttgtgggaaaagtctcctcacctccaaaatgacttcaggcccaaaggagaaagaagttatcataagaaaagaaaaaaaacctatgtttgggaatgtgttcatacacacacacctttaggaaatgggatgtgagttttcttgtccaagctcctgtggccccttctctggcctcagcttgtccagagcttggagcatttcagggtgagacaccagaaccacaggctctcattttgtgcacccctgctgggtgctagaacctgccatctgattaatgagccgagtatttttatcctgagtgctcagtatccctggccatccacctgccaaccgcctcccttccccacccctctgagaatcacagtacctgagtctgtgctgagtgggggtagagctgcaagctgtgcccacagcagagaaaatcagggttgaacgctaagctggaaggcttatgggggcagggacctccaggtgtgactgtccacagcctaaggacaggctgaagtagagtgcgaaaggggaaagttgggccctgatggggagaactgtccggtcgctgtcagtctctctccctctggggggtaacaaatggtgacctcttatctcagctctctggccttccccaactcctcaacaacatgaccagacccaccactaccctcccaccctccaaaattcttcccattgggagtcactctgaagaatctcagggacttccaagatcaaccccacactgagcttggcccttgaccagggacagggacctccaggtgtgacttgagcaggatggaatgcaggactcaaccctgaaggagggaaggggccctcagtcactctgaagccagactcctcagtacctcttaggcactgggaagtattgagtgcagtgtcttcaagtccaacataataagcacattgcaaatgagcaatcaatattcatgaactaagttgagccaaaaacagaactgtgtggctgtagggaatttgggggatattctggatcttagcaaagggtcaaggtcaactcttatatctcccgcacctcaactgacccaacttgaaagcatgagagggagaataggggataataaaaattccaggggctaattttaatcataatccttccctccagttagcagcccaagtcctagaagacaagggtgttggcttcgggctggtagactctgagaaggatgcagctgtggccaagaaactaggtaagagaggggagggcaggggaggggaaggtggcattgagacaaggggaggcttagggcggaggacctgtcaggcagtccttgggatccgaggggcttgggaatctctcagatttatgtctattctaaaagagggggtgagaaaatatgaggttgggagggttatggctcggagactctgcctctctattccttatgaagttccatgctcaaatcccagaaagaggtgggggaggccttctttatacttaccttaaaacatggctaggtgctggagggaaggggagtcggggaatacaggcggggctggccagacctctgcaaactccgcttccaacccctcccatccagagccatggttgttagagcagtcagccactagggggcagcacaggcttgagacgggattctggacatgcatgggggaggggtggtcagtaataatgaagtcatctggtcagtaatagcaattaaagagcttgactgggaaccagctactagagtgctcagagggggtggcatgaatactcatctctagtcgttgcggtcagagaaggggagaaatactgctagaatctacacctctctattccctcccctcaccctacctgatcccccagctactccctagaaagctctggggccacgctagccccctaggcttaatccaggggcagagacctcaggcctgtcggcctctgggtcagaggaggtgggtggggcaacgggcccatgaggtggagcatgtggggccccggtgattatcaaatgggctgtggccgaggatttggaccttgaatctgtgggaagcctgggatcatggctcactacctcacccctgcgcccggctcactccctaggcctaactgaagtggacagcatgtatgtattcaagggagatgaagtcattgagtacgatggcgagttttctgctgacaccatcgtggagtttctgcttgatgtaaggactcccctggacctgacggccttgcttgaaaactccactgcctgccccctagtccctaccaaccccaacctgacactgcacacacacaccacacacacacacatacaccacacgcacacacaccatacatacaccacacgcacacacaccatacatacacacacacaccacgggcatacacaccacacatatgcatgcacatgcacacaatagttcacaaatcacctacacaccacacactacacataggcaccacatgcacaccacacacactacacacaccacacacacatcatatacataccacacacccatcacacacatatcacatgcacacacacaccacatgcacaccacacactccacacacatcacacaccacatgcacatacacaacaaacacacaccacacatgcacacacaccacatccatgccacgcaaatgcacacaccacacactctttacatgtacacacacactacacacatgcacacacatcacacatatgccacacatgcacacaataggccacacatcacctagataccacacactatgcatatgcaccacatgcacaccacacacacaacacacaccacacacacccatccatacacaccacacacaacatatacatgccacacacccaccagatatatcacatgcacacacaccgtacatgcgcacacacacaccacatgcacatacatacctgcacaccacacatgcacacactacacacatgcacacaccacatgcacactccacacgtacacacaccacacattcacacacatcacacacatgccacacatgtacacagtaggccacacatcacctacataccgaacactacacatatgcaccacatgcacaccacactcataccatccacacacatcacacacacatcatatacataccacacacccaccatacatatatatcacatgcacacacacaccacacatgcacaccacacactgcacacatcacacactatacacacacacgcacatgcaaccccccacacacacacccacacactgtcaacatctagccccctcctccagttccccagccttcttttccctaggtccctttctggttctacttgaggatagaaactctcttcctgcaatgtcctcctctttcaggtcctagaggaccctgtggaattgattgaaggtgaacgagagctgcaggcgtttgagaatattgaggatgagatcaaactcattggctacttcaagagcaaagactcagagcgtgggtaaccctcagactccactgtgcccctctctggatccccatctcacctgtcctcccacctccccacatcacccagtgtctcagcctctacctctgcacttcccacctcttcctccagccgtggtcagcaccatcaacagctctgacctccctgtactctgggggttcccagacaagcccctccagtattccaccttcccctcactctcgaagaactagaaggggtgggtctcaaaatgaaccctgcctgcaaagaattggggacgatagtgggggatgattcccgggcagaccctggtttccccagagactgactctgcattccaccccccagattacaaagccttcgaggatgcagctgaggagtttcatccctacatccccttcttcgccaccttcgacagcaaggttctcctccccgcagctgtattggttctgcctcatgtcctgaagctgtcctccagtttcctctcccagaatcgatggctgacctggtcccttcctacgtgctggcactccctacctgcccccccccccggctcctcccactccatagatttagagctgaagaggggctttagatgatctaacacccctctcatgttaaacccaaccccaggcaagttaagacacttgtcaggtgtcacagtggcagtgacaaggatcccggctttctgactcccttcctaatatttgttcccccattatactgcttctcgacatgaccctgtgtctcctgctccactcccctcctaccccctctcccaaaggtggcaaagaagctgaccctgaagctgaatgagattgatttctacgaggccttcatggaagagcctgtgaccatcccagacaagcccaatagcgaagaggagattgtcaacttcgtggaggagcacaggaggtggggaccaagggcaaccctctcagcggggtcggctcctccttgggctagaacacactgtgtgagatgggctggggaaagcttagccaaccgggaagccaatcttgcctggagatgaatacactttgggcaccagtgctctctgatacactgacaattttgcacaatattttataccccactacttagccctgagccctacaccgagagggtccttcataagtgtgtataattcagtgtgaggttgattgagacttaaataatctctgtcaacaaatgagtgttgactgcctgtggtggggcaggaactgcaaggtactttccatctctatgattatattaagtccttttaacctcagtgaaaggttctacaggtaataagtgtcagagcttttaaccctgattttaaccctgatgtgtcccatgtttgttctttttttcttcttcttctttttttttttttcttccgagaccgagtcttactctatcccctaggctggagcacagtggcgccatcttggctcactgcagcctccgcctcccaggttcaagcgattctccttcctcagcctcccaggtagctggaattacaggcacgccaccacacctggctaatttttgtatttttagtagagatggggtttcaccacgttggccaggctggtctcaaactcctgacctcaagtgatgcgcctgcctcggtctcccaaagtgctgggattacaggcatgagccactgcgcctggccccatgttctttctaatacaatatcgtacaccaatggttctctacaaggtgggaaggcgtggcgaggtgggcataggtttttgccctccaaaggatgtttggcaatgtctagacacatttttggttgtgcagagtgctactagtatttagtggctagagcccagggatactgctaaacattctacagtgcgcaggacagccccctactacaaagaattatctggctccaaatggcaatagtgctgaggttgaataatcctgccgggcactcacacataattcccttccttcatagtagtccacagctggaaatatccaatcactctgtcccccaggctagtgtgcagtggtggatcactgcaagctcccttgcagtatatacagtacttactctcccatactactggctcccttcatcaaggcaggaacatgcttgcctggttcaactgtatgtacccagcacctagcatagtgcttagaacatatcgggcactcaatcatagtgagtgagtgaatgaatgaataaattaatgaatatcctgatgtccagttcttgcctttctcccccagtctctcttccagtccctttgcccaccctcccctctcccaccgctttaaccatgcaatgagccgggcctggtgcccagagttgaggccttgccagatggctttgttgtaggctacaagctgtctgtgccctgggcctgacctagaggcagcctttgctacaggaccctctggagggggcatccttctaacccactgagtaatgacactctgtctgtctcttctagatcaaccctgaggaaactgaagccggagagtatgtatgagacctgggtgagtgcccctggccagggtcaagccctcagggaagcatgggtgccagaagactcaagtcctagaaaaaccccaccctactgctcctcaggcccatttttagaaaaaacagtgcactgaccagctgggtgtggtggctcatgcctgtaatcccagcactttgggaggccaaggtgggtggatcacgaggtcaggagatcgagaccatcctggctaacacagtgaaaccccatctctactgaaaatacaaaaaaaatagcagggtgtggtggcgggcgcctgtagtcccagctacttgggaggctgaggcaggagaatggcttgaacccaggaggcggagcttgcagtgatccgccactgcacaccagcctgggggacagagtgagactccgtctcaaaaaaaaagaaaaaagaaaaaacagtgcactagcagcaactgaaggatttctacactgaagaatgtgtgaggaaatgggagacagacataattgaagatgacaagggaagagcctcaagcctggggataaagggattatcagaggaagtgtggggccttggagctgaaaggagtgtcacttggaaaaaggtcaccatcacaagaatatatatggccaggcgcagtggctcacgcctgtaatcccagcactttgggaggctgaggcaggcagatcatctgaggtcaggagtttgagaccagcccgatcaacaaggtgaaacaatgttgtactaaaaatacaaaattagccaggtgtggtggcgcatggctgtaatcccagctactcaggaggctgaggcaggagaatcgcttgaacccgggaggcggaggttgcagtgagccgagatcgcgccattgcactctaccctgggggacagagtgaaactctgtctcaaaaacaaaaaaaaacaaaccccaaaaaacgaaagaatatatctggtcctgaagctggatttccacaaaattgaagttcaatgaacatctaggatctgttctgggctcctcaacttcagggagtatagtaaggtcttctccaaaaccctgttctccttcttaccccctgacaggaggatgatatggatggaatccacattgtggccttcgcagaggaagctgatcctggtgagggaggaataccgggttggactggagggaaggcagggggaggtgggtgtgtttattggagcatgggcctcactaggaggctttcctgggagtttgcaaacagcctagggctagacatgtgaagcttggggagcagggaggtagctctgcactcctgtttcacctgggtccctttcctctctacacacctcataccttgtacttgtgttccctccaagatggtttcgagttcttagagactctcaaggctgtggcccaagataacactgaaaacccagatcttagcatcatctggattgaccctgatgacttccccctggtaagaggcacagctcaggcactgctatcttaaggtggggccttggactgtgacatcttcttagtgagggctttgtttcagaggtcccatccccacctcctagctggggggccctgggagggtatgcgtgttgcatgcttaagggcactgttggcatggagggcatcctgagcaaggggaaacaggacggacatcacacacattcccagagcagaggctggatgggtagctcaggtgctagggctgactcctaaagaaaaccaatgttgtgaggcacaatagtcctgcacatgggtatacacactcaatcatagaatcatagcacagagattccctgtttcaggagatgattttgttctcagctacattcccaacacctagcactcgctgttgaatgagtaactgaaagaacaaagagaaacgtgagaaacattggcacttaccaggtatacttgccttattttagaaatgtaagatctgagggccagagagaagtgacttgaccttgaacacaaggatctgatccaggatcagaacagggtttcctatccagttttcctcagaaaagaggggccagtgcacccagctgaccctcccgattctctccctttaggatttctcctcttttgctgtttagttctacccttgccttgatgccctcacaggtggacctgtccccatccactgccagttcgcactgtcccctctccatccctgggctgaccctcacactcatcctcctggattcatgtgctccctagtatctattaagttgctgtattttgatctctctacagctggtcccatactgggagaagacgtttgacatcgacttgtcagccccacaaataggagtcgtcaatgttactgatgtgagtttcctgtcctcatcccgggttgacccccgactctacttcctagcatagctagctctcctcctctctgctaactaggagttgggcccttctcacaggacgcagacatgcccagtctagtggctggatggagggggagacttaggatctgaatgtggccctgtcccacatgttggaatcagtggctcatccttcaaggcccagttcaaattctttctcctctgtgaagtctttccagatctcccatttaaaatcattccctccctggcactcccagggctcaatagccattgagaacatgacatttaaatggctatttatgtattatgtgtgtctcttccagtagatttttgagcttgttcagggcagaagtcttcttatgcacacacagtaggtgcttcaaaactgctaagttgaactgaatgagccacagtctctgctttcatagaattctcagactaattagagaggcaagtgttccattaactacaaggccagatctgataaactttataataacgatacaaataagacacaggatcacattgatttctgcttgacagaatcagagaaaagtttaagaaaaagtgatattcaaaatggagattctacaatgtatacgatttcaacaagtgatgattcagggaagtcatttccaaactgaggaaaaagcaagatcaaaagttaaaaacaggaaaatgaatatcaggttcccggaaaaggcaggtggatttttatggttgagagtctagagatcactgagaatggtactagaaaagcaggttatgaaaagccctggggccagggtagtggctcaggcctgtaatcccagcattttgggaggccaaggtgggagaatcacttgaggccaggtgttcaaggctgcagtgagccatgactgcccctctgcgcttcagcccgggcaatagagtgagaccatgtctcttttagaaaagaaagaaagaaagaaatgtcctgaatgccgaagagttgctaactttattcttataagccatgaagagctaccagtggttttgcaccaaaggcataatagggaagttcagtgtggcaagagcacgggagacagattgaagggagaaggtctatttgccaatccaacttttcttcccactctcacctgtcactattctaacccataccttcacctggacagtttccctggcctttggcagatgaaaggaagggactgagaatgtagggaaggatgtacagagtccagtgagtgggaagacagatcctaagacccgggttggacttagcttccgtccctgcctgtgccatctcctaggcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaacaagtgtattttggtgaagtctcacccctatggcaggaggaggtggccactgatggggaattcagatgtgggtgccttgctagggatgagctgggggactcttatagtggggactggggttcctccaggcagctttcccagagaagcctggattgttaatctgcttcaagtcaacaagccttttctgaacacatggtgtttgtccagggccactgttaggctctgggagaacagagagtgctaggcctgtccctgatcttgagctgattagcctcacggagaagtcaagacaagcatactaaacaatcgaagaagaatacaaagcaatatgtaattaagtgattatgtgctgctcgatagcaccctctctgcagctcttatttgaacatcaagacagagctccaattatacttccttggtgaagccttcccagaggtggcccctccagtgatgacctcttctgagttcctgctgcacttccattccagtactcagcacagtctgttattgttcttcatttacgtgtctgtcttccccactcaactgtgagccccttgaaggcaggaacccaagctttttctttgtgtccacagggtctgacactcaaaagttgtccctagtaaatgtttcctaaaggaagaacaaaggaaagaacagaatgaactcagaagagagatcagagtgggcttgatgacttcacaaaggaagtaagcctttactaggccttaaattgaagaatgggatttggttggagacaaaggagctgaggaggagacatttcagtcagtggaaaacatcaagtactggcaggatatgtttgtcatattgggggcacagagaccagagagacaagaagaaaaatcaagttgtggccatgaagttgggtaagcataatggggctgggttgtagagctgtttgaattgaatcctgccagccgaggaggcagggcaaaatttaatctggtagcgataagcaggatggggaggggagatgatggagatgccagaggtaaggggcccaacccataatcagtgactgttataataattggagtgatgttgggagaacatggacccaagtggtggccatgggaatggagaggagatattgtatacaatggggatctcccagacctgggcctgctggaggtcttggcaagaaggacccacagtctttccagaataggcccaggctggggtaagcaaaaaggagtttagggagttggggatgggagggccaaatagctaaataagcccataaataataaacatatacatatatagttttgagatgatgcccatgaacaataaacattttatatatataatatatacaaatagctaaacaagcccataaataataaacattatatatatatttttgagatgatgcccataaataataaacattatatatatatacatatacatatatatgtgtgtgtatatatatatatttttttcttttttttttttttttttgagatgga

SEQ ID NO: 16451 - DNA, 31754 bp, Human
  misc_feature (1)...(31754): n = A,T,C or G
tcccaagtagctgggaccactggcatgtaccactatgcctggctaatttttgattttttgtagagatgggatctccctatgttgcccaggctggtctcaaactcctggatgtaagcaatcctcctgccttgggctcccaaagtactgggattacaggcatgtaattgcctgctgggaggcaagtcccttacactgcactctgtcattccctccttcctgccataacttttttaatttttctttgagacagagtcttgcattgttgcctgggctggagtgatcttggctcactgcaatctccccgtcctggcttcaagtgattctcctgcctgagcctcctgagtagctgggattacaggtgcctgccaccacccccggctaattttttgtatttttagtagagacggggtttcactatgtcggccaggctggtctcgaactcctgacctcgtgatctgcccaccttggcctcccaaagtgctgggattacaggcatgagccaccgcgcccagccctttctgcctcaactttgcaccttttcttcagagagttaccctgggctgagaaaagaatagattttcaatttggacagttttttcttggcttgtttcctctttggttacacggatagtaactatgtcatgcagatgtgcctgggagaatggggtgaatacaggaagcaccttattcacagtgggccggttacttgtcttcccttctttctgagctgcagggaacggggttctaatgccaaggcttagtaaggaaggttcccacgaacaaaacagccccttctctcagtcccaagcctcccagggactgtgctcctcctcttcaggccttcccttctccctctgattaagccttcaacacttggtgggactgggcaggggacacaattttgtactcttgatcccaaaggagataaaggctgggaaatctagggaaggaatgtgaagcctgttggagtaagtccttttaaaagcagcaagaagtgaccttgtctccctctttccattcccccggggcttgtgaatagccttcagtgcccaagttggagtaagagcttcagaaagactggctgtgagggtttggagagaggtttgagaaagcagctcagagactcacagagtcacaccaagagcttagctaatcagctaatcagcactggaggaagacaaatgtccttggtctggtgggacagcttcgtgaggcttggagcatgcagcctaccaaagtgagctcagtgccagccctgcaagttgggaggtagagaggccaaaccaaattggaaaaaatgacaaaacccctatgtactttctagaacaatacataccagctaggaagtgttaaaagacaagctccccaaagtcagttccttagcttttgacttattctaatgtagggcctccatttttaataaactctcccaggtgattcttagctgcagatttgaggcccgcaatttaagaaactgctcttgagactgcatagacatcctcagggctggaagttctttgttgacccgaccagattctctcctgctgtggaactggtttgtcctgatcctgctggcttctctgcagactacactcatcaggggttggcttggcgcctcctgggcaatggggcaagagtaatcatagcaacctaggtgaagtcccaggggaaaactgtgaccctgggccaggctcctggggccgctgacagttagaaccccctcggcccatagtaagttctttaggttcgggttctgacccaaaagtttggccaaagccaaagtggagagcagggcacgccagggcgggtcaatccttcagagccgcggttgggctggagcgtggagctgcaacggttggagcgacgggctccggttcctaagccaccagcacaaggcaactgcccgctggaggtgggaggggcggggccgggggcggggcctgagccgaagaacgcgggctagtggttgccaaggtaacgcgtcaacactagggccttggcggcgccgaggcggcagcagaagtccggagtcagggcgtgtggctgaggagatggtgagggagaacctcagatgggccccttgtgtcctgaattgggtgggggctctgagtggggaaagtgggggcctaggggaggtcacagttgggtctaggggtcaggagggcccaggagtaaggagaacacctctagaagaagcaagggagatcctgaggtgggttcaaaagaggaattagggatagcatcgataacgattggaaatgtggagcgcgctgagcggaggagttggggagaaagggatgccccaaccctctccccgttgccattacagcggggcctctgtggaccaaagattgtggatgtggtgtgggaaaaagcaatggtgggccgggcgcggtggcttacgcctgtaatcccagcactttgggaggcagaggcgggcggatcatgaggtcaggagatcgagaccatcctggctaacacagtgaaaccccgcctctactaaaaatacaaaaaattagccgggcgtggtggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaagcactggtgaggaggccagataatgggtcgtggtacctgtttttgccactaactagcaaggtgactgtgggtaagtcatctaatgtgcccgagcctcaggtttttcttctgttagcagggctttgtatccctcagtagttagtcaataaatatttggcagtgaatgaatgaatgaataaatgagtgagtgagtgaggagggtctcaggtttgcaaggcccgggagagagattgggacaggactggcagcctggggtttgctgggatggggagggctgtcagggtactgagggctgagaaggccagcaaagcctgggaggaaccatgaaggggatgcctgggcttgagtgtgttggtcccagaggggaggggaagggcagatgataagtgttggagtcttgggttattggaactgacctagaatgtctggggcacaacaggtggcaaaggttgctacttggatgtacttgtggacagacttcaggcccaggggctgcattgcttttctggggctcagtggacctcagaagaattttgttaattattaaataagtctccaacaaagagcagttcctgactttcgaggactccctgcagtgttgtaattggggtgggggagcgtcccctttcacttatgtattctatttgattcagtgtcccatcttctctcagcaccttacaaacacagtggcgtatgtatgtatgtgagcacctactgtcatgcctggtgtctaagggcatatggtaaatgttagttccccttttgtcctcttttaaaaatttcctatttccaagctctcatagggcataagttgcacctgggcaagacctgtgggcttcagagcacccagatcagggattccccatccaggagccactcagggcaggggtttgactcactcactgagcccctctgtaattcctgggacaggactgggcatatagacacctttgagaagcagtgggtctaagttagtgatctctggcaggccagctgtgtgtgttcgtgtacgtatagtgctactcactaggtttggagaatatttaaaggcatgagaagagatagtagtggtggtgagggtcacaattaggcagacttccagaactcttacaaaaataatgattaaaatcctgcagaaggagagatggggacctcagtactgactaggatgttatcttctggtggcatcctacagatggccaacttggtcccaattgaagaaagaggataattgcgtggatcactcagagtaaaaggcaaggggtctcgtgcatgggaatctccctttcttggtaaccaaagtctacagaaagggaagtagaaccaggccaagagtttgaagcctgaatttgccagcctgcggagactgtgcaaaagaagaactagatctcagaatgggtaagacatctaggaaaagacatatctttcctgaacatgtcaacctgtttagttgacaggtgttgaagttacatcagggaaacttcacactgacctattctagccccattccagctttgtcttgctgaatttgagtgaaacattctggatcccagaatatataatgctatggtttttttgtttgtttgtttgtttgttttcttttttaggtctgtactctcttgctttcagagttcgggcaccaggcccattgctatgctttgttttcaaataaaaattgttttattgttttttttttctggtcataaaattggtatctactcattgcaggaaattattcaataaagaaacatcttaagatggtaaaggttcctgacatactgttaaacatttttttgaacatgctttcagtaatacattctgggcacatacctgccatacaaacatctttacaagagtacttctacatttctttttctttttgagatggagtcttgctctgtcgcctaggctggagtgcagtggcgtgatctcagctcactgcaacctccacctcccaggttcaagcgattctcctgcctcagcctcctgagtagctgggactacaggcgtgtgccaccatgcccagctaatttttgtattttttgtagagacgagtttcaccatgttggacaggctggtctcaaattcctgacctcaggtgatccacccactttggcctcccaaagtgctgggattacaggcgtgagccaccatgcctggccaagaatacttatgtatttctttattattattattttttgagacagtgtcttgctctgtcacccaggctggagtgcagtggctcaaccttggctcactgcaacctctgcctcccgggatcaagcaatccttccgcctcagcctcccaagtagctgggactataggtgtacgccaccgtgcctggctaattttcatattttttgtagagatggggttttgccatgttgcccaggctggtcttgaactcctgagttcgatggatccacccaccttggcctcccaaagtgctgagattacaggcatgagctactgcacccagccttatgcgtttcttacagtctgttttctttacaacttaacaagttatggagatcatcctatatcaatgactgtaagtcaaaattatcatttgtttgatcagcaaatctttctgcatcagagtctctcatagagctcctagctgtggctgaattcttgtgctccaggagttggatggcttatgaagagagggggagtcagctgagtcaccaagacgaaaatatcaaagcagggctggcatctttatctgtccccagtcctcatcttccccagaccccctgccttctcagctgccttcccttcaagagttatcttcctgcaagcaggactggatgtgcttctccttaggcactgttcagcttcttggcaatatttatttggtcatgcaaagaagaaaaccagcccgtcacctccttaaagaacttcttcgctattgcctctggcccagagggatccagctttacatttgtgcttgattcttcatttttttctagtatgtttacacagtgacctctctaatccttgttactcttggcaaaactgtttattctaaccctggtgtaaggctgcggcttcaaagtcagcatttccccaatgaggttttctcaaccacccaaccctagagttcagagcttccctctgtcctgctcagtggccacttttctgtggtcatctgtttttcttcctctgttctggctcaggcagtccttgctgtgacttcctcttgacctgggtaccaagggcataggaaacaggagatgcaggctcagccctggaggaacctgcagtctggcggacacttcagcacaagggaaaacctgttggagtccttgaaaacagacaggaaaacaaatggaaaacaataatactttccatctgtattccaaagccctttcacatacgttattatccacagtggagaccacatacgtgatctggaaaacatggaatggtggagtgacttggagtcaggcagttgtattccggaaaagtatccatctcaatctggtctgcagtcctgtccttgagaggtcaccttgttcggttttattcattcttcatcaaatgcacattgctatattgttcctactacatgtgccaggcactgcaccttttcccttaattacatacaaaactcatgatccaaagccatccaccttttccagttattcccaatgcttagcctcaatcccacctactgaagtttctattcatttcctcttattctatttttggtggaaaggggagccgtagctcaccacctaccatataataacccttcagaggctgttattaggcatccttggggctgctatatttaccttttaataaatccaagcttttctgctctacagtattggggctggctgacgctgtagagggagactccctgtgtaagccttttgctggctgtgccgggcagtgagggaaatgcacatatagcattgttcaatgtacagcacagagacagctggaaaataattgtccaatcgagtgtgaaaacctgatacaggagtaacaggtgctggggtgtctggttggtaatggcagatcagagagagctttcagaacactgtccagggcttagggacctggaaagcatggtatatttccctgtctaccctgttcctttatcagctgctgattcccaggcttggggagacccaatgtgcctggcctattccttcaaggtagcccagtttagagaggtgtggggcatgtgggctcctccaaagtgaggtttgaatcagctttatcataagcctggagtcatccagtagtccttgtagacactaccttttagagatagacgtctactcttgggactgagatgaagctgcctgtcctttgggaatggaggttgtgttcgtcagattcttagttacaagcaacagagccagaattccaatttaagtaaaagagaatgtgttaagagggttttggagagctcacaaataggaacaaaagaagtttctgcagctggaaccaagaccaaaatcaaaacctagaactggtctggcaaggaccctgatgcactgttgcacccccaaaactgccaattccttacatagggtgccgctgctggtatcgttatcagtgttgcccagacgctgggtctggctgccagttctgtttgggtcagaaaggttttccttgttctgccttttggtccactagttccctagtcattgtcagtccagggccatctcattggctaagcctaggtcccttggccaggctgaggtgaatatttgatgttttcagcttctgtagttggagaagagcactatctcccacaactcattagatggggaatttgccaaaataggaagttagtagggggttaaaaaatgactaaggcacactaaaagggtcttgggagagaaacagccaaatagtgggtattatgaactggtttgcttgattatagctagtaatcatttatcattcacccactgcctcaagtttattgggcatcaaccacatgccaagcagtgggtgaggcacttttccatcctttatatcctgtggtcccaccataaccttgtaagattgtggagacacgaaggaggtcaaacagtagcgtcatttgtgagaaagacttgaagcacaagctgaaaagattggaggcaaaggggacactgtgcgtgtctcagggggcaagcccaagttgccccacaagagattgtcctcttgggaaactggtactaggcagataatgagaaactgttgcttctctcctcctgccattcctgcttcctttatccttacttccatactatgtggccgacttggccttcagcttcagggactacagaaatgctcttaaaaaaaccccacaaaaaacaaaacagttttgtttttaattgacacataatgattgtacacatttatggggtatagtgtgatgttttgatacatgtatatacattgtgtaatgattgaatcagggtagttagcatatccattacctcaaacacttgtcatttctttgcagtgagatcactcaaaattctctcttctagctagtttgaaatatacaatgtaaattaatatacattgtatacatgtatatttatatatattattgtatacatgtatattaatatacatttatatatagtaatatacattattgttaactctagtcattctattgcgctatcaaatactagaccttgccatctcatttaatcttataacatttatatttctcaaaatcctctcctagatattgtgtatctcttttgagatatacagtacattattattaactatagtggcctttctgtgcaatagagcaccagaacttattcctcctatctaactgtaactgcgcactcactgaccaacctctccccatgcccctccccttcctctcttcagcctctggtaaccaccattctactctgtacttctatgagatcaactgttttacacaaatgctgctttatgcagagctcttttttttgcagagacccttccctgctctgtggggatgccctccatctgttgctccttgtcccctatggttcagagtttacacagccgctttccctaactgtttctttttcacatgcccacccactcccccagcatgggctggtgaattgttgacttcccagggtctggatgccactcagtactgatgacccaaactttctgcctcttcctgcagccactaagcacagctggcatcctgagctcctcttctgccgcttccaacaggtcaaggaataaggctcgctatcggaccaaagccgtgagctctgaggtggatgagagcctctttggagatatcaaggtaatcctcaacaagtcctttcaagttgatgccacctgcaggcagaggcccaaaaatgtagctcagggcaaagcttctgctgagtaaccttgctctcgtaggtaactctcagactgaagacaaaggggaattctgagacctgagctgcagagctttgggatctagtggggcctatgtaaacagggacacctagcttcttccaccctagaatctctcatgtcttcacagtgtttaaaatctgttataatgtcaaaagggaggctcagctgcagagagtgcaatagttgctcagttgagctccatgatggaaacattgcagggctgatgggctaagcttgcagacaatagcaacatcttccccgctccatccaaggataatagcatcagagtacaacacaaaaccatcctcctttcccagttgctcaactaaaacaattacttagctttgggaaacgagcaggtctttatttgcaagtgttatctagaccaagaggtggacaactcctttagtctagataaagagagctagatagtagagctttgactgattttggtacatatggagtttagtaggtaagaaggaagagagggaaggagaaaaagagaatatgacatggagagaagggcagtgagagattaagagaaggggaaaagagaaagagagacactagtagtgacctgaatgcctctgccagtggggaaggtggggagaggagtgttgatgtctgtccctgctcttcaacatcttcattgtgaattgaagaggactctccagagggattgagataggcttcttaatccatttagaagactctcgctctgcagcagttttcctgttggtaagggaaaggatcaacagatgcatttattttttattatttttttaaagatagggtttcactcctgtcacccaggctggagctggagtgcaatggtacagtctcggctcactgccacctccacttcccaggctcaagtgattctcctgcctcagcctcccaagtagctgggactacaggtgcacaccactgcacctggctaatttttgtattttttgtaaagacagggtttcatcatgttccccatgctggtcttgaactcctaagctcaagcaatctgcccacctcgacctcccaaagtgctgggattacaggcgtaagtctccccacctggccaaaatgcaatttcacttacagacatttgtattgttgttgttgttttgggtacatgtggagttttctagtcaaagcaaagagagatttggaattggctgagttctccaggagtagtcatgctggctggcaaaagggggctatcagaaaaatgcttgtctcttgtccagtttctttggcctcattgatgggtaagagttcaggaagtctctcaatgggcagtagagggcagaagtggcctgtggcacgactgagttgtgcccacgtgaaagcagagatgggcaccaggtggcagcagcacacaggggactgtgggtgcaaagtgaggtaggacaagtggggccatccccctgcctctggtcaggagcacagtggctgcattaatgacacatcctttcctgtgtttagacattttctgaaacaggtgatttcatttaattgttatctaactccttcagggtcggagaattttgaaaaaaagaaaaaatcacacagttagtctgtgttcttgctgaattctaactcactgacctcctcaccaccaactcaatgagctggcagagagctacccttagatcttaagggtaggcctctgcaggtcatttagcgatttctaactccctgaatatggctttttgtgggggttaaagtaatttaatcgtaagaaagaatttaaaattaccaatatcaaagattgtaagagtctgtaacaaattatattgcttcaaacccactgtgtggtcctagagagataattatttcttctttcataaaggaaaatctttcatggagagaggaaaacctagagaacagaaatttactttaattcctgatgattttagactaagtatagacacacactagtgacccccactccttgctatccctaccattctgcgaggaatatctgtataagaacaagagacttgttttcagaaaagctggtcagggctgggcatggtggctcacgcctgtaatcccagcactttgggaggcccaggcgggcggatcatctgaggtcaggagattgagaccagcctggccaacatggagaaaccccgactctactaaaaatacaaaaattagccaggcatggtggtggtcgcctgtaatcccagctactcaggaggctgagggaggagaattgcttgaacccgggaggtggcggttgtagtgagccaagatcgtgccactgcactccagcctgggtgacagagcaagactctgtctcaaaaaaaaaaaaaaaaaaaagaaaagaaaagctggtcggtacacatccagccatgctcagatacagggcatcacgctgctctatccttgaagttaggactgaccagcaggaagtgggggtgacaagcttctaagctattctttctgaactcatagtccccagcccagggccagagcgacagccccattgtgctgctccgagataagcatacccttcaaaaaactctcactgctttgggcttggatcgcaagccagagaccatccagctcatcacccgggacatggtccgagaactcatgtgagtacactgtcccctgcccttctatgtccagtcctcatccttttgctaaggatctttgtagggagatgggtaaacccacctggtttcattctgtcagtccaatccccacttctttcctattcgttttcccctttttgtttgatagttctttctttcttctccatcctggcctctcttgtttctcccattgttgtatctattattgccactgtcctttattctcagcttcattgtccttccttacttctagctggctgtgtgagctaagggactggtagagaggaggtgcttagtgagtcctctctaagtccccattagtaccctccctaaagggaagtgatccagatgagtcacttcctttcggctgcattaagaatctgaagcaaagggaaactgaccagatgcctaattagccccctggcttcctcccagactctaaggccataggaagaaattcacaggggctccctgggttcctttgggattagctcaaccccacttcctgactagagctgcccccaggcttgagcccatcctgtgggacttaggcctagctcaaccatgtgccatgagccaacactgtgctcagtggtttaactcttgtgttagtgcttcaccctctacaaccgttctccctgccctagctccacccactaaaagccctaattcccagaaaatcctacctgtgtcacaagctggagaggcacatctagcacacaccccgggagctgtgtcggactgcggccccttactgagcatgtctggtcagccgtggcatcaagtggccagatgtggctagagccctgcagccactcctggagccagaggaagggaggaagggttccttcttggagccatctagtcctgaaaacacattggaggacaagtggctggttatttttcagggatgctgaaagcagtataaactgctgtcttagattcggatcactgctggtcactccagatcctaggctgtttagggccacgctgctttgtgaaacacaaggtcttggctaagctgcaaatctactcactcattctgtccatctcctggaccaccctcccccaacacacacacattagttttattagatgaggtttcacttcctgtctcagatgtctgtgtcttattggcatgtacctgtcaaattggcatgtacctgcctcacccagaagcagctttcttcccacccccctaactactccctcccccatctttaatatatgtcatttgcttgtaatcattataattagcgattggtttgttgaatgcgttggatagctagaaaggagaggtctatagacatgtctctggctattgttgatcacagattttaattaatatttacagttcaaagcttctctctaggctggatgggcagggaagcttaggtttctaactagcatctatatcaaccttgtctggcgtccccttgccgtttttatgtcatccttgaggaataatctgtttttaaaatttaattcaacagctttgttttgaattctcactctgtaccaagcgctatgccagagactaggctaccagtgtggttaagacagagtttgtgtcctgaaggagctcataaaggaaacagagctgcccaattggctgtgatacaggcagtaagaacagagtgcagtgtgggctcagaggaggaggtgatctattggtccttggtgggggggcagagtgggcacatgtggacatgatggggggtctcagctgcacagagaaggtaacatatgagcaggacctaatagaaaaaggacttaaaatgtctctttttagccttcaatgctacctgaccccccacttggaacatctactccccagtggacccatggcacacttgccgtctcttctgccattgggggagtccactggcatgatgggaagaggggaagagagcagagaagcctgaagtgtggtgctgagagctttccctctcccctccctaactctgtttattcttgtgacagtgttcccacagaggatccctccggggagtccctaatcatcagccctgaggagtttgagcgaatcaaatgggcatcccatgtcctgaccagagaagaacttgaggccagggaccaggccttcaagaaggagaaggaagccaccatggtagttaacctccctaagccttcacctctgcagatgggtggcagaatcaaaatgcactggggaactctcatcaggggnnnnnnnnnnnnnnnnnnnnnnnnnnnnnnnnnnnnnnnnnnnnnnnnnnnnnnnnnnnnnnngagcagccggggccaaggggagggctgagtaatgaagccaggctgtggaacttcttggctctgacatcatcactggccaaggcaaaattgtactgggtcacctgtggtagccaggctagcgcccagggcacagagcgcatgaaataatctcccactgagccagactggtctcccttaggatgcagtgatgacacgaaagaagatcatgaaacagaaggagatggtgtggaacaacaacaagaagctcagtgacctggaggaggtggccaaggaacgggcccagaacctcctgcagagagccaacaagctgcggatggagcaggaggaggagctcaaggacatgagcaaggtgggctcttcgtctctcccttccctctgagcattcactgccatccctccgccctccccttattcccgcactggacaaggccagggactggtgggggtgtgggcaggggtggggcgggggagagctgcacctgctgtggtagttgcagtgatcacagtgaggactggctctgccacctgttcgctgtgtgaccatgggcaagtcacttgccctccctgagcctcactttcttcatttgtaacttgagggtggtaaaactactttgtggaatcattggcaggatgaaataaggtagtagatgggagaggctttgtgggctgaggattggtaaattaaatgtgcagtgttacttttattttcatcctgttagttcagttctggccacgtatggtggtcgaggcaattggatgcttttggagtacccaaagcttttcctttggctgagagcctaaagaccagaggctcatttgaattctgttgtaactcatttgcatgtggttcacttccttaccaaatgaaaagtgctgattccccaatccctgcacctctgatttctgtctctcaggtaaatcttctctatgtatgcctcctttaattttctaaaggttttacttttgggttcttattcatgggcccgtggtttttcatcccttttgtgtcatgttgggctcttccagcttaaaaatcttgtggcctggcctctgcaagagtgtcttagctcccctgaggagaacaaggggtccaacctggagttcatgggtctctaagtggaacaatggacctctgaagttttatagaaattttgtgtgtacatgtataagtgagttttatggaggagagggccgttgctttcatcatatttccaaagggtgacccattaccaccaaaaccctaagatgtagctccctgaaagatgctattccaggcccctccttgcacagaccctggcacctagcaggaggccagtaaatctttgagctaaactatattaaggggaaaggtaaatataagaacattcttatttccccggacttgtgagcagtcatgcacacctccagcatgctcagcagtatagcattctgtttccatttcttccccttaaacttacacatccctaggcctagtgctacagtttaatctccactctccagattatcctcaatgctaagtgccatgccatccgggatgcccaaatcctggagaagcagcagatccaaaaagaactggacacagaagagaagcggttggatcagatgatggaagtggagcggcagaaatccattcaaaggcaggaggaactggagaggaagaggagggaggaaagaattaggtaaagatgtggttttggcatctccctctctaagctatttccatgtatctttaggtccatgtagcctagcaaagagggaagagatgagaaatggtcattattgtcatctacttattatctcaaaactttacgaagtgatacatagaatcacagaacttttttttttttttagagggagtctcactctgtcgcccaggctctggagtgcagtggcataatctcggctcactgtaacctccacctcccgggttcaagcgattctcctgcttcagcttcccaagtagctgggattacaggcatgcacatccacacccggctaatttttgtatttagaagagatggggtttcaccatgttggccaggctggtctcaaactcctgacctcaagtgatcccccggcctcagcctcccaaagtgctgggattacaggcgtgagcccggccagaatcacagaatttttagaagcttatttcccaaatcctaggaggcacttcacagtctggctgcaatcaatctcgtttctcacccctacctgccatctactctgtgctttttcccaggcccccaacatgccaggccttgtgacaagttcttaatttttttttgttttctcttttttgaatacccttttctttccttttcctcctggaaaatgctgtctccttccctttatatatagctttgctgtcacctccctcatgtcactaggcaggcttagtggctcccttctctgtgcccatcactctgtgtttatgctccagcatcccactcttgtgctgtggctttctgaccctcctagatgctacgctcattgcggacaggtcctttcgtatccagttctgtagcttctgagcctagcagagtgtttggcctgtaataggtgcttaattcatgttgggatgaataaattcagtctccccttcattttgtgcagaaaaggacaagtcccagagcaagtaaattatagaataatagtgtcctagatttagaacgccaaccatacaatacatgaattacctttataaataatctttgtaccacactgaatggcagttttatctccccaactgtatcctgttctctggaaccattcatctctgtgtcttgtgtactatacctggtacattcacctctgtacttctggtaggtacctggtatactatagtaggttcccagtgaaaggttactgagtggctaagtggctgtccatcttctgcataaacagctccagcaaaggaaaactctgtcttgttaggcaactgtaatgatttgagctggtccttgtattgagcccaaacttgttttcatgtaacccttttactctttactcctgtttacttcatctggagtcatgaagccattcgagcactccatctgaatgtggctctcatactctttcccctcaattctgatcctaatatgtgtcttctcccgttcttccagcctttactcatatgtcatggggtctatgcttccaagtttattgacatcccactaacacatagggaatcactgacaacattgcttgtacaccctgggtttgtttgtttgtttgtttgtttggctttttactattcagctagcttcctatgattactctgggaagaattgggaggtggtaggatttcagaaactctttatatactggaaggtagaaggtgttttatcaagtggggtacccctcttggacaaacaaataaagaaggagaatctcaggaagagtgagccctggaaccaggagctcaggagaaaggaggccaacccttgaggtccttcctgggggagggactttggtctgggctcatgaagcatattcatgtttagggggcacttgtcaaattgtttcggtgacaccacccatcttgggggttgtttaggtggaggttggactctgggagatgtggacccggggtttctaagacactgtggcactgttctctccaagaggaaggcggcaaattgtggaacagatggaaaagaaccaggaggagcgatcgctgcttgctgagcagcgggagcaggagaaggagcagatgctggaatatatggaacagctccaagaggaagatctaaaggtaacaggccagacagacaatgccacgtttcaccagctgcagcatcaaaacccttcaagactctggggtttcagggtgttgactgattttctgccaggcacatgctcatttcacaacatcatcaccgtcaactttttattgccatgttaaatatttatttcaccatggtgtcacgctgcgggatgagcagtgatttggatagatattgtcccttccttccaaggacttgaggtccaagactgacatatcactgtgaatagacacataaaggaaatatatggctgcatgctttgcacaagtaaacatagggatgttttatagtcttccttcaatcacctagggatattatatactttgtagatgaacagtagcaatatcttagttccagactccctgctgttacttcactcaaagtacatagcatcccattgtcattaactgtgttgtgaagccaaaccttttcttcctgttagtccaaataaaattagtaagcatatttattgcaaaagaaatgacaacatacctgcccaaactaagaagacttaaaaagtcatcttctgtatgccttctctgggctgtaacaatgtataaaaccctttagcacagtgagggacatggcaggcacttggataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattccataatatcatctaatagttaatccacattcacattccccaattgttccaaatatgtattttctggctctcttgtttccaaactagactttaatcaaggtttgcacattgcattccgttgagcctctttagtttgttttgatctagaagagttcccccattcattcattcattcattcattcattcagttcttcattcatttttataacactgatattttgaagcatctaggccagttgcctttaagaatatctcacattctgaatttgtatgattgcctcctcatggtgccatttaacttgtggaacacgtattcttttacgattctctccctcccctgtgtttatgaattgtcaagttgtcatcagctagtgcatttgatggtggtgagtgacagggggacgtgaagagtgctgcaggtgggcagacttgtaattatgaagtcttctcatcacatctgcagtgtgaggagctgctagagaagtgcaatgaagatcacctgggtagttgggaaactgaaggggcacacagctctgtgaactgcatgagaaggagaatagcagggtgaaggcaatgagagacctggccaagttactccatttcctggctcaggggagagagagtgggaaagggccaagaaggaaagttatggggcaaatatgcaaggtagtgggtgagaagtgagggcaggaaaatccaactagatgtggggagtgggaattagtgggctcactgaggaagttctaggagtccatgagtcagcaccattatgttgatgttgtgtcattatccttttaatgtccttctaacaggcactccctgagtctccaggaagtattattgggcaactttagcaaggaaacctgtgccttcccagctttagacctactgtatcatctcatggtggtacgaagggcagcgtttcccaccttgctaacaaagggggaaagagtgaagggaatttatctggggttgctttggaagggcttcaaaagaaacagggaaagtcctttggtgtcttggaattgaaatgagccaacaaaaacaacaatccaaaaagtaaataaatagggaaagaagtaaataaatacatgattgtatgtatgtcatacatcagaaatcaacagcatctttagctttgagggccagtgagattaaatgatgtctgggatacaaatagcaggcctaaaatcagtgagaagcagttaggaaggaaaggaagaaagggagaagggggaaaaggagcgagagagttggaggggcagaaagggaaaagtggagtgagcaaagaaatgagtatggtgagagagagagggaatgtctgtgactcacgcaccacatggacctcagaggcagagagttgccataccgctctggttcagaagccttcctgaaggaagaagccttgaactgggcagtgagccaagctggcagagagccagcactacaggaagacacacagggagagttaccttggttagatgaatcagggcagcagctgggctgaggaagacctggaaggccagggagggatttagtctttggagaaatggagggagctggaaacagtgtgggaggtggggtgagttaatcaatagaagaacttaaggagtctgagattgattggaggtgattggggggccagctgttcccctaattccgatgcccctctgcacctgagaatgtgcttggctcagaagtggtctgatcattgagagctgttgaaggctcaggtctgggaaaggcagggggatccttccttaaaaacgaccttgttcacattggtactctgatctccgtcaaatgtttccctgtgtctaagaactttttttctttcctttctcacatgcctctcactttggtcctacctttcctgcctcatttatcaatggtttatcgaatatttgctattttccttgcattgggctacatgttgttggggaagagaggatgtgtgacacaaggtcccttgtcctgtaactggggcagagcgaacacatatgaaatgagtggggacctgcaaggcagtgtatgatcaccttgcaagaggtgtgtcgccaccttaagtgcagagagaatttagaaatggagagagaattgaaagttgaggcaatcaagcaagatttccagagaaggttgatactttaatttagacagaacaggtttcaaaattttagctctggagattataagctgtgtggccggtggggaagtcacttcaatgctgggcctcagtttctttattggagcaagagagataacaaggcctacctaccttttaggatttttggacatatttaggtattagagatagtctgtgtacagtgctcaagaaatagaaagcactcaattaaggcaatatgtattatttcagtcgtcactattgactggagagtgaaagttaggtttaaatgggagaggaacattgaaggcaggagaagcaccatgagcaaagccacaggggtaggatttagcaaaacatgtgagaggcaattgtatggaactttaagagcttctgcttcctgaaaatatagagatcaatagcatcaggggctgccacaaagtcaagttggatgaagactgtaaataggccatttggttgaagagggtatttatgacccttgaaaaaacagctttaacaaaggatagttgtggacactagactgcaggcaatgcatttgccccctcctctgtctgcatctctctatccctggatgccagtggcttcttgtcttacctctttgtactctgaggctctctttcttttgctggcaggacatggaacgaaggcagcaacaaaaactgaagatgcaagctgagattaagcgcatcaatgatgaaaaccagaaacagaaagcagaactgctggctcaggagaagctggcagaccagatggtgatggagtttaccaagaagaagatggtagggacttggtttctgggacctttggttaggaatggaatgtctgtcacagggagaggagggcctgagaactaagggaactccagtggaaggcagccgcaccttcattctaagatgcacatccttagttcaagggcctggcttctttgtctcttcatcttagccagtccacttgttcgttaacagagacagcctagaaaggacaaccaaattagctttaacctcattaacacctttgattagaagttgggatgagggccatatgcaggcagaaaagaaaactgaaactattggtgaaagtgagtttttttgtggatttgtcatgacttgcgtaattatacccccggtaatcatgagtcagcggttacataaatttcttgtgcaaatgcctatattggacatcctgtattgggtgctagactcagaaaatagtcttcccccatctcccaccaaagaacctatatgacagagcaaatgcacagtggaggagagagccatacctgcagacagttgcagatggatgtagctcatgaatgtgtcagctcattctggggcaaaattgagtaataaaatgattgggatctacggggattggagagtagaagaaggcttttaagagtggtatagataaagtgaacatggatttatgtaaaaagaggaggaagtactcaaggtggcaggaaagttattaaattcttcatgtgttgatcttgtctgccctgctagttttgaaattccatgatgacagaaacacattgtacttctctatgctcctctatagtagtgatttttaaagaaggccagggggagggtgtgagtataatttgaatggcatatttggtacacctatatgttctgaatacaaaccacagaaaatgaagctcagcgaagctcacttattggctttagtattcttattggatgctggggacactctatgcaagcaatagagtgagaatgcaggtttggggacatagatgattcctacataataacaatcacataactatcatttagtgagcacctagtctgtgcataggctccgtgctaagtgttttacacgtgttatctcttttaatctttacaataatcctgtgaaatggtcactgatgattcaaaatatactggatgcttcaatatgtgtccagtcagactaggctgaaaatacctaggataatgctgtaccattggaactcaaccactattttcccaagtgaatgaaggtggggatgatgagctaattctgtgtaggagttagtgcacatattttctggctgcagcagagggttggtagtggatataataagaaatgagggtggtgagatgacagagagctaagagcagttgttggggtgtcttggacattgagtggagctggaagagtggaatgataaggagtcgccatgaatttctaagcaagagaggagtatatcttgtctttatcatggaaaggacattgtcaaggtgtagctgggagaggctggagactggccacggaatcaggcacttgggcatgtccacagtccaccgtaagtatctacgtatatcacaagcccttaccgacctcacggtggtatctattcttgcagccagggctgcccctgcagagctaaaagcagaaattggttgtagaaacacccagagttccctgtcctgttatctagggcagggtggacaaaggaagcagcttgacaacagccccgtacaacttacagggacaactcactgggcttcacggaagtctgggcaggtagaatgagggcaaggaaggtttctgtttttnnnnnnnnnnnnnnnnnnnntttttttttttttttttttttttttttttttttttttttttttcttagatgtagtcttgctctgtcactaggctggagtgcagtggtgcgatctcagctcactgcagcaacctctgccttccgggttcaagagattctcctgcctcagcctcccgagtagctgggactacaggcatgcgccaccatgctcagctaatttttgtatttttagtatagacactgtttcaccatgttggcctggattggtttgatctctttacgtcatgatctgcctgcctcagcctcccaaagtgctgggattacaggcatgagccaccatgcctggccgggaagattctttataaatgtcacatttgcctccaacctgcaccattcatcttacgattgctcaagaatggcgttgggaagcgggcttgggaagcttttaaggatatacctgttttttcagagaggtggaaagggagctaattttggtggttcattctttaagtatctggtaaccactgtgggactgcccaaagcatggttggctctttgcccagggactaatgagataacctccacctgctgtactttacaagacaggcacaggaccagttgtttcttggcccagtagccttgcaacttgaaaattgtctatgacatagtggaaggagtgtgaaagccagggtcagggtacctgtgttcaaatcctgttaggtagtttacttcctgtgcaatcttgggcaagacccttgatctttctgaccatccatttcctcatctataatatctgtctcaggaaatgttgtgagggctctccaggataacacataggaaagtgttttgtaaacaataaagcattttataaatgctaattgttttatattcatgcattgctaaattcattttaccttatttatttatttatttatttatttatttatttattttgagacaaggtcttactctgttgcccaggggaatgcagtaatgcaatcatgattcactgcatcctcgacttcccaggttcaagcagtcctcctatctcagcttcccgagtagctgggactataggcacatgccaccatgcctggctaatttttagatttctagtagagacagagtctttctctgtggcctaggctggtcatgaactcctgggctcaagtggtcctcctgcctcaacctcccaaagtgctaggattataggcatgagccacggcacctggccttattttgtcctattttaaaaggagtcaggaagtggtaggggagatattggaaagtctgttgtaggggttttgtttctctctgcaaggctggggcaatggcaactattctacaaggcctttccttccggcaggctcgagaagcagagtttgaggctgagcaggagagaatccggagggagaaagagaaggagatcgcacgcttgagggccatgcaggagaaggcccaggattaccaggcagaacaggtacctgcttagtctcgacttccctctacttttcccactcccttgcctatccatccctttgacagcctgtagaatggccttgagggtggagatgcggaggaaaggatgcaagttacctagacttcagtagtctgagaaggaaggggtggcctgctcccagggcctgtgtcagcagggattgggcagtgcagcctgtgcttaaggttcaagagaaagtttttcgctgctccataaagaagaactttcaaccttaaccaaccaatgaaatgtgtcaccaggggaacctgtggtatctccatcattagcagtttttaaaattagaagcaatttcaagactgcctggagatgtctgaggtacagggaaagaactgggatgagtgggttggaaggacaagatgacccctcaggttatcttctaacccaaaggtttgatgacaggattccatttatcttttcctagaataactagctgccagagaaattcatgatgcttttcaaagcagactgtcagagtctgtaagtaggtatcttcttaaagccacttggtctgtacttccagctattttgtgccctcactggtcccctgccaacattcccaggatgccttgcgggccaagcgcaaccaggaggttgcagacagagagtggcgcagaaaggaaaaggaaaatgcgcggaagaagatggaaacagaggctgagctgcgaaaaagtcggctcgaacaggtggctttcaaggagcacgctctggctgttcaggtgcaacgggaccgggatgagttcgagaggattcttcggtaggaggggcctgggaaccttggattcctttccttgtactgtagcagggatggtccatattggatagagagaagctttctggcatgttaacagatgctcgtcgatcttgtctgggttggtgggatcattataactagatggatgattgaaacttttaaaaatcacttgagccaagaattatgtgattagagaattgggagatagcacctggaattgcttaaggaattggtgatgactgggattatttaccctggaacagtaaaagtataaataaaggtaaaattctggtccattctgctgccctctgacccatgtgcccctgcaaattggggatgaaactgcaagaggagtggtttaggaaagatagagaaaagaacttcagacactaagggttgtgagtcactggagcaggactttaagggagctgtttgccgttcatttgacaaatatatattaagcacagaaatgcagggctctgtgctggatgccatggaggacattagcaattaacaaaacactgctcttgcccattccacaggaaaggtattagagatttgtgtttggatggactgcacctacatcaatccatctttcttccttggtagctatttatccttttacttttgttttcccttttggctcaatgataatttcaacacataagtggaagctaaatgttcacatctctcactgttctgctccctccccaaaagcagtcaacagtcacagctcccattggtttccctctctgctctgttttccaccagtcagacctggtccctggggctgttctcctggtctaactgggaatgactctctttttgctctggttcagactctacaacattagaatttttcaaaaggaaacaagccaagcaaaattcgaattgaagggatacaaaattatagacattatgctcagataagtagagattaaacagtatagcatcactttcttggttcatatgctctaagtccttcctcttggcaatgggtagttagtggcatgccagaccaggctacccagacccctagttagaggcagagcaggtcttcgggagcctctatccttacgagagccagatttttggccttttattggactgcaggccccagcatgtcccccctgccatgataccctttggctctgtaattttctctgcccccagggttgtgccatggtcactggacacctagtgaagaaagtagcttcctaaatgccccccaagattctgcccttgggctacagactgccttccagatgtctcctctctcctccctggcctctatgcccttggacatctgtgttgctgttaacaggcactaataaatattaatgaaatgaaatttaagtcctacttttgctgccgacccatttatctttcctttgcatcatttgcctgaagcatatgcactagccagttattaaagctagaccagcctttttggagaagttcaacttcacctattgttgtaggttagtatctaggcctagtgtctccagggccatgtgaccaccatgttttgtgtctttactcagaagcatctctgccacagcccaaatccaactttctctgcctcaaaagcacagcctcctctatggcctatatgtggacttttgtttctggacagagggatgtccatacttctcagcctgttgactaagcagagatagctgtcttcctctaccaagtggtttttagaaatgtcttggagcttttgaaaaatacgatgaccaggcttcacttcctagattgtgatttaaatggtctgggattaggcccatgcatgagtctgtttcaaaagctcccaggtgattctaaaatgtagctaggctctgtgatcactgccctaacccgatggaacgaccaggttcatcctcatttggattttcaactgcctggcaccaccggggctctctagtgacacatacaagtcccccttttccacacttaccccttcactcagaagagggtgaaacaatagaaaactgttctaaatataggaaaacaatggcaaggcaaagaggagagtccccctgctatcagagatgtgtctgggaagtcaggatttggtgtctaaatacagagggctgaggaagccaacagtattcttcgggtaaactgggaagtctctgtagaaggcacagaattttaggagatgtttgcatgatggaaagagtttctgggagtggggaggatgccgcatgtatggtggatcttggaagaaagctagagggaaatgaggaaatgaagcagtgttgtaggtaccttttgttggggtatcggtgactctaggggaggagagcaggtgagaaattcctgcctaagatgattttacatttcattttttaaattatgttgagaacaaaattagatgttagcttaagaaggcctataaatgcatttttttctgagatgcgaatgcatttcatttgagtgttttctgagcctttcctgttgccattagtgattttctccctgatgtcagggtccatcaggtatttttgtggaagaggtttctaagggaaatttggagaggtggatcaggaagagaactgagcgatatcaggctgagctccttccttccagtaaccagggtggagctagcatgacactttatgcatcttttacatttccaagcatagagggagggagggagggaggcaggaaaggaaggaaggaagcaaggaagaaggaaggaaggaaggaaggaaggaaggaaggagaagaaatctcaggataagctggagaggagttatacattgttatcaggggagaagtaggaacaatagttcccagtgggtgaaaccctgggtgtaaggactggttgcataattttcagggcccagtgaatattgagaatgtgtagcttgggcaatgtaatgagacttcatctctacaaataataaacaaaaaattagctgggtgtggtggcactctcttgtggtcccagctactcgggaggctgaggtgggagaatcacttgagcccaggtggttgaggctgcggtgagctatgatagcaccactgcattccagcctgggtgacagagcaagagagtgtggactcccttgttcaaaaattattaagaatttcaaaacagtgaaagcagagcatcaaaccaagctgggggcccttctaagcatgcccatgacatacagtcatgcgaccctggagctagtcctggctgggtaggagaagggggcatgcatgtgcagcagcttttgggggctgatccttgagttacaaaatggggctggagcccagagggctgtggtctctgaggcatgtctactgaaggagcccacccaggaggctcccccaccacctttcctggcctgggccagctcagctgagttcattccattcctgtttccctcccccagggctcagagagaacagattgagaaggagcggctggaggaggagaaaaaggccacagggcgcttacagcatgccaatgagctccggcgccaggtgcgcgagaaccagcagaaggaagtgcagaaccggattgccacctttgaggagggccggcgcctcaaagaggaggcccagaaacgccgtgagcgcatcgatgagatcaagaggaaaaagcttgaagagctgaggtgcgctggaatctcctcctttcccaaatcctcttccctcccgcaaagagatggcaccacaggctggaaagcatggggatttgggggtgaagggccatggcagagatgctcagggagaggctcttctccccacccagggctcatccctctgaagggggctccagcagaaagtcctgggatggggtcttgctggctctctgggagctccttggcaggatgctggagccttggcatgaatgtgtgtttcgggggtggattgtgagagcagggttggggggtgcaggcccccaggttctgtaaaccccacccagagcctgcttcctcccacctcctgtctggtccaatacctttccttatacctgcctgcgtttccccggcagagccactggccttcccgagaagtactgcattgaagctgagcgcaaagctaacatcctgccagctacctctgtgaactgaggggagccttcgtggccctcaggatgccttcgggggacagattctgcccagtctctgggcatccataattgctgctaacctagacatttcatagttacagattaaatctacttgactttaaggaacagcttggctttcttgtgggaatgtggctgctacagggtactgaaggtggagtaaaataggatggggggaacccgagtgtgggtggtgtggggctgagggtaagggaatgggaagatgctcttttatgatggtttctcctaagccaggaggtccctttgtcctggtgtctcctggcctttttgtgattccctgggatcacaatcttgtctcagctccaccctgacgcccagttcagaagcatttcagggcattgaggcagagctacagttgcctctcagtgggggctggggcaaggcttggccaggcggagctggtgaaggaggcaccagggccaggtgaggcaaggctcttactgggatcacacccatgactcagatcacatctgtggagggagtgaagtttgaacctggggctcactctgcctgtctcagctctctcccaccagaaccctttcaattccaggcaatgctgcaacacagacacaggcccatgccccactagggcacaccaagagccctgcactccccaccctgccagtccagtcccctcacccgaactcagcccctcctgtggctgggctctcctcagtccacctcactcccataggtggggctcccaaaccattttcgtctgtttttaacttgtctcactttgccccaaactatactttaatcattcattcacttattcagatactgactgagtgcctaccacatgccaggtacatttcaggcactcactgagcacaacagaccttgctgcccactcagaagctgctcatttatgccggtctgctcctgttttctcccctgagctgctcccaccaaatttcttgtacctttggaatcatctctgcctttttggcctctcacctggttgtcaggtgcccctttggggctggactgctagcttctagggatggagccatgtaccctgtttttgtatgcctaggggaaagggctttcctccagctgctgtgacaatgaggtccctctctacccctggggatggattcatctctcaaatccagagcccagtcttgccttccctgatgggccctgcactagaggaggtgaggaatctgttgggtgcgtcctggatgtttacaactccaggttacaagggcctcaggcaagagtcctcttttcatagggcccagggagagtcagtaagctgtttcctgtgcttccttttcctcaggacagccacagcttccccaggtgccttctccaccttttccaccaggaaagattgttgccccgcccgaccaactgtttgggaaagaggctttctcaccgtccctgctcagcacctttaactgcaaccctccttcctagggaagctgatgccttcctccctaggggtcttgggaagatgtggtacccagcctcggatgggagagaagacatggcaatgccgctgaggattctgggactcatctgcagttggggcactggcaaaggttctctctgagcatcacctgttgcttagctgatgcctgcagggaccagggaacaaggctttgcctagttcaggagacactctttcccaggaaagctagaaagagcctgggtgcttaagagtttgcctaggctcacacctaagtcatccatctcagggctggaaaaaatgggccactatggagaaaggattgaggagaaagggggttccacacccactgctaacttctgagcccacttagacaaaaatgggccaacatcacaggttgacagtaaggccagcatttgaccagagctgctgctggtgaaaatgtaggtctttgggtccgggaagatcccaaagccttactaaaagtgagtgagactgtcgactgggcctggacacaggggcagttataggttacgtgaataaaggtctggctttggagaagagagaatatagccacttctgagcaagtgaagatggtttgggagagaatctcagggctctgcctcagggttgacccttttactctcatcaggagttctccat

SEQ ID NO: 16452 - DNA, 52971 bp, Human
  misc_feature (1)...(52971): n = A,T,C or G
ctgagacctgtataggtgaaatgtgaaatgggtcttcataatctttcagttttcttttctgctcctaatttcttgctgggcagtacagaaggaaaaacaaagatgtcataatatttgagggcaaacatccattgttgagtgtacttatatatcataattaaaaaaaagaacctaatggaaaaatagacaatttagaagaaaaattgtaaatgttcaataaataattaaaatagttccacctcactagtaatgaaagaaatgcaagaaaaaaaaagttaagttacttttttggggggagggtcttagatttataaaacaaaacaacaaatagctgatagcagcctgtgtgcaaaatgggcacctccataaacttcatgagactgtatattgatacagtgtttttacatttaaactatatgtactaaaatgttaagtgcacatattctattcctgagcaatctcacaggtctttagcctagggcagtaataatgcaaataggctagattatgtgtagaagtatcttcagtaggctcttctgatagccaaaaattggcggacaaaatgcctgttagaataatataagtgtagtacatttgtcccttgtagttaaaaagaatgaggttatgtttatatgtacttccatgagatccatattatatagttaagtgaggaagaagtttgcagaacaacatcataacgtgatccccactttcataaaatactaaagcctatgtctatgtgtaactgcattaaaaatctgaaaggatacacttcaaactgttagtagttgttacctctggggacttccatttccagtcatgatagaataacaagagccagatttaccttcccaccttaactatacaactgaacaaaatgtatgaaacaaaggttcatacattgctcacagatgttgggcaacaggcagtgcaggaaaataattctccagagaaggcaaataaacaaggtgagtcctgtgattgtcgtagattactgcctagagagtttttaggcttcagtgaagaggggaatcccttggtctttctgaggagacataaatttagagtgtggggaagcaaagatggctagattttgttgggcaaaataccggagaagagggggctgcagagagagagcactagagatctgcaggatgtcttctcaggtctttgtttgagtactgatctgcatgtgagaaaactattcaaaacctgaaaaaggaccactggaaaggagaaggcagagcaatccccagagttcacactagtgaactgggactagtttgtgttcctacttgccagaaaggaaagacttcctaatattacagggcttcaaatagagacctcagatggctattgctttaatagtggttccagattaagcctagaatgaaggctgctgtagcccctctgtaataaaacctaaaagcaagccttgaaaggatcaactgattccaagtaacttaattgtatcctagagcaaagcccaagaatatgtaaaggaatatgacaaaaatctagtaccaaacataaaattcacgatgtctggcatccagtaaaaaatcatcaagcatgtcgaatgaatgaacctaggattaaccttgatgtttctttttcttatcagaattgacagaaggtgacatcatggggcttagttagctcattgtatcattttctatttttttcagggctcagctttcaccccaaaagaccttggatcctgactagtttacataatggggtcatccagttatgggactatcggatgtgcactctcattgacaagtttgatgaacatgatggtgagatatttctaggaggaagttaaaggagtataagtatttataatatcctggggtattttaagccttgtttgacatggattcctctatgattaaagaatgtggaaatgatagaactgaaaaatcctgaataggaatcaccttagagattagaaaggatagctctgtctaacatacattgcctgccttctccaccaggtccagtgcgaggcattgacttccataagcagcagccactgttcgtctctggaggagatgactataagattaaggtacagagggtctgtcataactgagaataaaggaaagaggatgtgggaaggtttgggaatcatgaaaggaactgaaagacaggaaatttcattcatacagagctcaggcctttgacaacattatccggagaacttactcagcaaacatttattgaatgcttactgtgtaccagacactgttttctttttagggaattcaaaaataaataagaaatggcttctgttttcaaggagcttttattctaatacagaagataaacatatatccaagtaatagcatgtacagtttggtaagcaatataatagagagatattcacagtgaaataggaaagagcagtataggtgcaaagacaaaaagcatgacacagctagatacagggcagctgttattggttttgtatggagaaaacctggagaaatggtgagagaaggggcagaagatgagaggggccagatcatggagtacctgtttgtggcgctcaggagtttagatgttatcatgcagataactaggagccatttgaggaacttaaatacaggagtgataccagatttatatgtttttaaaatgattacttggtggtaattaaagaaaagattggatgatttgggcaagacaggaggcaaaaataccagttaggaaacctgagcttaggtagtagcatttgaaatggagagaaggagatggatgtgagaatttaaggaaatgaatcagtgtgtctgttgggtgatggccaataaggagaaataaatgagatggccaataaggagaaataagggccaataaggagaaataaatgagctgactttcaggcttctagtttaggtcactgggtaaagggggtgtcattaactaggaaaggaaaatcaggaggagatagttttctggagtggaagagaatggataatgaattccatcttgtctctggtgattttgagggacctaagggacagtctagttgaggtgtctgtgctagaaatatatttgtgatttgtcgtcatgaagggaggagccaaaggagaagcagtagaagatattgctcaaggagtacgttgaataagaagacagaccatcatttaagggagagagaggaagtagagttagtatgggaaacagtgattcgaggggttcgagatgaaccaagagggagaagaagcctcttggatgccaaggaagaagagaattttgggaaggagaaagtgttcagaataagatcaagattgagaaataacctttgaattgcttaatttggaaggccttagtgtgaaatgaggaagcagacagaatataggcaattctttaaagacaactgactatcataatagcaaaagttagagccagagactagcaacctataaaaataaatcaaaatttcctctgtttacttcctttagttgttttcattaagtctatgtgtcaaaccgaaccagtgaaatttaattcataaaaaggtaaagtcttttcataagcaacttcaagaagttatatattgtgattataccgcagaacttaggtgatgggagtaaagagtgacagctgcctacagagaaaagagctattagaattataggaaggacatttctttctgttttctagtttttaggcaccacatcctggggcaatcaaaactcaaaccacctgacagatctcaaaagcccataaggatatcacctcattatagtatttttgtatttgttatttatagtgatgaacattgagtatcaagaatggttaacttgggattcttataatctgtttaaaaaggaaaaactgggtgttaattaagaaaaagttttcccaaaatgactaatattttggaaaagaaattatcttccacttatgaaatgtccagaataggtaaatctatagagacagaaagtaggttagtgattgtctagggttggaggggttgggaggaaatgagaagtgacagctaatgggtatgaatttcttaggggagtgaataaaaatgttctaaaatggatggttgcacaactgtgaatatattaaaagccattgagttttatactttatatgaataaattgtatggtatttgaactgtatctcaataaagctgttattaaaacaaaggaattctttattagctggtaggtgtgtagtgctatcatttggtgggtttttttggtttgttttttgtttgtttgtttgtttgtttgtttgttttttgcgatggagtcttgttctgttgcccaggctggagtgcagtggcgtgatctcggctcactgcagcctccacctcccgggttcaagtggttctcctgcctcagcctcccgagtagctggaattacaggcatgcgccaccaagcccggctaattttgtatttttagtagagatggggtttctccatgttggtcaggctggtcttgaactcccgacctcgggtcgtcttcctgcctcggcctcccaaagtgctgggattacaggcgtgagccaccgcacccggcccattcggtggttttaattaatttctctgatgactaataaacttgaacatttttccataaaaagggggattatctagaaaagtcatgtctgtggaccatcttattgcttgctatatccagataaatgtagcattagttataatcctcgttgacaaagagtaagacaaggagcccagcaaatggtcagagtattcatctaaaacccctataagtttttaaggatttacagttttggagcttgacttaggccattaaaggagtcaagacattttgaaactagaaatatgaaagtttaaaacactgaactctataaggggaaaaaagtcagttaaagaatagtgtttatggtatggtctaatttttatgtgaaactctactgtgtacatgtgtatttatatgtagctgattgaatagatagaggcaaaggtattggaataccttaacttttcatgttattcttatttccatacataatgcttactgagcacttacctaatgtcaggcactgtgttaggtggtaagggtatagtgttgagcatgatggacaagaaccctgcctttaaggaactcagcattcttgtttggaagatcatacttttggattgtctggacttgttataggaaatgaaatttttataatttactgaagaaaagttaaaaattagaaatagtaacaagctggcccagattgattataaacaaatattaaaaagaaatttaaaaaaattaaataagaagaaaaatgcatctggtctcttatttttgtacattttaggggattttctgaatgaggaagataagctattttatatttatgatcctggttttcatgtcttcagttgtgttcattgatgcctagtactttggtagttgactcaacttcacatctgaatatgatattgtttctctgcttagctcaggcttactgagcaatgtagtattttccatgtaataagttaaggtctgtttgcttgacaggtgagtacagaccacacatgtatgggcgttgtttgccatcaagttaggagcctaagaagctgatgccctatattattgtttcccttggagtcatggtatctatctgtcctacttttttttttttttttgagaccgagcctctctctgtcgcccaggctggagtgcagtggagcgatctcaactcactgcaaacgccgcctcccaggttcaagtgatcctgctgccgcagcctcccaagtagctgggatcacatccggctaatttttttttgtatttttgtagagacagggtttccccatgttggccaggccggtcccaaactcctgacctcaggtgatccccctgccttgacctcccaaagtgctgggattacaggtatgagccatcgtgcccagcctgtcatactttttaaaagtgatgggtaaagcacttaaggggtctatattcaagccaagagcacaattttgcagtagaaaaaagagttgcaaatcaagccctggataaatatctcctgctattaaatgcagatggcttcttcccaaagaaagaaaaacttttttttttttttttttttttgagactgagtctcgctctgttacccaggctggagtacaatggcatgatttcggctcactgcaacctcttgtatcctgagttcaagcgattctcctgcctcagcctcccgagtagctgggactacaggcacatgccaccacgcctggctaattttttgtatttttagtagagacagggtttcactatgttagccaggatggtctcgatctcctgaccttgtgatccacccgcctcgacctcccaaagtgctgggattacaggcatgagtgaccacgcccagcctgaaaaacttcaataattttatctttagcttttccctaatcctaccccaaccccatgttgtttatctgacctatattttcattcttgttcttttcccctcaaatcttaaacaaggctttctaccaaggttcctacctatttagaaatgccaaaatacaaataatgtatataaatctatatttatatacatatttctatctctgtaaagatatcaatttctctgagccttttagaggctcaataactatttctgtttcttagtttgatttgtctttgcaggtttggaattacaagcttcggcgctgtcttttcacattgcttgggcacttagattatattcgcaccacgttttttcatcatgtaagtagtcatggtggcgctagttttggagcattcttagtttccccatagtaatctttatttgatccttgagaacccatgttttaataatagagttgtttttggagtggctcttctacaatctgtgtggtattgtcctttctgctttttttctttctgcaaaaggaagcacttgggattatactgaatttaattttattggattcagtggattctatgggaagtcattgtttctctgtagggaaaagtagggatttgatttcagatttgctgaaccaaaaaacaaaagtttgccagctaatcccatgtagggtattattagtaagtagtaggtgtgtctggaagaaggtcagactaagatgccattttgatcagctaacaaacgtttcgaagtattaacaatcatacccctctatcctaggatttttgggtctggtggaggctgttcccttagccaggcttactactttctttgatctgccaggtaacatagtagatttagatagtgaggtgcagattacagactcccaacctctgaatccagttgcaccctgacaggatctccttatagttctgtgtattagcattaacttacactattctttgattgccagtaaattaagtctctttaattaagttagaaagaatatgatgaaataaacaatttactggttgagtatatattatttctttttttaattaaaaaattctaggataggagagaatgagaaaattacagcttaaacatttgagaatgataaccactcaataagataacttattaagtaggaattatttgtcattgccataaaggacttcctgaagacccttgcctagaacaagttgccatctacctggaaagttacgaaagaccttattttctttcattttaccagctcactaaatatgtgtgtgccttatacttgctaagctttgtgctaaatactgaaggtagagatactatctctattgaaaatagaaataccatctattttcagtgtttaacacaaagcttagcaagtgtagtaagaaggaagtgtaaataagaaatacttccttttctcaacaatcttatagactccaaaaaggctaaattgtctttacatgttactttctgctttgcttgctgagacctgggaattttttgaaactggacagaaagaagtcagacaataaaataatattcccatcctagagttaaaggtagaagagtctttcacaggatcttaatttacatgattaactgtatataaatacacacacacacacacatatagaagtaaatgtaaatgtatgtttcactatctgcctctgagaatgtattgtgcctctaactggcttccattcttaagtcttataggtgaaagtgccgaagttgagaaaagctgttagagtggtagagaaaaggagacagctaacctgatagcaaaagcagcagcccctttgctaatgtagctgagccgttaagcaatgcagttctttagagaaaaatgattacaagaacctgatagaacagatttgtttaatgtttaaagcctttgtctggaatatctttcaggaatatccctggattctgagtgcctccgatgatcagaccatccgagtgtggaactggcaatctagaacctgtgtttggtaaagcaggaggcagagggctcgaaaagagtcttcatttttcctagtttttcataatgagcttctcttagaacaatcttctcccttctcaaatggactatgtcggctgattaattactgattgtatttgtaggatgcttttaagtgcaaaataataaatgtagaggcaatcccatatatgaatctggacttccaataatttcttaccaggaagagaagtcatatagccttttagaacaagaacttttagctggttttcaattattttcccataaaacctgagtcaaggtctagacctttgtcttattttgtgtttggagctggagctttacatagaactttccatgaagagttagggaccatttaaagtgatggccttggcccggcgccatggctcatgcctgtaatcccagcactttgggaggccaaggcaggcaaatcacctgaggttagaagttcgagaccagcctggccaagatggtgaaaccccgtctctactaaaaatacaaaaataagctggacgcggtggcgtgtgcctatagtcccagctactcgggaggctgaggcggagaatcgcttgaactggggaggcagaggttgcagtgagccaagattgcgccactgcactccagcctgggcaacagagtgaaattccatctcaaaaaaataataacaataaaaaataaagtgatggcctttaaaagggataccctactaaaatctcacagataatttacagtatggattactgagattacatttattttgatattttaaaatatttttgagagaagagctatgtaatcttagtcctcctgaaattagtaatatttaaatactaaagcattagaggcaagaagagaactattgttaaaatagctgactgggcttattattattagttcagaattggtaggatgacctgcctttgtctccataaaagtaaaattggataagcatttattgaatatggagaaaggtatttagtttaggagtctgttgacttccacctctaatttggtattgtcttttttttttcttgcagtgtgttaacagggcacaaccattatgtgatgtgtgctcagttccaccccacagaagacttggtagtatcagccagcctggaccagactgtgcgcgtttgggatatttctggtgagctgcccaagttcagaggacaacctggtcatctctggtgcaaaactgcaattgcttaaaatagtgaggagagttgacttagaactggaaaatttagaatattctgttttataatagcatctttgtttctgaggttgttgaatttgctttgatggttcttcatattggaagtcttctctaagaaaagaggtaactctagaaaattcatttgatttgaagaaattttaactttctagttacatcagcttttgttaaaatctatttactgttgcaacatttgattaagaatcatgctttccactcaaataagaaaaaatacatctatgacaaaaagaaattttgagaatagattaatacagggaaacaagactcttggaccctatcgctttatttaaaaatagtaaaatctctctattacgtttcttctagtgcggggagcatggttgggttctaggagttggtgacttttatgtccagaataccttttttttttttctgagagggagtcttgctttgttgcccaggctggagcgcagtggtgtgatgatcttggctcactgcaacctccacctcccgggttcaagcaattctccctcagcctcctgagtagctgggactacagatgcatgtgaccacacctggctaatttttgtatcttaattagagatggggtttcaccatattggccaggctggtctcaaactcctgaccttgtgatctgcctgcctcggcctcccaaagtactgggactacaggtgtgagccaccgtggctggcctgtttttttttttttttttgagatggagtctcactctgtctcacccatgctgaaatgcagtggcgcaatctcggctcgctacaacctctgcctcccggattcaagcgtttcttgtgcctcataagtaactgagattacaggtgcacgccaccacgcacagctaatttttgtatttttagtagagacagggtttcaccatgttagccaggctggtctcgaactcctgacctcaggtgattctcctgcctcagcctcccaaagtgctgggattacagacatgagcccctgtgcctagcccagaataccttttaatggacagatttaggactagaaattaaataatttatagattatggatagttgggataattcctccttttacagtttacatatctttattttgagacaaggatttaaatgtttagtcttatatagaggagatctaagaaagtgctacctagagaatttaaatgtagagaatggactgtacctgtgagacctatggaagcgcttcatgttggaatagggaaatcaaacactaaatgctgtagttctctgaccagttagtatttgttgtttctttctttctttttttttaacttttatttatttatttttgccatgtgccaccatgcccagctaatttttgtatttttagtagagacagggtttcaccatgttggccaggctggtctcgagctcctgatctcaggtgatccacccacctttgcctcccagagtgctgagattataggcgcgagccaccatgcccagcctgttgtttctttgtattcatttccttagaaattcttggagatttgagttctttgaaatgtcagtgactggactacaaaacatgtttcattctatgaaaggaaggcccccctcatagatctttgtttggttctttgtaataaaggagtcatcctctgcattgtacagctgaggtgataactattcccaactccattgtggcatgggggactggggcaataatggcacttgttcttatagaccattaatgaacagcaagctgaaaatttggattctgagatacagcatttggaatactgcaatagcagtttaggttaatgtagcatagaaacaagacaagaggagatggggacaattgtagagtagaacctctagataatgctgtctttgtagttttcaaaggcatagaatgaaagggaggagtataaacaagaggtattggagatagggcagttgtattctctttccctagggctttgccattgcagtttttcatcagactgacaaggttttttgaagtacacccagatgtgaccagccatgccaacaggaggagctagacacaggcactgtgaacctgtgtcctctcctcactgccagtaccagggagcttagcatctactctcccagtaaccttgctatggctttccatggtttttcactgtgcacacattcaaagcactctctctgtctcaggatataggagcctgatgggcttggatcccaattcatgctattccagctgatcaggggcaatttttttttggggggggtggcggtggggacagagtctcactgttacccaggctggagtgcagtggcatgatctcagctcactacaacctccacctcctgggttcaagcaattatcctgcctcagtcttccaagtagctgggactacaagggcatgccaccatgcccagctaatttttgtgtgtttttagtagagacagggtttcactattttggccaggctagtctcgaactcctgacctcaagtgatccagctgcctcagcctcccaaagtgctgggattacaagcacgagccactgcccctggccggcaattattcagaatatcctttgtcaacctggattctgtgagagaattaagtgctatagaaagtactttcagtggctgttttcgtagttcttctaagaatggtatatagctaatgctattctagttcatagagaatttgttacatacctaaactgatgcctttcgggcattaaaacttaattcttttccagaacgccgggttgagaagggctccactgtaaaagtaatgtttgtgccacctgatgccagccttgcatgttccctgcagtctagccaatgcagtttgggggcagtcaggtggttggattcttggtggtcatgaaatgctcaaggcatgaaatacttttctttaccttttgcagacagagaacatttttacatcaaaattaagggccctagatcagagaagagagggagtgtgaccccatggggtttatacttgctcttgaatgtgtgaagtgcatggattactatgtaataaccttgcaattgctatactttatttatgtgatagtaagaattttgtgctagcttgctgtactaatgttaatgctctttttaccatttctaagtgttgttctttacccacaactcttgacttccagtaaccccttaaccagagtggaaggagatgctttggtatttaacaaagtgcaagaagcttttgggttagacttttatactttccttctctagaaatcagcatattctttttcagcagggttcttttttgctattgggttcaaataagtctgaaaacaggaagaggaattagctttccgatctgttaaagaccagtgcttatatttctgaaagggagaagttagttctgaatgagagtatgaatactcccaaatttagaggactagttctaatttttttgactatttttttttgaaagggacactctctgagttagttaagcagtaagagaatatagagatctttaaaggaaaacctatctcttggtacctctcccatagggattgaaccccacagggcttagcttaacctgaatcttttgtgttaccctggcaaaaactatttgtttaaaagggaatgtatttacaaacctacatataaaaggttactttcttaacttgagcttctaagtaaactgacagttaaattattttaatatgcttatacctttgcatgtcaagcccatgtaattcaggctcagtctctgaaaaggctactaaaaaagtattaatttgctgccaaatcctgttatcatccctctctttttcctgctttccctggtccgtattgggaggtgtgcatcaaactggtccattctgagagtgtcctctcctccctctggatttgggtagctgctgtagaaattttccatctgtcgttcagtcctagcgagcggcttgttgaaggctcaaatatttcttctctgagtatcttttcactgcctgtcaccattcatctgtctgtttttgcccttccccttttcccggatcattacacgcaaatgcaacaaagccttccattctgtcatacggctttccttttaatgtgtttgttgaagcttattggaggtgaagtttctcacagctgtctatctttgtattttcctttgaatctgtttcatataccagactcgttagaaaaagttgacagatcttattaaagggacaagtgaaataagtgaaaggaggcatcccagcgataaagtatttatgaacctttgggagagtatattgtaaaacatcagctttatttctctctacctactggctaaatgctcatcttggacagaggacaagataattaaaattgttgtggccttctaagctcttgcttctccagtgttaacatgtaggtgccaccataacagaagagatatattataattttaaaacaataaatataaatgcagttattaaacttaagttcttatattttcctacagatggcaaagtttaggcttaaaatgacttaggttttctttcctttttttgagacggagtttcactctgttgcccaggctggagtgcagtggcgggatctcagctcatcgcagcctccgtctcccgggttcaagtgattctcctgcctcagcctcccaggtagctgggattacaggcatgcaccaccacacccagctaatttttgtatttttagtagagacagggtttcaccatttgagccaggctggtctcaaactcctgacctcagttgttccacctgccttggcctcccaaagtgctgggattacaggtgtgagccaccgtgcccagcctcctttttttttaatttgagacggagtttcgttctttcgcccaggctggagtaaagtggtgcaatcttggctcactgcaacctccgcgctgcgccccccccagccccgccccccgggttcaagcaattcccctgcctcagcctccctagcagctgggattacaggcatgcgccatcatgcccgactaatttttgtatgtttagtagagacggggttttgccatgttagccaggcagacctcaaactcctgacctgcggtggttcacctgtctcagcctcccaaagtgctaggattacaggcgtgagccactgcgcccagcctttaggttttattttcaatgagagtttttattttccattacacataactgtctttttaaaaaatatttacaagtgctaggtaatttcatcttccactattcccccaaaatacttcaaaatataggattttagtctcaattctttttttctcatctacaaactgttataattttacctgcttgttcattccaaaggtttgttatcagagtccagttacataacatactctctgaaaaccacaaagtactttccgaatgtgagatagtagcagtgctatcataattttggttctgactatagcacaaatagcttttaaagatagatttacttgagccatatatgtgggtcctctacaaataagactattattattctggtgtctttttccatcgtttttaagttacaggataattcctcccagtaaaactagcctccaaaggttttaatggcaaaatccaagtattcaaatctataatcagccttttaagcaggaacttaaaatgacatgacagttttaattatcttgttcttcgtccaagagtcaagtagtaggcatgagtacactttttacatggcttatggttttacgttatcttctaccaaacagctgttttgtacttaataggcctagtttctgtaacccatttggaacttcccccatcagctgtcgaaaggcttcaagttgagaaacactgcactgtggcttcttcaaatggcttttcttttttgagatagggtctcaatgtcacccaggctggagtgcagtggcgccatcatggctcactgcagcctcgacttcctgggctcaagccatccccctatctctcagcctcccaagtagctgggactacaggctcgcgccactgcacctagctaatttttatattttttggagagacggggttttgccatgttgctcaggctgatctttaactcttgggctcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattctttaaaaaaaagaaaaaaatttctgaaatgatcggggaaaagctgctataaattttatgaagttgagagtagaaattgaatgtttaccatttggggccacatttcaagaacactgaagaatggaaagtgggcattaactgaagcagacacctcttgaggtaagatttgtggaagaagaggttaaagtgtgccagaaatttgggttaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtgtttctgatactgtgctgttttagataatattatgtttacatctttcatcccactccttatcccttcaaaggtctgaggaaaaaaaacctgtcccctggtgcggtggaatcggatgtgagaggaataactggggttgatctatttggaactacagatgcagtggtgaagcatgtactagaggtacttatctttatagccaggggctgaatatgggctgtcatcttgggaaagtcacagtatgttgttcatttattcattccttcaacaaatatttacagagtgcttattaagtgccaggcactgtttgaggtactagaaatcaaattgtgcgtgaaccaacagagaaatgaagcttatgtgccacctgagggagagtcttattaccttataaacccagtgggaaagggagaaagccaggcgtagacctcatcaccatcccaaagcagagcccattctcaagctttctgtaaggcagggcagcaggaaatttaatcggagttatcgagaaccagccatgtgtaacttttgtgcaggtgggaaaacagaaaagcataagggaaagaaactagtttttgttctaaaaaattatctaatcttcatagctacccactgaagtagatattattatccctatttagcagacaaaaaaaaaaaagagatttagagaaattaagtggtctaccaaaatctacatatatctagtaaataaatgtaagaaataagatttgaatttcgatctgactccaaaacccaggtgcttttcgctgcatcatgatacatctcaataatactgctaattcaaaactgccttatccaggattctgtcacaatataccatataactgtataaatagggtatacagtatcttaaaatcagcagttcttaaactttttggtctgaagatctctttatactcttaaaatttattgaggaccccaaagagtttttgtttatgtgggttatatctgtcaattttttaccacattttagattaaaacaacttttaaaaacatgaaatatatcagcacacattctattagctgtcagagcgatgatatcacatatcatgtgctgggaaactctattgtatacttacgaaagaataagaatgaagaagataaataggctgggtgcagtgggtcacacctgtaatctcagcactttgggagaccgaggccagaggattacttgaggccaggagtttgaaaccagcctaggcaacatagcaagaccttgtctctaccaaaaaaaaaaaaaaaaaaaattagctgggcgtggtggtgctcacttgtagtcctttgggaggccgaggtaggagaatcacttgatcctggaagtttgagacttcagggagcaattaatatgattgcaccactacactccagcctggatgacacagcaagacctcatcttaaaaaaaaaaaaaaaaaaaaaaagaatgaagaagacaaagtcttagtaatattatgaaaatagtttttaccttgcaaacttcttaaaataatcttggagctccttcaagaccagactgagatttctgcattaagttataaaagttttcgggcgggcgcagtggctcacgcctgtaatcccagcactgtgggaggccgaggcaagtgaatcatgaggccgggagttcaagaccagcctggccaagatggtgaaaccccatctctactaaaaatacaaaaaaattagccgggtatggtggtgggtgcctgtaatcccagctacttgggaggctgaggcagagaattacttgaacccgggaggcagaggttgcagtgagctgagatcgtgccactgcactccagcctgggtgacagagcgagactccgtctaaaaacaataaaaaataaaaaataaaatttgtctggagatattaataattatttgtagaaataagataaaaataggcaagtaaaaaacaaagcagaatatcctaaatgcaaatgaggctgagtttaggggttagaaatatgtatttggaaattcacatgagaatttggggtaatattggaggacagacatggtaattctgatgctcaaaattttagagcagcgtagtctcttgaatctgttcacatgaagaataaatcagagacattttttacaacgagtagcttgattcattggtttgctttgagtaatgactataaagatgttttagaagaaccactcttttctacagggtcacgatcgtggagtaaactgggctgccttccaccccactatgccccttattgtatctggggcagatgatcgtcaagtgaagatctggcgcatgaatggtgagtgaaccggttacattatcgccatatctaagaaactgccagccagcaaggtaaagtagccaggtcttctggactctgacctatttttctaccttaggtgattaattaatgctaatcccaggagcatagaaattattttacaaataaaatatatcatctttacaatttttatgtgtacagttaagtggtaataaatatatttatattctgttttcctccatttcctccttcaccctccttcccattctactctcgatcttaataatatccactttttagcttccacatgtgagtgagaacatgccatatttgtctctttgttcttcccttaacataatggcctccagttccatccattttgctgcaaataacaggatttcattcttttttatagctgaataatattccattgtgtgtgtgtgtgtgtgtgtgtgtgtgcacgtgcgcgtatgtaattttctttattcatcccttgatgagcacttaagttgattccgtattttggctattgtaaatagtgctgcaataaacaaacatggggatgcagataccgctttgatatatttatttcctttatttggatatatagccagtagtggaattgctggataatatgttagttctatttttagttttttgaggaacctccatactattctccattgtgactatactaatttacattcccaccaacagtgcaggagggttcccctttctccatacccttgccagcatctgttattgcctgtctttttgatacaagccattttacctgtggtgaaatgatatctcattgtggatttgattcgcatgtctttttttctatatatatgtatatatatttcagcctctgtgttaaggacacattgatttgcatttctctgataattattgatgagcattttgcccagacaatgtcctgggacatttccccaatgttttcttctagtagtttcatagtttctggtcttagatttaagtctttaatccttttttgatttgatttttgtgtgtggtgagagataggagtttcattcttctgcatatagttacccagttttcccaacactttattgtatgttcttggcacctttgttaaacatgagttagctatagatttgtggatttatatctgggtcctctgttctgttccattggtttatgtgtctgtttctgtgccagtaccacagtgttttggttactctagctttgtagcaaattttgaagtcaggtagtgtgatgcctccatctttgttctttttgctcagaattgctttggctatttggggtcttttgtgctgccatataaattttaggattttttttctgtttctgtgaagaatgtctttgatattttgatggggaatacaataaatctgtaaattactttaggtagtaatttaccctatcatttttacaatattctttcaacccacaagcatggactatctttccatttttgggggtcctcttcaacttttttcatcagagttttatagttttccttgtatggccctttcacttctttggttagagtgattcctgggcattttatattttttgtagttactataaatgggatttcttgattttttttcagattattcactattggcatatataaatgctactgatattttgagacaggatctcgctctgttgcccaggctggagtacagtggctcgatcttggcttactgaaacctccccctcccaggttcaagtgattctcatacttcagcgtctcgagtagctgggactacaggtgcacaccaccacacctggctaatttttgtactttttttagagacgaggtttcaccatgttggccaagctggtctcgaactcttgacctcaagtgatctgcccaccttggcctcccaaagtgctgggtttataggcatgagccactgcacctggtcatgctactgatttttgtatgttgattttgtatcccgcagctggactgaatttatcattttggttgagtcttaggtttttctaagtatatgataatgtcatctgtgaacaagggtaatttttccaatttgtttgtcctttatttgtttctcatacctacttgacctggccaggacttctagtgttttgtcgaataaaagtggtaaaagtgggcatccttgccttctggtccgtagagaaaaggccttcaattttttcccattaagtgtaatattagttgtaagtttatcatatatggcctttattgttttgaggtatgctctttctctacccatgttgataataacttttgttataaagggatgttgaattttatccaatgttttttcagcatctgcttaactatcatatggtttttatttttgattttgttaatgtgatatatcatgtttattgatgtatattgaaccattcttgcatccctgaaatgaatcccacttgatcttagtaaatgatcttatcagtatactattgaatttggtttgctaatattttgttgaggatttttgcatctatgttcatcagtgatatcggcctgtagttttctctttttgtggtgtccttgcctggttttgttatcagagtaatgctggcctcatagaatgagtttgaaaatattccctcctcttccttttttttttttttttttttttttaagagtttgaataggattggcattaattctttaaatgtttggtagaattcagcagtaaagcagtcaggtcctgggcttttctttgatgggagaatttttattaaggctttgatctaggcactggtttttagaagtttttctattttatcgtggttcaatcttttttttttttttttttttttttgagttggagtctcgctgtgttgcctaggctggagtgcagcagggcaatcttagctcactgcagcctccacctcctgggttcaaacaattctcctgcctcagcctcccaagtagctgggactacaggctgtgccaccatacccagctaatttttatgtttttagtagagacagggttttgccatgttgtccaggctggtcttgaactcctgacctcaagtgatccacctgtctccacctcccaaagtgctgggattacagacgtgggccaccatccctggcctcgtggttcaatctttgtaggttgtatgtgtctaggaatatatccatttcttgtaagttttctagtatgttggcatgtcattctcgtaatagtttctaatgattctttgtatttctgaggtctcagttgttatgtttcctttctcatttctgattttatttatttggatcttctctcctttttccttagttggtctagctaacagtttgttgatactatcttttcaaaaagcaagtgtttcgtttcattgatagtctgtattttttttagtctcaattttatttctgctctgatctttattgtttgttttcttctactaatttagggtttggcttgttttttattatctaggtccttgaggtgtatcattagattgttcatttggagtctttcctttttttttttttttttttgacataggtgtttatgttataaacttcattcttagtactgcttttgtcatatcccataaattttgttacattgtattgccattttcattcgtttcaagcaatttttaaatttccttcttaatttcttcattgatccattagtctttcaggaacatgttgtttaacttacatgtgtttgtattttctgaggttcctcttgttattgatttctagttctattgtgttcagaaaagatacttaatataatttctattttttacaattttttcaagcttgttttgtggcctaaagtatagtttattctggagagtgttccatgtgctgatgaaaagaatattctgtagccgttgggtgaaatgttctgtaaattgcagttaggcctattagatctagtatgtagtttaactccactgtttctttgttgatttactgtatggatgatctgtctgtttttgagagtggggtattagctctcctactattatcatattgtagtctacctctccttttggatctattagtgtttgctttatatacttgggagctttggtgttgggtgcacagatacttataattgttatttcctcttgctgaattgacccctttatcattatatagtgaccttctttgtctctttttacaatcttaggtttggtagtctgttttatctcatgtaagtatagctacgcctgctcttttctggtttccagtttcatggaatatctcccactccttcgttttcagtctatgtgtgtctgtataggtaaatgggtttcttgagggcagcatatagttaggtcttctctctttatccgtttagccactctatgccttttaattgaagaattgagagcatttacattcagtgatattattgataagcaaggacttattactgctgttttttgcttgttttctggttttgttttgtttttttttgaggcttctctcttccttttcttactgtcttcttttgtggttaagtgattttctttggtaatatgtcttaatttgatgctttttatttttagtgagtatatattaatagtttttgtgctgtaattaccatgagattcacaaaaaaaaatcttatagatagaataaggtattttaaagagatgacagcttattttatatcacaaacacaagaacaaaaacaaaggctaaaacacactcagaaattatacatttaactccatttctgttcctgcctttttgactatctctttaacatgttgctatagctattattgcttttgatatatttgtcttttgggcttcatagtaaagttataagtggattgtgtaccaccattatagtaatatagtcttctgggtttgtctatgaacttaattttacatcttgggttttatatcttgaaaagttttctttttgcacattagtgttttttttttttttttgttttttttttttttttttttttttacaaatattgtttattttaatgaagctggtacagacaatgtccatttaaaacccatatcccaggccaaaaagtacaaataaaatcaaaaagagcagtgttctgttgtattcatttctgcatgtatagctttattaattgctaatgaaaattagaacttttctgggatcttctgacaagatttttaaaaaatcttaaaatgccttttcttcaatgaagccatctttggagttagtcattactctctccttatcagttatcttgacttcaacccgatattcctcttcttttggtccagaccctcaaatttaagagtagcttgaagttaaggaaaggtcatttttccacagtttcagttctctgaaacacttccatctcccactgaaagtcacagtccaggagtgaagtaatcacatgctagaacatcagggccaattcgcaagttattatgaacgcttgcattggtcaatcttatttatcaccacaagcctgaaaatgcaatgtcctgaaaaaggtgggctctctgtgcacacgtaatttttaaaaaggagagggtaatatgaaggggactgaggcttgatcaccaaaaatcagcacaatgaaaataaacaataatgaataatgagcactagaattcagattaccagatgtttcaaagagatggggtgccagttttcaattccgtttttaacaccacattacaaaagaactatttttaaaaatgagaaaggattgagggaaaagaaaaaaaataaaaagaatatctaaactgttgaatgaccccccatttgttcctgataaacttcaatcacatcttcttcctccattcccagttcttttggagtatgattatcagcaattctctgaccctcaaagagaaacctgaatgaattcattggaacgccctgtctttgacagtatgattctttgagtttcttgagatgtgttgtcattttcactttgaagtgaatctcactgctatcctgtccaatgactttgagtttaatatattcaccttccttcttatcccccaagtcctcagttgaaggttttgcctcctggtcagacatgatgacagtggcttcacccgggggtctccgcacagcagcggcctcgggtaagcagaacctcactccggggtttacaaatccttctcccttccccacagcacaacaccgcagctgcagtaacttccgctaccacattagtgtttttttctttcagatcgaagaactacttttaacacttactgtaagatggatctggtggtggtaaattctcaccttttgtttgtatgggaaatactatccttcatatttggaaaataaaataatcttgctgggtacagtattcttagatgtcaggttttttctttgagcacttggaaaatgtcattcctctctctcttggcctgtatggtttgcattgaaacatctattgccagacaaattggagctcctttgtgtgttctttgcttcttttctgttgtgtattttaggatcctttctttgtccttgacttttgagagtttgacttttatatgccttagggtagtcttacttgggttggacctgtttggtgttctcaggccttcctgtacctggatatttcttcctcaagttttggaaaattttctgtaattatttctttgaataagctttctacgcttgctcttgcttagctccctcttgaaaaccaatcattctttttttttttttttgagacagaattttgctcttgttggccaggctggagtgcaatggtgcgatctcagctcaccatgacctccgcctcccgagttcaagtgattctcctccctcagcctcccgagtagctgggattataggcatgcaccaccacacccggctaattttgtatttttagtagagacagggtttctccatgttggttagggtggttgcaaactcctgaccttagatgatccgcccacctcagcctcccaaagtgctatgattacaggcatgagccaccacgccagccaattgttcttaaatttggtcttttgaggcaattttctgtatcttgtagtcttgtaggtagtctttgttccttttcattctttttattttttcctctgacttctttttttttcaagacagggtcttgctctgtcacccaggctggagtgcaatggtacaatctcagctcactgcaacctccacctcccgggttcaagtgattctcctgcctcagcctcccaagtagctggtattacaggcatccaccaccaggtctggctaattttggtatttttagtagaaacagggtttcactatgtcggccaggctggtctcgaactcctgaccttgtgatccacccacctcggcctcccaaagtgctgggattataggtgtgagccaccatgcccagcctgactgtgtatttttcaaacagccagtcttcgagctcactgatttttttcctccacttggtccagtctgctattcagagtctctaatgagctcttcatttcagcaaatgtgtttctgtttcaagatttctgtttgatttgttttcattgtttcaatctctttgttaaacttctctggtaaatttcttaattgtttttcagccatctcttggcgataacagggtttcctttaaactaccagttttaattcttggtcagagatcacaaattgctgtcattttagggtcagtcattgtatttttgctttgtccttgtggggaggttatggttccctgtttgctattgtttattttgggtatacacctatgtctttgtattgaaagattagttacttattccagttttctctgtttggcttgctttggtttttattggatatatttgcttagcaaatctgtactgctaggtcacttcctcctctttggctttaggtgacaccttaagtccgggttcaccttggctttagtaaatgaccagagcattgtctgtcctgaatggggaggtcccaaagggattatcccagctgtgtgtcaaggctggctagaggttcgtgtatgggcagacctgtggaatatacttcctgcaatgcagtgctgctgagcagccactctgatttggcatctcctttggccaagtaacagagcagagtttctggggctgggtgtgatagtcttgcctcccccctttctctctgcctgtcctcagggatatttcccctttcaggcagtcgtgatgcttcccatgggttaagtcaaggttagatctcctgccagggcacccaggaagatggggaaggtagttgacctcctcagtctcactttttccagtgtagaaaccatgagttgggggagggccattgcagatgtggaaatcagatgctcttaccatctgctcagagttttttcatctctctgtggccccaggaactgtctcattgtcatatttgagttctgggttgttgctgatgaaaatctcagcactgtatatttgttttgggttttctgtggaggggagtgaagccagcttgcttctataccactgttttgaaactgaaagtattccttctttcccttttttcctgtggtggtacccttattttgaggagtatgaacatagaattcatccattcatttgacaaatatttattgagtacctcctttgtactagactttgtttaaggctctggagatacagcggtgactaaaacagataaggcccctgtctgaaggagctcatatttgttctaaaatggcaactcctaaagtggcaggtccctgaaaaaaagaaaaaataacaaaaattgaaaggccaactaggacagttgttatcaggacagataaaacaggataaagggatggagaatgatgaaaaagaggtgtttgtttttttgagacagggtcttgctctgttgcccagcctggagtttggtggtgcattcacggctcactgccgtcttgaccttttgggcttgggcgatcctccccctcagcctcctgagtagctgggactacaaacgtgcgccacaacacccagttaatttttgtattttttgtagagatggggttttttaccatgttgcccaggctgatctcgaactcctaggctcaagtgatccccctaccttagcctcccaaagttctgggattacaggtgtgagccaccatgtctggccaagagaagaggttttataatcaataagagggtcagaatgaaagaaccaagacatgtaaagattaagagacttaaatgaagaagattgccatattagaaagaagttggcaatttagcattctgtaatagtacttagttcttgatgaagaggatgtcatatctccaaatcctaaagttatagtagtagggaattgtgatgacctaattctttttgtccttcagaatcaaaggcatgggaggttgatacctgccggggccattacaacaatgtatcttgtgccgtcttccaccctcgccaagagttgatcctcagcaattctgaggacaagagtattcgagtctgggatatgtctaagcggtaaggtagtcctcagtgttgtgtgaactttctcttactctctcttttaaaattagattggaatacttctttatgtctctcatcatcttcagcatgtagacaaatcaaatcatatattatgaaaatttgaagagacctagagatcagtcaacatttacaaattttccatcaaatagaaatctccatgtatattattttttgcctctaaatttaaacatgttttcttcttccccctttccccagttctgtagctagagaagtaagaaatgcggaatgaggccgggcgcggtggctcatgcctgtaatcccagcacttgggaggctgaggcgggtggatcacgaggtcaggagattgagaccatcctggctaacacaatgaaaccccgtctctactaaaaatacaaaaaattagccgggcgtggtggcgggcgcctgtagtcccagctactcaggaggctgaggcagaagaatggcatgaacctgggaggtggagcttgcagtgagccgagatcgcgccactgcactccagcctgggcaacagagcgagactccgtctcaaaaaaaaaaaatgcagaatgaaagccataaaattatgctgaaaaggggaaatctatatatcataataatatggtcagttttgaagtctcctctttttgttccttggtagaatttatcacgactactgttacttaggatatgcagtttactctccctgatttacattttaatcagcttgctggcttaccatttaatattcttgtgtaggatgggctgaagattcctaggaaattaatgtttttctttttgtgtaccttttctaggactggggttcagactttccgcagagaccatgatcgtttctgggtcctagctgctcaccctaaccttaacctctttgcagcaggtaagggccattttctctcttttttctttgcttaattcaaagtttataagtcttgaaagtgattattagctttgtctctagtaaatgtatagtaggatgacaagaagaagaaggactctcagagccacttagttgaagcttttctcctttttttcttccactttatatgtacgtaaaatgatgtgtggtgaaaaatgctttgaagaaaaattaaaggtaaggcagatagagacagatgagtatggggactgctgctttatattgggtggttcagaaaagtgaaagggtatgaggcaatgggaacagcaaatgcagagactgtgttgtgagaggtgcttagcatgtcaccatcacatgctaaggaacaccaaagaggccagttggagcacagtgagtaagggactgagtaacaggtgaggtctggccagatcgtgtattgccttctatgccatggttagaacttaagattttattctgaatacatggaaagccattggaaggttttgggcaggaaagtgacatgatctggtttatatttggagagcagacagtaggagaacaagagtggaagggttttctaagggatgatggtgctagtagggaaagagcaaaacattttaaaaaacagaatcacaaagggtttttaacatccattttttcagtaaatacttcttatactctttttatatgctagagactggggaaggatggaaattataatttctgccttcagggaattcatgttacaatgtgggtgatagacctaaatgattacagtgcaggatgataagtactgtaatggaggtttgtacaaagcattaggggaacacagaaaagggcagtgtggatagtgacactaagtgtggcagtgtgaatagtattaggaaaggattcacagagaattatttaaataaagattccaagaattgtgagaatttaggcaaataagggatgcattcaggtgtcttgtcttacagatataatcttcatccttacgtatctccaatttccaggtttttttcttgcctacagcttaattttttctcctcctctccctgtcccccaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggaggtaaatcggacttgtttctttcctccaaaccctctcatctgtcaccctgatacaactcccacaaacaagactcttcttttctttctttcatttatttattttatttatttaatttttttttgagacggagtctcgctttgtcgcccaggctggagtgcagtggcgcgatctcggctcactgcaagctccgcctcccgggttcacaccattctcctgcctcagcctcccaagtactgggactacaggcgcccgccaccacgcctggctaattttttgtattttttagtagagacggtttcaccatgttagccaggatggtctcaatctcctgacctcatgatctgcctggcttggcctcccaaagtgctgggattacaggcgtgagccaccgcgcccagcctatttatttatttttaaattttttttttttgagatggagtctcactctgtcacccaggctggagcgcagtgatgcaacctcagctcactgcaacctccacctcctgggttcaagcaattctcctgcctcagtctcccaagtagctgggattacaggtgtgcaccaccacacctggctaattttgtattttgagtagagacggggtttcgctgtgttggtcaggctggcctcgaactcctgaccttgtgatccgcccacctcggcctcccaaagttctgggattgcaggcgtgagccaccgcacccaaccaagactcttcttttaaatgacattttggatctcgtattctgtcacagatggaatccccattagatgagcccgctcagtttaaacccaatgagtgagggaggcaaggaagtggtcatgagtagaatgatagttcccttcttgagaatgctagtgaccttgtggatggaaaatcattctgccacaatttgctgggtctcttgcaagccagaggaagtttcttgatagagaatggcccaaactggtaacagaacttttcgcctttgtttggcatttcttttctttaactctcccttgccttccagcaaaaagtgcacaactctgaaccagaatatatgtccctggaaactcttaattctgaagatacaataacctctgggatgcctggcaaaaggacctgtccttttgaaaagccagctgcatcagcatgctgaaacattcatggtggcaaaatttggaatgaggttttgataaccaccctttagcatcattacaataaaaaaatgggtttatgtgaatactccaagggacaggagaaaccagccagagacaaatcacattatgttactctgtggtgtccactgcaattacgtgtaggaatttgtatccaagcagaaccagtcccactcactacagtgagtgttaaccctacctaccttctgttgaataatttgacttctactatggcttactttttaaaactgtttgttcaaagctgagctagggaagttgccaagccttaaaggaagagaatacaatatttattcattttattcctgattataaaagtgatgagtatatagtgtaaagattggataagtaggaggtgtgggggtgattcctttcttccttctattcttatgcctcttccctgttttctcctttttctatatatatctctagtggttccaagtttccagtattcaatatgtcatacaatccagcagaaaatgcagtcctgctttgtacagtaagtaacctgtggagccctcctaggttctcctcattttccataggtctctttcttatgcccttagggaatctttaatggcttcttagaaactatttaatggtcattttgtgagagctgacacagtgatcactcagagactcaaatcaggtaggtttcagttgtcgtaaacatattgagcatttgtgaactgcctatctttcctaaagctgaacttaatggagcatcagaatgaatgacccagatcactagaaataatttgagagaatgtttagactatatatatatatttcctatggaaagaaaatgtttaccttgatcccttcctttgggtgaaaatagaagaactattattttgagaggaagttcatatcagtggggttggcttcagagtcatcaatgactcctctctgtttcttgcaacagaatttgcaaaaaaaaaaaaaaaagaaatgacattctaattttagtgccctcgtggccaagttaaaaggaatgaagttaaatgtctttcctcatataactatattgtctaatctgttcttctttaatatctagtagtcccatactctgagttttcttgagtgttttttcttttcttctttttccaataaacatttgcattcctatagtgtcttttctttgatgtcttttttttttcctttccagaggttgagtactcagttgatgagtcctcagggtggggtaccagaatatcagggtcctagtctgttaatttgtggagtagagagcatttcttactttcattcagataatatctgcatctttggaggataaagaaaataaagtgacatcagtgctgatgtgtttggcaaagagccctataactcatagatgtagaaacagtcaaatgccctctgggtgaagggtaagaaaagtatggtttcagattggtgtctgtgcaatggaactgttttctctgtcagagtaaattggaaaactggtatcttgggtgcttctcactaacattttaatttccccttttcttctacagagagctagcaatctagagaatagtacctatgacctgtacaccatccctaaagatgctgactcccagaatcctgatggtaagtgttctttttgtctaccccactctgcttccagctctcctcacccgcatcataactcctcttcaagtttttcacattccatccccaagccatggccacatcactcatgtctgttggcaggtgctgctgacaattgcatcagaggcgaccatggtgtgaaatattcatgttcctcctccattttattaccccagctagatatatatattttataatttggttattagaaactctccattctctctttcagcacagcatgttatcctagtttattgtcagttgatatgactttcaccctggtagtttcatttatttaaaaatgtggttccaatcttataatgcctcatcctgggactagggatttatactgtcctatccacatccagatccgatttgcttccttttgcatgtcaaaaagatgaggctgctaacagccccacaccccacctgggatcccaggatccagctgagactcctgcctacctcttccattaccactatcccttgttgatgtccttgtgattagaacttgctgacaaaacattctcagaatggatttgactattgcctatggtcctttgggtgcacttcttccagcgggtttatggctagtaccaggtcagagatttattctgcagatccccactcttactggcatattttaatgatattttagaccccatcaacagattcctaagaaataatttgctagctctgtttcttttgtgggtgcccctgggttattattgttgctaatcgatctcctctcttttaaatgtgttcatagtgagagaaagaaaagatatttgtatttggtatccataagtcaaagtctcccttataaattagtcagttaagccatttctgactaaatcttatggtttggtacctcccaactcagctctttgcttttttttttccccatctgtgtttacaattaatagaatttaaaatattttgttttgttttattaccacttttattttctgtacttcattttttgagggagataataataaaggagcagcccagtggtgggcaacagagatgggcttgaataatgcagattcctggcccctggaaaacgggagtgttggttttgataataattagtttcataaattgcctgccactccagatgccaggggcaagactggccagcatgttctctccagttttctgctggtctaataggtaaaagagtattttgatgcacccttctgtttatccttctacaagtttcccagagaatggagtgtccatttcaaaattctaataagccactgaactgaggaacattttgtaactctcttcagggtgataagaatggtcagttgacatttacagagcaacaacttggttctaaataccgcccagcaccaagctctcctgtcaagatttagttgggagtgctctgcctcaccctgccctactaggaagtctgcatttgcatgttaaaagcagcagagagcagctgcatcctgtggagggggtcctatgacacaggcttgctttgccgcagcttggccagggaggccctgctcgttagcttgatggagtgtgctgtctcccaagatgggcggcccttctgccagtacatgatgttggctgaaatgcaaccacttggcctagagaaaagagccttggcaggggtggtggttggtgtttggaggggactggtggggaaaagtcactcaataatagccccaggttatggctgaattagttaggaagcagctcaactggcaaagccaagatggcatccagcaagactggcagctccatggcacccgactatgtcacctgccagtgactcaccacatgctcccaccctttggttttgttcttctcagcgcctgaagggaaacgatcctcaggcctgacagccgtttgggtcgctcgaaatcggtttgctgtcctagatcggatgcattcggtgagttaagactaaaagcagaaactaatttggggagtgtggtggcagtggcctgtgtattgcaaaataaagaccattgttttttctgttctcccccgggcagccgtgattctcatgtattggctgtacctctgtctctagccctacactaagccctcttgggggaatggcattaaaactgatttgattgggttgatgatcgccgtggctctgggtttaagaaccaagctaaagtcactcttgactacaggagcccaaaacgcatcaaatctgaagtgagtgggctggatgaggaaatttccctccttctgctgcctccattgttacttgaaatgtaataggtccagcacaagataaagcactctgaagaaaatatttaacaaaatttaagccccagaaacagtgttttctctctctcattcattgagaaattcagactttagttgggacttctcaggatgttttagttggaggagaaaaaataatgtattaaggcccttagagaagatcttggttggcatggtctgtctgcagtggtaattgacatggacaggacaaaaaatacttagttaattgaagctaaggaacaattgctgaggaacatcatcagttgtcatcatcatctatacacatttcttctcttaaccccatctttaatacttattgcagcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggtaacatatcaggtgcccctaagcagacagccctgtagttggggagagtggacatctttagtgggaaccttttttccccaagtgagtttgtcttgtggcttggccacttcttgtgctccaagactctttatagtaacttttcccttctgtgatcactctccattcttcacgtccacactagcattacagtgagattcttggttatttatctgtttttacagtacttacctgaacaaagcgtgttctccgagcttagaatgagagagagacagagattaataacatagttcctacatttaagggagcttgcagtccagtggtgaaaacagacatacacagattccctaataatacaaggaaatgagggagagggggttgaggaaggggtaagtgcacaatgtgagccaaaatgtttaagtcactgagctactatgtaggaattacattaagtattttatgtaattagaattacattaagaaattggggtttacattaattagagggtgcaattgatgtagatcaaagcctgagacaagggaaatagatccattcatgtttgcacatctctatctatctcaggactctggcatctgtgaagatttctaaagtgaaatacgttatctggtcagcagacatgtcacatgtagcactactagccaaacacggtgagtcttcattatatccaccctgatttagagaccattccctcccaccccgatccctgccagtctacggcacttaccctatccaacagaacactcatgccctttgcctcttacagccattgtgatctgtaaccgcaaactggatgctttatgtaacattcatgagaacattcgtgtcaagagtggggcctgggatgagagtggggtatttatctataccacaagcaaccacatcaaatatgctgtcaccactgggtaagttaattatctgggatacagaatgggagaagacagcttcctgaaatcactgtcttgtcttgagatgtaactgaagtcctccatgaattttcttcatggaaaagccttacctggcatatatgtgcaaggggcatcagaacattcttttttcaacttttttaaaattgagaaatctaaaacaaatatagacaattacattaaaaaaaaatagaataacaaataagttatgtagtgaacatcagcataactaccacccaagtcaaaaaatagaacagttccggcaccccagaagccctttgccacgtggtcacaaccctccctgtttccaccaacagtaacattctagtttttacagtaatttcttccttgcttttctttgtaattttactgccctgtgtttcttaatatgatttagttttgcctggttttgccttcatataaatgaaatcatactgaatatattatttcatattttgcccaatattttgtttgtaagattcatccatcttgtagctccaatgtatttattttcatttttgtataattatatgattatgccacagtttgtcagttctactcttaaggaatatttgagtgaattctagtttttggcttgtatgaacaatgctcttaaacattcttttttacctgttttctggggtacatgtacatacatttctctagagtgtatccccagaatagaattgctaggccatggattatgcatatcttcacatttattaggcaatgtgaaactgcttttcttttttttctgaaacggagtctcgcccaggctggagtgcagtggtgtgaccttggctcactgcaacctccgcctcctgggttcaagtgattctcctgcctcagcctcccgagtagctgggattacaggcacacaccaccacacccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaagtaacttgtgaaattccacacaaaaaaagtttgtggtttcgtttggaattgcattaattctctacatcagttgggggataactgtcatctttacagtccttacagtgttcagtttcctaatctgtgaacttggtatagcagctcttcattcatttaggtcttctgaaacatccttcaataaagttttatagttttctctatagagatcttgcatttctttggttagatttattagacacttgatggttttaaaattctgtttgtaaatggataatatctatttaaaattttaattttctaattttgttgatatttagaaatacagttaattcaatttaaatacaataaaatcaatttaaaattgattttaggaatcttgctagactcttatcaattccaggatttatttctatttcctttacaaataatcatagtatctgtgggtaatgacaatttagtttctctttcaagtacttatatattactatatttttcttgcttactgcactgactaggatctccagcaatgtggaattaacatgatgacagcaaacattcttgtcttattcctaacttaaagggtgaactttcagtgtgttagaattatgtgagcttacagtagatttttaaaatgtatatcccttttctatgaaggaattttgctatttctttttgctaagagtttttttttttaccttggtaaaattcaacatttaccaacctaaatgttgaatttatttatttatatctatttattaaattaatgtaatttaactatttttggcagagagtctcactctgttgcccattgtgtagtggcacaatcttggctcactgcaacctctgcctcctgggctcaagttatcctcccagctcagcctcccaagtagctgagactacaggcatatgccaccatgcccagctcatttttgttttttttgtagtgatggggtttcaccatgttgctcaggctggtcttgaactcctgggctcaagcagtcggcctgccgtggcctcccagagtgttgagattacaggcatgagccaccatgcccggcctaaatattgaattttattaaataacttttctgcatatacaggttgagtgtcccttacttgacatgcttgaaaccagaattattttatatttctgatttttttctgattttggaatatttgtgttactgattgaacatcccacatccaaaaatctgaaatccatactgctccaatgaacatttcctttgagtgtcacttcagtgctcagttttggattttggagcatttcagatttcctgtttgggatgctcagccagcattggggtagtcatacaatttttctcctttcattgattaatgtagtgaattaaattgatttttttttattttttattttttttgagacagagtctcaccccaggctggagtacagtggcatgacctcagctcactgcaacctccacctcccgggttcaagcacctcagctcactgcaacctccacctcccgggttcaagcaattcttgtgcatcagtctcccaagtagctgggattataggcatgagccattacgcctggctaattttgaatttttaatagagatgaggttttgccgtgttgttcaggttggtcttgaactcctgacctcaggtgatccgcctgcctcagcctcccaaagtgctgggattacaggcatgagccactgtgcccagctgattttttataaatgttaaatcaacactatattcctgatgtaaacctaacttggtcttgatatttttacccttttcaaatattgctagctttaggttgctaatattttacttatgttttcacatatttataagtgagattacctgtaattttcccttttcttactgtccttgttaggttttagtatcaaggttgtgtgaatttcataaagcaaagtaatgtattttttctgttccctcaatgagtttgcatacaactggaattaattcttccttgaatattggttagaatttgcccttgaagtcatatggacataggactttctctatgggaggattttaaaaatctgattcagtttatttagccattataggactataggtgttttctatttatttttgattcaactttggcaaattttattttttaggagtttgatccttctatttatttatttatttatttatttatttatttatttatttattttgagtcggagtctcactcccagtctcacccaggctggagtgcaatggtacgacctcggctcacggcaacctccgtctctcgggttcaagtgactctcctgcctcagccttccgagtagttgggattacagacatgcaccaccactcctggctaatttttgtatttttagtagagacggggtttcaccatgttggccaggctggtcttgaactcctggcttcatgtgatctacccgcctcggcctcccaaagtgctgggattatagatgtgagccactgtacctggccagtttgattctcttaaaaagttacatctttattctgcaagatctgtagtgatatcccctttttcattcctattgttttcttttctctgaattaccctcatgagaggcttatcaattttattcaagttttgctttcattgaacttctctactgtagtttttgttttttatttaatttctactattggcttcattattttcttctaagtactttctttggcttaaaaagaacagtaaattttttgagatgactgcttgttaattttcagtttctcctaatatatgcatgtagaacccaataatttttaatatttcttctaatgcagtctgtaaattatctgttaaatgttgcattagctatattgacaaacttcaatttgcaatctatttattattattcagttcaaaatactttgttttttattatttctttatcagaactcttcacatctacctctcttctactttcagttatagattataaaggagttacctgtccataatcacctactgattatatatcagaacttaagatttaacttttaggtctgattcctatagccacatctgttactcatcttctaggataatagcatataaagatcgtgccatctaccccatcgtagaaagaatatgataaatttggcatttagttctgctcttttttgaatcacttcccatctatatcattgttcaaatggcacttgacaaaagaccgtttcctaggtttgttccgtttcttcacaggatggattttccctctcacttactgaaagctgtgccctctgttcttagggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtatgaagtgaggatgcaaactagagtattaagagaggcagcactctttttttttttcttttcctgtaagtgatgtctacttcttgcccgactccaccccaaatgtctaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgaggtgagaggaatatggtcatcagccccatattgtcttagaggtgagagagttagagtgccattgggagggcattattctgggcttgcttctttagccagaataatgaaatttgggattttttttagttgttacattgagccatcttcctgttgctatttgcccatctctacttttacctgcctctgcttctgccaccgcatttctatttttgtcaacctcaattagtgtgaattcagtaacttctaggataaaagcaagatggcatggaatttgaaaatcttattatttccttgacacttgatcttgctgactggctacttagatgaaagagtacctactaagcgttggggcctagaatgtataggcattgttttctaaggcgaaaagagcttatgaaaacgttttccagttctgaacttcttcctagtagtatttcttctgtctttgctaaagcccctgtggatcttcaaacctggcaggtgggaagtaaggtagctaagcaagaactggctctatggaatcagcaactgctaggtggttttgttgtaaaagtaaatttctgaggaggaggaggaggataatgcgatgtaattatttccatctctgtatccaaaggggtcctatgtgttcactggattttctttttttttttttcttttttttgaggcggagtctcgctcttgttgcccaggctggagtgcaatggcatgatctcggctcactgcaacctccgcctcctgggtccaagcgattctcctgcctcagcttcccgagtaggtgggactacaggcgtgcaccatgattcccagctaattttttttgtatttttagtagagacagggtttcaccatgttggccaggatggtctcgagctcttgacctcgggatccgcctgccttggcctcccaaagtgctgggattacagatgtgagccaccgcacccagccgattttcaatggaattagactaaaagctaggagtaattgaaagtataggaagttcttcaggaaatctatatagatgcagatgctttgcagagtccttggttttgagtcacattgtccttcaacctgttaacacgaccctggggattctttagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattggtgaggccctcaaactaaggatgggaagaggggttcttgggggaaggaggaaggtgaattaaggagaaagagaacttaagagaaaagacctaacttggtgtctcttacttggtgcagctgagatcagaaaggacatgagtggccactatcagaatgccctatacctgggtgatgtgtcagagcgtgtgcggatcctgaagaactgtggacagagtaagtatccgagacttgccagctttttcagggtctgaggaagtatttttctgtttttgttgagttaatctgtgtatagtggtgagggatttctctttattgtgcatttttttaggagagacaacatgctcctactgtgcttagaagattttcttcaaagccaaagggaggtgcagccagaatattcagtccagccaaacacccttaggagaatagttattcatgggggagataggaggttttaaaaggtcttgagtggacgccctagtaaatgcacttggttggatgccattagaattttattctttattttcagtttggaggtttcactcatttattcatgtatatagtcaagggatattttttgagaacccactatataccaagcattatattagcatttaagatacattaggaaacaagcaaggtgaaagatgaggtttggaccaaggcgctattagtggaggggtgagcagtggtcagattcaggatatattttaaggtagaaacaacatgatttattgcggtaactagatttgagatgtaacagagaggagtcagggatatccaaggttctcagcacggatggatacgtctcaaagataagcagctatattagttctctatttctgtgtaacaaattatccccaaatttagtagtttaaaaccacaaacatttattatttcacaatttgtggcatggcttagctaggtgcctccggcttaggatctctcatgaggctacagtcaaagtgttggccagaactgcagatatctgaagactcaccggggagagaatctacttctgcactcactcaatggccattggcagcccccatgtccttgctccctgttgtctaagaaacatcactttcttttcgtgttgacctctccataggagtttgtaacgtggtagctagtttcccttacagcaagtgagcaaaagagggcaccccaagatagaagccacaatctttgtaaccagatctaggaagtaacatcccatcacatctgccatgttccatccattagaagctatttaataaatccagcccacacttaagaggtgggtattttgcaacaacttgaataccaggagtcagggattactggggggccatttcagaggttgcttaccacagcagcatgcatttggaaatgtacctataccacaaagtctgttttctctacagagtccctggcctatctcacagctgctacccatggcttagatgaagaagctgagagcctaaaggagacatttgacccagagaaggagacagtgagtctttatttacataattgtctcttattacaggattaactctaggatcttagaacaatttaaaattatgaatgtcactctcccacctggttaccaggagaggcagagaaacaaatgagatcaaaggaggctccataactttccttacgtgacttccaagtgctatttgtttttagcctcttttcttctactattcagatcccagacattgaccctaatgccaagctgctccagccacctgcacctatcatgccattggataccaattggcctttattgactgtatccaaaggattttttgaaggcaccattgccagcaaaggtaagtacctgtttctcccatagcacttttgttgtttgttttgtgaagaactgtcctagagaataccattagcatttagtttaacttgtcctttttttctgcatggagcctaatggaatattgaaatgccagtcatttatggtgcagtcttaaaaacttaagatagcattttcaggtcattaaagaaaatttggaaaatagggagaaaaaaagggatccctctactaccatcaataacttcggttaatattttggtgtattttcttaggttttactatatatgtagtcatgttctttgttcagtattttatcattcatgacatacaatcttaaaggtactaattcaactacctgtaattccggtatgtgggtataggcagatgtgtgctatcaccctccaccacttccacccttaacctcctcctgttttctgggtctcctagttcatttcccgtgagtaagagcctaaacagactcttgagcattttgtgccaaaccccactcttttctccacctcctctatctaccctatgcctgatgccctgtacacattgtagtggtggtagcttagcaaagcgctcaggaagaaattcaagagttggtagccaaaggctggtaagtacaaattatttaagagccagtttttggtagcaggaaggccagttccttccatctgtcttctattccctccctctgtgaaagctactgcaagttagcataacatatataccacaaaaataaataatacacaaaaataaatagtaagtaggcagaagcttggcacctgtttttgaaaggatttaacctgcctacagaaaaggccgtatctcagacttgctggactataaccagttccgttctgttccttccctctgtagggaagggaggagcactggctgctgacattgacattgacactgttggtacagagggctggggagaggatgcagagctgcagttggatgaaggtaaaagtgctgttttaagactgttctggggtgatggacaccttggattgggactgggttgtgggtagctctgcagacttccaggccatgaaacgaactaggattgattttacttcctttggctaagattatgccactgcccaaatctgttttgagcttgaattttccttacagatgggtttgtggaggctacagaaggtttgggggatgatgctcttggcaagggacaggaagaaggaggtggctgggatgtagaagaagatctggagctccctcctgagctggtatgtggaatttgtacccttagaaggttctctccgtatctccctgtggaagccagaggccttattgtcccctaccactatcctcaggtctcctatcctatcccctaccactatcctaaggtcagcccttctgggaaggggactagaccctcctagtctgatgcttatctcccatttgaaagaaggaagatggctgggcacggtgactcatgcctgtaatcccagcactttgggaggctaaggcaggacaattgcttgagcccaggagttcaagaccagcctgggcaccatagcaagaccctgtctctattttaaaaagtaaaagaagcaggaagaacgagagagtcaaagttagtggccttgtcacttccatctatcctgatatgctccaagaggagaggatgtaggacttatctctaatctgatgcttaactcccatttgaaagaaagaagaatgaggtaatcagcgttctgccagcagcagcttatgagaaggtagcaagctgtttcatctgaattggagtttttgatatgtcattttgtcactggtgaggtggctcctattttggcagccttctcccacaactatcacccctcttcctcagtgggggcagggaacaatgtaaatggttgtgttctagattcaacagaacaaagtgcttgaatggcttaaaaaattactcaatttggctgggcacagtggctcacgcctgtaatgctagcactttgggaggctgagccaggcagatcacttgaactcaggagttggagaccagcctgggcaacatggcaaaaccccatctctacaaaaaaatacaaaaattagccaggtgtggtgactcatgcctgcagtcccagctactcgggaagctgaggttggaggattgcttgagcatgggaggcagaggttgcagtgtgccgagatcatgcctctgtactccagtctaggtgacagagtgtgaccctgtctcaaaaaaaaaaaaaaaattactcaatactcaatttttgtttttcccctaggatatatcccctggggcagctggtggggctgaagatggtttctttgtgcccccaaccaagggaacaagtccaactcaggtaagcgggaagaaacctagcacggcagggatgagtggctaatacttgattggtatataacaggtgttggctacttttctactatagttacagaggagaatagagaagggacaaagtttcacttggcttgggtttttttgtttcttgttagatctggtgtaataactctcagcttccagttgatcacatcctggcaggctctttcgaaacagccatgcgggtaagtaaccttggcttttcctcttgagtgtgcctagcccagggtccccgggagatggttgactcattttaatcaagggaaattatcctacccataaggggaaaggtgtatatttttcatgaaaactctttatctttgttaagtacacttgccttcctgttatctgccttccacttggcctagtaatctcttagggcatatccttcagtcatcttccacccatttatagcttgctttctggctcatatcagtgagataagtacccctttccaagcaggggtctgttttgaacactaagccagtattgttataataacaacaataatgataacactgcaataactgctaacgtttatttaatgttcactgtgtgccaggcactatcctaaatactttaataggtatcattaaatgaggtaggtcttacaattaagtgtattttactgatgaggaaacgtgaacagagaaattaattaccttgcccaaggaaaagtagctttttatgcagcagggccaaaatccttgtttctttccttctgttccagctccttcatgaccaagtaggggtaatccagtttggcccctacaagcaactgttcctacagacatacgcccgaggccgcacaacctatcaggctctgccctgcctaccctccatgtatggctatcctaatcgcaactggtaaggcccttttctctttgctttcatctgttccaagttgtggtcgatatttcagatggtagcctcagtgacatagtcagaattctctcagagctagggtttcccagtagaaaaagatctttggtttgttactctatggggttggtttacacctgctgtcatcctcttccccagctactttaacaggagacaggagggtagctatgaggatgtttgccagaaaaggaaattgggtcctagttgcctactgactatcctgtcttcttcctacttttccctttccaggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggtaggagggtctagccgctgtcccagttctgggcacttccacattcttgtctctgtatcctgaccttctgccccctctacaggcccagcagctcatcaccatttgccgtgagtacattgtgggtttgtccgtggagacagaaaggaagaagctgcccaaagagactctagaacagcagaagcgcatctgtgaggtaagatctataggaccctgagcacaacagagacgtccttcccttcacccttcactaggtttgaattctttaatttcaaacccagatctgagtggggatgaagagaaatttaggcccttcatttctatgaggggaggatacatttcttcatcctacttcctcatctcaccagtcctccatacctaggaggtagaagacctctcagctttatagcccatcatcctattttgtgttgtgttttttatgcatgtgtagcagcttagaaatgacttctaccaggtgtagcatcaacctggcatgtgttcctttttctgtccaccagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacaggtagatggaactccttcagtgaccatagggaagccagatcagctcttacatggagggagcagaccaaggtccttgcctctgaaacaaagcaataaataacaacattcaacaaaaagccaacagaatgctaccctctgtttacttcctgacttggtgtttcctttgttcctggaaaattaatagtttattgagacatggcactcgtctaagagtgccgtgcaacctagaatagctccactgcagctgaaagtaaccccagtcctgtccttaagctccagatatcccatcacaaccaccacaaagcttcacatacacatctcattacttgtgtcctccaaatgcattctttttgggtgatggaagtctgttttaaccctttctaggacctgaccctgataatctctagagttggtggaggaatgtgggtctagattatggagccacttttgtattgagaaggggaaagtttgatacaataggaatggtgattgttaacccttcacatacatccagtacagaggttgggacctcttttcacgcagtacagttgtgtctcacatcaacggaactaccaaaccatggtgttgggatcctttgaggtgttgtctgcagccttctgtcctcctaaatactccttccttcccctagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtaagtactgtcctcaataaatatatctaggatattgagcgaaggggagaaagaaagaaacatggtggtcctttttttcttcttgtgcttgtcccctgctccctgaggcagtgacactggagaaagctagagcatctccccactgctcttggccagtcagtgatgaacaccccaatacctgtctactgtgcccattgaggggtatagggaatacattttctagggttctcaatcttacaaatctctaacttgttcctttgtttgtttttccacaggtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattggaaaaaaaaaaaaaaagctagccgggcatggtggtgggtgcctgtaatcccagctactctggaggctgaggcagaggattgcttgaacccgggaggcggaggttgcagtaagctgagatcgcgccaccgcactccagcctgggcgacagagtgagactccatctcaaaaaaaaagaaagaaaaaaagaagcacatgtttttcatagggtatatatgaggacctaaactgctgtgaaaatgatagaaagcaagtagctcccttattctgtttttgattgcagccttttatcttttgctaattatagcaatatttattgagcacctgccatgtgactgtcactgttctagatattttacatgtaatatacagataaaagaatagtactttatatatattacaatgatacaatgattacattaacaatacaatattttgcttgtcatatgctaagaataattgggtagagtgacattactgtgccttcgattaaaataagtacttttttgcgtgttaaattcatgttttcaataaataataaatgcatatagttgaaaaatcagtaaatataaaaagctattctgtgacaaatctttccaccctttcatcagccacccagttcctatcaccttcccctaaacaggtaaccactgttaccagctttc

SEQ ID NO: 16453 - DNA, 5746 bp, Human
tctcataaaagaatgcaaaacagacattcccagggcctaaaacactgacatacagtgggtttatgcagttacaggtgaaaggggacatgcttcatgaaaggagttggaaactagaaaaagccagataagaaaggagacggtgggagatgaggataaaggtagctgctaagaaatgagtccgttggaaaaaactatagagacatcaaagtatgttccactttatattttagaaaggtctttcctaagcatacttgcaacctccagttataaaactgagagtctgaaagctctgaggagcctcaagtgaacactgtatggtgggattagatggaatgggacatgaggggatggtaaatcaatgacaaaagtgttactgtttattttcttttcaaagccagagagaagtcatatggagggggagcagaaaaaaatgttactaaattcagcagcatgcaatagtgataattgtatttcttgcttatgcatatacatgagaaactgattctgtagagaaattagaaagggaaaatagtgaggagtaaaaaattcaatcacacaaaacacatgaacatcaaaaaagtgtcctaaggagaagggtctcagaatacctgcgccttcccatatcttgctcgtggactctgagggtatttgcgtactagttctttaaatgcattcactgcttcctcaatttttccctgttagaaagacaaaattacataaataaaataaattaaaatgaataatcaatcaatattgttatttaatattcagcaagtggttttgtcagagtttcctagattccatcctgagtgtaaagatagttttatctaagattttaaaaaaagctatattaaggcaaacagaaaactagtaatgaacacatatttacttcatttttaaaaagacagaaggacagaaaaccaaacatcgcatgttctcactcatagatgggaattgaacaatgagaacacttggacacagggtggggaacatcacacaccagggcctgtcgtggggtggggggatggaggagggctagcattaggagatatacctaatgtacatgacgggtgaacgggtgcaccacatcaacatggcacatgtatactgtatacatatgtaacaaacctgcacatggtgcacatgtaccatagaacttaaagtataataataaaaacataaataaataataaaatgccaaaaaaaaaagaaaatggcaaggatgcccaatctcgcaaaaaaaaaaaaaaaaaaaaaaaaaaagacaagacacctgataaatgatgtaatatgtggttttgctaaagaaattgaattttccctcaatataagtacaggttctaccatgttctcgaatattgtattagtctgttttcacactgctataaaaaatacctgagactggataatttataaaggaaagaggtttaactgaatcacagttccacgtggctggggaggcctaaggaaacttgcgattgtggcagaaggcaaagaggaatcaaggaccctcctgacatggtggcaagagagagaagagtgaggagcgaagggggaagatccccttataaaaccatcagatctcatgagaacttactatcatgagaacggcatgggggaaactgcccccttgatccaatcaccttccaccaggtgtctctctaggcacatggggattatggggattacaatttgagatgggacttgggtggggacacagtgaaaccatatcattccacccctgatccctcccaattctcatgtcctcacatttcaaaacacaatcatgcctttacaacagtcccacaaaagtttaactcattccagcataaacccaaagtcaaagtccaaagtctcatctgagacaaggcaagtcccatccacttagaagcctgtaaaatcaaaagcaaatcagttacttctaagatacaatgggggtacaggtattggataaatgctcccattcaaaatgggagaaattggaccaagaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcatagacaaggtacagttcctggagcagcagaacaagatgctggagaccaagtggagcctcctgcagcagcagaagacggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtacgaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagggcttccctggaggccgccattgcagatgccgagcagcgtggagagctggccattaaggatgccaacgccaagttgtccgagctggaggctgccctgcagcgggccaagcaggacatggcacggcagctgcgtgagtaccaggagctgatgaacgtcaagctggccctggacatcgagatcgccacctacaggaagctgctggagggcaaagagagccggctgaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgggaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaagggagaaattcgccaaaacaaaggggcttcaagttccatgcaagtctaaaatccagtgtggcagtcattaaattttaaagctctgaaatcatctcctttgactccatgtctcacatccaggtcatgctgatacaagtggtgggctctcatggtcttgggcagctccacccctgtggctttgcagggtacagtccccctcccagctgctttcatgggctggtcttaggtatctgcggcttttccaggcacacagtacaagctgttggtggatctaccattctggggcctgcaggatggtggccgtcttctcacaactccactaggcagtgccccagtggggactctatgtgggggatccaaccccacatttcccttctacgctgccctagcagaggttctccatgagggctccacccgtacagcaaacttttgcttggacatccaggcaattcaatacacgtcctctgaaatctaggcagaggttcccaaacctcaattcctgacttctgtgtacctgcaggcccagtattgaaatctgtgttactcttcgatggcctctgtaacaaactaccacaaacttgatggcttaaaataagagaactttgttctctcgcagttttgcagaacagatttccagaattagtttctctgggatgaaatcaagatgatggcagggctgtgctctatccagaggttttacgggaatatttgtccttgtctattcccagtatttcttgatttgtggatggatcactccaatatccaattctgtcttcatactgctttctttctcctctgtatgtgctactttttattttgtcggcatcaaatttccctctgtccctctcttatgaggaaacatgattgcatttaaggcccaactggataatccaggataatctctctatctcaatgtccttaatcacatctgcaaagatccttttcccaaataacataacatttacaggttccagacacatatcttttgggggtctattttcagcctagtatgcaccccatgcaacttaaattgcaactgtcaaagctatttcaatgataattgtgctaaatgtactaatatcagacttaaaacataagaataacaatgttcataacaaatttgataaggtgagatattcctgcttgacactgtcaaggctgttaaaataatgggatattttggctctgtctgcagcatcctttgaatccctgcaagacagaggctctgtggctttcctgaggggccatcagccttgctttcacttcagttggctggcaaagtaaatgtgtttgcttttagtctgaaagaatttcccttccctaagtttttgtatagctccaaacactattgctcaattctaatttaaaaactcagctgcaagacacaaaatgtttgaagaattgcctgaaaatgatctgttcctcaacatagcttataatgttctcctaggaccaagacagttcatgggagagacatggacgtaggccacactgtgttgacatgaggccaatgggctgtgcggaaggataataagatacattcctgcagctgcatggtagaataatccactggtatgatgtcagtggggaagtaggaagttttgcatccatcagtataccttttatgaagatctacagccaaatgtttctctctggacttggagcagaacagctcttctgatgaacaatattaatcttatcttctgattctgttttccatgttgtccctcgaggaattgttgacttcattcctagcatggtttagagccagtggtgtgaactttcaggtatttgattacattttctttactccctccccaccttttcaaaaatcacttacaatgctgtaataataagtgattccaacaaataagcaaatatatttcagtatatcatttcaaaccctttttccagaggtaggaaagcattttaaataataaatattattattttttaaaatagaggattggaata

SEQ ID NO: 16454 - DNA, 13259 bp, Human
  misc_feature (1)...(13259): n = A,T,C or G
tcagctcactgcaacctctgcctcctgggttcaagcaattctcatgcctcagcctcctgagtagctgggattataggcacccgccaccacgcctggctaatttttgtatttttaatagagacggggcttcaccacgttggccagtctggtctcaaactcctgacctcaagtgatctccctgccttggcctccccaagtgctaggattacaggtgtgagccaccgtgcctggccggggatgttttcaccttgttcaagtttcctcaaatctgagaagtgtgctaaagtagtaataggccctcaatatctatttattaaacccagttgaatttattttgctagataatgctggaatagccactactcagaggttaaagctatgagttcaggggagaagggtgcattcctgttgtctcttaccccaggattgatttagcaagctggtgtattgatcgtcagggaaatcttgagcttacatattctgtactaatgtcttcatgtaggacacatatcaatagtcattctgaacatacagtcactgtgattatgacagaagataactggactggtggtgttaaggaggtctgggtcctacctagccttgttgccaacgcactgagaccctgggcaactcactcccctttgggtctcagttttcccatcagtaaaaggaggttggggtagaaaaactaaaacatcttttccaggtctggtctctgatgttgcaaaatgcactctgggattatacgggggagacctggcttccgcaaccacaggatgatgtggtttcaaatcagttctggctccaaggtgaatctgacaccaggacttgaactggataaggccgtttgccagcctcttggaggtacctataattttcggttaaggatgtgaaaattttgggtgtagacagtgaacttgacagttcagccagaaagcagtgcacccacgatgacaccaacacccgcatactctccgcagccagtgggagaggtcgtttcctcccacaactgttcaaatacttctcttcttgtcccatcgactcctttccatgacatagaaactattttgcagagaaacgggcacgcatcattccaatacacacccccaccccacccctgtactaagtctgatacaataaaactacacaatttctctttagtatctagtctcgactgaagaagtgtctgtagtttctaaagagccctacacacattttctaggccggattccccctgggtgagagaggcttcacggcaaccacccttccctcaggtcctccagagtcgctgacgctctatgcgactgtctcgcaggcgggcccgactcgcgtctctctagccagctcatcctctctgtggcctgtgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggaggtaggtggtggtcgtccccggtcccaggaaggcaggggccccgctcccccacgggaccctcgacatggaccattccgcgttcgcaaccgcggggagcgggcgaatccattatgtggggcgggggtgaaccgtgggtctggggccgcggggtggtgggagcggtgcgagggaaaccctgcactctgagctggattgggtcgcgtgcgatgtgcgggctcctggcagaccctggggttccgctgctcgttgccatggctcccgccggagcggccagagcgggcgtcgggttgggtgtcagcggtattccgggcccggttctccacccaggcctggacctggaccctcgggcactgcagcgtccgtctgtaggtttccaggcagaggaaatcctgagacatccaggcgcagctgggagttgctacctggctccatccgtgagcacagcgaggtgctgtctttcatgcttatctgtcttcctcttgaattcagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatggtgagaatggcttggacaggtgatacaagtagagagaaggaaggagggtagagtttttgtccattaatgagagcttgctttggtaacgttattttggaaaaagaagactcagtataatgtgtacctagtgtctccaccaactcaaggcaatactgagagatagtctcagagttatagggaccgtatatgctgttcagttcccaattcctgttttacaaatgaggaaactgagaatctgttaagggttctagataccagagtctggtttagaatctagactccttggcaccctcagctgttgctcctgcattgataatctggccagtccacttgcagcaggaatgtgtgttaggtagagctgtagaacccaggacatgctgtgtactgtctccatgcatctgggcctgcttttcttacagaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggtgagatgtcccatggctataagcctcctttttactgcatcttcttattttaatcttctagagactcgaggttccttcctcatgtaaccctgtgattgctagtttgggctccttagagcagggctgtgaggccatcaggcaatcagtgtttggctttgagcgttgaagtcttgtgaatttctgtgtgccttgactccagaagattttcttctgtcttgatttagatagtagtttctgcctgtggcttttatcaaggttcagaatcttagcttgatttctttgtgtgtatgtgtgtttttggttttttttggggacagggccttgctctgtcacccaggctggagtgcagtggcgcaatctcggattactgcagcctccgcctcctgggctcaagtaatccttccatctcagcctcctgagtatctggtaccacaggcacatgccaccatgcccagctgatttttaataatttttggtagaaacggcgttttgccacattacccagtctggtcttgagctctcagactcaagggatcgcccaccttggcctcccaaagggttgagattacaggcgtgagccattgcgcctggctagcttgatatcttaaagtgtgggttttgttttcctttttgaactgcttgagttaaaggctttatttgattttaatttccactttcattaaagtaatacctatacaaagtttataaagtcagatggcccgtaaccaggaatgtcagatccagtggctagaagcaatctctttcaacaatcttaccatgagctgggttgctaagtcagcatggatttcttataaagcctatttggggcagtttctcagaaatagataatcccaggacattcaagtcggtgttaaggccaccaaggtttactgggattgtgctttcttccctccacccacaggagtttgagaaactctctgatttcttcaaaactcactatcgccttgagctaatggagaaggacctttgtgtgaagggctggaactgggggacagtgaaatttggtggtgagtcctggggaagactgaggtttggggaggaagatagggtgaagggtttcagccttttacttgttttgctcttttccctctgccactgtctctggtttcctatctatttgcatgttcatcatgtgtttattgagtacctacagtatactgcctggggttggggttatagtctaaacagactaaccgcagtatcctgtctctgtggaactcagtttggtgggaatattgcttatgcagacttaaggggaggagcttgtggctggataagccctttcctcacagggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggtgaggcttcccctggttgccttggcagcagatggtgctgagcaggcattggctggcctgggagcagggcctgctgcttggctaccaatatgtgcttttgcaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtggtaagcagaaacccctatggccggataatcctggtttttgcctaagtgttaagtagatggatctcactggtgtgcagaattctacgttggttaattgcaagttgttgtagagtgtcaattagtactcttccttactagatcagcctggatcccccaatcaagcaaggccaaactcgctaccacttcctgatcctcctcttctccaaggacgaggacatttcgttgactctgaacatgaacgagtgagtgtctccctggactcgtttcctaccactgtccaggcaggagacaggtgtgccattagaaggcagtagtgttgtgacctcaccttgctttctttgtagggaagaagtggagaagcgctttgagggtcggctcaccaagaacatgtcaggatccctctatgagatggtcagccgggtcatgaaagcactggtaaaccgcaagatcacagtgccaggcaacttccaagggtgagagtgtgggcctgggatcctgccctgcctgggtatgggaaatgccgtgtctccttggtaaacccttcctgagatgggaatgcggcctcctagaggcctggatgggaccttgtgtcacaataggtgccagcgcctctgtcagaacagctcagtgaggtttacttagtcgaggacatgagcactcgtgtcgctgctgctagatacgccctttgcctctgctgaggttggcactaaccaggctccctgcaccctctgtcaggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagaggtgagaacctccacctgtcacttcctgggcatcctggtcccgagccagctttgtctaggaaggctggcgtggcctggggcactctccaaccctagagcagaatttttcttttgctacatcaggatttggtccttttccctggagtgctcagactttagaaacctctccattgctttctttctggtcattaaaaaaacaaaacaaaacaaaacaaaaaaaactttttccgtattctgaaagctatatgtcttcgctactggtcttttttctcctccactccccaccatgatggaaatgctatctctttctttcctggaatgagctttgtgcctgagaacatagcggctaatgcttattgagtgctcactgtggactaaacgttttataagcatcttcacgtgtaatcctcatatcaaccttgtgaagtatgaaaaaagatgaccacgtcccctgccccacacttactcccctctgagcttattttgtaaacagatgcgcacccctccctgcctttcctttcccagagttcttcaaagccatgcagttctttcaggactaatgtctggctctggctctgccttactgctgtcctctgggggtttctaagctgttgggttgggtagcatagtcaagagctccaggctccacagtctaccccagctcatggaatcagaacattgtttagtgtgcccctgtgttggcactacctctctggtaacatggtgcatgtcccctcacagggaggagtacgggaaactgtttgattttgtcaacgcgaaaaagctcaacatcaaaaaccgaggattgaaagaggtacttctgtgtggggaggatgagaccctctcctggtctttctataggggagaaaggggtggagattttttccggcttctttttcactctttcttctcttcttacccttatagaaaaaagaggtgcgtgtgaccctttccccctcctggtgcaggtttcctctgcatgaccttagaccagtctatgcagcccctcaggagcccccagtggggctgggagagggaggggcttggggcttggactaacccagttggcaggaagtacttgggcataggccctgcacgttggctgtgtgtggacaatccagccccaggtcttctgggagctgctgctctgacttgacaggcatgggggtgtgcttttgagtgtgcagggattctggctcgagggtgagttggccccaccgtgaactcttccctggctagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccggtgggttagcctccgtgctgagcacgaggatggtcagacgctcctcgctgtggcccgggctggactcacccttgggccagagctgggtgcctgggtgaggtggggggatttccattggggcagaagctgatgcatcctgtgccctttttcagatgagtcattcaacccaggtgaagaggaggaagatgtggcagaggagtgagttttggtggtaccttgtggggataagatggtgacccataagcttaagggaccagaagatttctggacatttctcaggtcccagcattagctactgacccagaatgggagagtgacctccaatgaggtgatatacgaaaatgttttggaaattgtcaagggctttgtaagtgcaagacatattttgaagtcggaaaagtatagtgggatctatggccataccgccctgaatgtgccagttggggctggttcgtagttggatgaggagagaatgggaatgagctggtgcttgccacttacttgctgggggttgtcgagtaagtcattgaatctcaatttcctcatcagtagaaatgcagtagtacccctgctaaattggttaagactttttgttagcagtgtcagaaatgtgattcactctcactttaaaagggaacatataaaagggaatttcataagttcatattactgcggagtctggggatttaattggcttcagacactactggattcaggcgctcaaatctatttcttccgatttccttaattaaaaataggtttaccccatggggtgcccagtgactctcagaagctcagggcaggcttaatcctactggtttaaaacaacaccagaagtgcctcttttggtgaacagcatagtgaacacagtggttacctgcccctttctagcctgagttattagaatgggctggggtctgatgggccagaaataggccaagtgcccacccttagagcctgtggttggggtaagcccttcctgagtgggggcaaggtggttcccaacagaaaattgggactctgctctcttaatccagaaggattgtaaaagaatgtcgggcagcaaaaaaaacacccaacaggagtcctctagttcagcctgccacatgcttatgaaggtttatgaaggtttaatgagcaaatacttgtgaaagtgccttgaagactgtccagcagcatacaggtgtaaggtagttgcattgtttgaggagtttcacatatatcagacaagactgtcaattacaggggtaggcactgggttggactgaagttggttttcctctttttgtagtaactgattatcttttcatcagaagactgtaggggccaatccttttgtagttcataaacataatggttgggtgttacgtgcgtgtgtgaaatgtgccaccctccagccttgttacgatgttgacacattacccatctgacatggaaaaaaaaagaagacaaaaaagactatagggtagattaaggtgattactccgagggaagtggtgaagtggatttgggccatgttccaggcatgaatgaggcagtgtttctgccagtggtgtcctggggatggactaggacctggtttggccatgcccagggagatccgctgaagctcattgatttgtttttcattcattaattccaatcaagtaaccaattgctgtggctgggtctggagagggcatggctgaagccaccacagtgaatgggagaaagcagtgttggggattggtggtggatactgtcctctggtcttcctcccttgccccttttgggtgggtatctttggatttgtcttcctcctgtcctgaggccgtggggtcctgtcttccctcctcaagtctaagcctggcttgttctctggcaggtttgacagcaacgcctctgccagctcctccagtaatgagggtgacagtgaccgggatgagaagaagcggaaacagctcaaaaaggccaagatggccaaggaccgcaagagccgcaagaagcctgtggaggtgcagactgtagatgggagggcctgtgtgtggtgcagtgggtggggggcgtgggaggcattctctttaccttctcctgtccaccaccagtaggacctgttcttccttggggctgttttttatagccagtgattatagccttgagggttatcttcttggaaatttttctcactagccctgagattaataagcttctggaaggtctgaattaggagatgggcttctgtcctggtaagctaggcactgaattgcagaggggaaggagatactatccttgcccttagggagctctcgtctcgcctgatgctatttagtcctccactttttctccaagttaagtgatctaaataatttatttgggaaaatgtatgggttctgtgggaaatagctgaaggcatttgggttcttatgtaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggtgagtagcagcagaggaggggtgatgcctctcatgggctggcgagaggtgctgtcttggggtggcgagtctcatgactgataggggagcagtatgagccattggtgggactttctgtatcgattttgcctgcatcaggggagaggggagatgggagaggtcttattcttaactgtttttttctgtgtgtgagacaggagtgggatcgcaaggctgaggatgccaggagggactatgaaaaagccatgaaagaatatgaagggggccgaggcgagtcttctaagaggtgagtgtcgagaacatggcccagtcactgatttttgtggcagacttttttttttttaacaggccgaagttgagcattggaaagttaaagacagcagagatgcttctgactgcagtagggtagtgcttctcaaacctgggtaggccattgcccaagtatgggtgacacaatagggcattcaagtcactggggaaatatggcctcttttcctggaccattttatttgaaggtatgggggaacgaaaaaaatactattatggagtgcagtgcacagtttgcatgaactctaaaagataaagcaagaaatatcaagtaggttttgcacattgggctgctttaggctgtgccctctgattcttctggtgtactcatgatactctcccttggtgccctccaggctgacgcagctatttacgttcagagtgaaatgggctgtgtggctgggattgggaaaggccttgttaaagctgggagaggtttggtcatggtgacaggggacctgaaggcccagctcctcttccctcttgccaatacagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggtgcggcaggaatgtggggcctgtgggctgggcagggtgaggggcatgtgtgtctgtgtggggttggtctgtaagagtaatgagttggagtggatggtggaattctgaggttctgaaggggggtgctgtagttgggggcggtagggaattgcgggcccttcactgaagagtgggtggggcacccaggactccagcttttcccttaagacacctttggttttcaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccatgtcctcatgctttctttgtagccttggtgtgttgctcccacttttattggtggtgtttactgctctggtcagactgggcagggccttcctggccagccgggaagcaagtctcgaggtacatcctgttctgttcccggctggacgagcattggttttcacccgcctctgcccggatgggccacctgagagtctagaaatgagagctgatctgattaggaagtttctcccagttacactccattagccaaccaagctagggggaggcagctccttggctgcatccttacctatgagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16455 - DNA, 19998 bp, Human
gggatgcagcgttcctgtaagaaaagaaaaggagagctacgatacgtggacagaggcttttgctccagtttccatagacactgccccgtttgctcatgctgttccctcttgttagaacatcttcatcccacgctcttacttctcgctgactcatcatgtttcacaatacacttggatttttctctcttccgggaaacctctgcccctccctgaagagggataaagtgaccctcctcatactcccagagtaccaggtgattctctatagcattatcattaaaaatcaggggctgcattctctccctctgtcccagtagtctgggaactaactcctcaggagcagggactcccctttctcatcctggtgtttcctattggcaatgcctgccactcagtagtaggcgcttgttgactgagactattgatcacaggcaggttcgaatgtctttgttccctcatctctacccctgttaagggattacggagtgtcctattcatttcgggcatatagaaaatgctgttaaagttcattgaattgaatgaaacaattaatcgttctgcaaaatctgagcagagaagtcatttggtttcaaaatacttggataaaaacattacggtggctcacgcctgtaattccaacactttgggaggccgaggcgggtggattacttgaaaccaggagctcgagaccctgactctactaaaaatacaaaaatgagccggtcgtggtggcgcgcgcctgtaaatctcagctactcaggaggctgaggcacgagaacagcttgaaccgggaggcggaggttgcagtgagccgatatcgccactgaactccagtcagggcgacagtgaaactctgtcagaaaaacaagaaacaaaaaaactgtgaggtactgagatcacaaactggtgctcaaaatatactgatttcctttctcgtctggactaaacgggggtagggaagggtgagaaggaggggatcggccctcccaacaagtctcatcttccccagatgctgcttggtgctcaggggctgcaagtactctgtccttgcacagagggttggggactccagctgtgcatgggggcacacattaggcccacagcttgtaatggaccagtagtaaagtaagggaggggaagcagactctctcttggaaaggaggctcctgagtccttcttggggcttcccccaccaactgtttcccaaaccagcatacagtaggcacttagtaaatactaaacctagtaaaggactgaatgatggtagaccgaacccccaaagcaaaagagaaagggtccaacagcgcctccttgcggtgctctgccccaagccacggggagaaacgttgcagcccgcgccgaacgccgggcagcacaaaggatccccgactgccggggagcggtgctcggagggcacaggtctacgccatcccccacgcagtttcggagatggagcgctgggcccatggagggaaggcggcaggctcggcggctccggcagcttgctggggcaggggctcaaggcggcagtccgatagtggaggccgctgagaactgtcacggagctgcgtctgtacagcgagcatcccttatttattcagggcgagtgtgtatttggggcggcgtgcagggggctgacaaagaccggagagctcccggtgcggccgccggcggagcgaagactggaacccgtatgagcgccccccagcgcccctgagcgctcgccgccggtgcacggcgcaccccgcgggaggcagggatcagcaaagccgtgcgccccgaggcccgcccccgtctccgcacaaagaccgtgagtcccgggtccgagccttccgcgcggggatcgggcggttgtccggcgggtcgtccttcgacggcctcctggcctcgccggagcgggtgcggggaggcccacgcagcgacggctggaggaggggtgggcggggctgccgggggtggggtccccggggcggggcggggcgcgctgtgtcgcgggtcggagctcggtcctgctggaggccacgggtgccacacactcggtcccgacatgatggcgagcatgcgagtggtgaaggtaaccgcgtataggatgacccctttctcttggctcccctcgcctcccgcattccctcctccctccatcccctccgcggctctccgagcacatttatttatttgtctgggcaccagggctggctgaatccctgtcctccccgccctctactcagaggaggactggcctgcaagagtggccagagctggggttttgggggtttggaggcctctgcttgagccgttcgcgtggtgaagatgagccggctcccccaaaactggtttcaatttcgcttttcctgcctgaaacttgtgataacaactgggtgcatctccagtgcaggaaaagtccttggcatcttggtgccaggcattctgctactgctggtggtgggttatgaacacagatgaccaggatgaagtccttgccttggaataagcccatagcccatcccataatttgatgcctgtattactagagtcctgagaaacacggaatgctgattagaatttgggacaaagttccctgagtattctctggaggaaaagatgcggaggtggacctggaaggcctcctggagtaggtggcttgcgttcgtgagttctacaagtgttgaatgcctacatgtgctggccctgttctaggaggggggggggggcgggcagagatgaacacaaatccggcccttgttgaattttgttcctatcagggacacaatttgaaataagatctggaaggatggggagggggcagtttcctccagaaggtgggaaaacccagggtgtttggagatggattagggaggaaggtgatcctggtgaagtgagtctggcaccccaagtctttcagaagtgccccttccagtctgcagggtggaggggcaggctctaggaagagggtgcctgctaccctcagcctctgagaagaaaatggcctcagactgggatgcccagagcaggcttggcctagatactaaatctggaggttggcagcaaaatgaggcagagggtctttccagccaagtggaagagagatgggagccagaatttattgcattggaaccattacatgccaaacggtttacatggttatttcatctaattcgcacagcagttctgtgagataagtaatatatacccgcattttacaaatgaggaaattgaggcacagaggaaataacttgcttgtccagagtctttcagtaaggagcaatgggactggaatatgaaaccaggtccacaggcctccagcctgcaggctctcttaatggcctttctactttcattttctgttcctctgagtcaggtgatttcctagtaggcagtaggaaagaactgtgtgttttaggttgggtttcaacttcctcaggctttgggaaagttctggcagaactcatcctaaacagataaagttcaagtgtctttatctttccaagacctggaaaatgtctattccagatcttctccggtcagccctgggctttgttcttgccaaagagtcacagatgatagagaaactcttacaagtgcagatgcttctagtttggggtaaagataaatgaagggccattgaccctgggtggaaggcaccagaagcagcttattggttgaacagaaatagaacataggctgagggataggaggggggcatgggatgtgtttatattatatgttgggggtgggggtaaggcagagaaagttcaaatggtccacagtgttaaaggacccctccccacttgtggactgggtttggagagcttcagtttctcaacctcatcactactgacattttgggtcacataactgttatgtatccattgtatgtttttagatttgaggttactacaaggtttgtaaataatatcttataacctgttattttaaactgatgacaagttaacactgattacataaacaaacaagcaaaatgaaaactaatgaaggccaggcgtggtgtcccactcctgtaatatcagcactttgggaggctgaggttcgcggactgcttgagcctaggagttcgagaccagcctgggtaacacagccaaaccccatctctacaaaaagtaccaaaattagccgggcatggtagcacactgctgtagtcctagctacttgggaggctgaggtagcaagatcacctgagcccaggaggttgaggctgcagtgagctgtgattgtgccactggactccaatctgggtgacagagtgagacattgtctcaaaaaaaaaaaaaaaaaaaaaaaaaaacaactaatacaaactgtatactttaacttcgtctttccgcttactaactttttgttgtttctatttctttccttctttctttctctctccctttctttccttccttccttccttaagatggagtttcactcttgttgcccaggctggagtgcaatggtgccatctcagctcaccgcaacctccgcctcccaggctcaagtgattctcctgcctcagcctcctgagtagctgggattacaggcaggcaccatcacgcctggctaattttgtatttttagtagagacggggtttctccatgttggtcaggctagtctcgaactcctgacctcaggtgatccacccacctcagcctcccaaagtgctgggattacatgagccactgtgcccggccatttctatttctttcttattgtactgtctacctcttgaaaaattgttgtagttattatatttaattggtcatcttttcctctttctacttaagatatgagtagtgtatataccataaatacagtgttatactaatctgtgtttttctttctttttttttttgagacggagtttcgctcttgttgcccaggctggagtgcaatggcacgatctcagctcactgcaacctccgcctcgtgggttcaagtgattctcttacctcagcctcccgagtagctggggttacaggcacccgccaccacgcccagctaatttttgtatttttagtagagatgtggtttcaccatgttagccaggctggtctcgaactcctgacctcaggtgatccaccggctttggcctcccacagtgctgggattacaggcgtgagccaccatgcccagcccagatgattttttattgctcattaaaatttttttaaatttctgattgaagaactcctttttagcatttcttgtaggacaggtctggtgtcgatggtatctctcagcttttgtttgtctgggaaagtctttatttctccttcatgtttgaaggatattttcactggatatactattctagggtaaaagattttttccctcagccgtatttcatttaaatatgtcatgccactctctcttggcctgtaagatttccactgaaaagtcgctgctggacatattggagctccattgtatgttatgtgtttattttctcttgctgctgttaggaccctttctttaatccctgacatctgggagattgattattaaatgccttgaggtagtcttctttgggttaagtctgcttggtgttctataaccttctcatgtttggatattgatatctttctctagatttgggaaattctctgctactatccgtttgaataaactttctagccctgtctctctccctacctcctatttaaggccagtaactcttagatttgcccttttgaggccattgtctagatcctgtaggcatacttcattctttgtttattctttttttttatttttgagacggagtctcgctctgttgcccaggatggagtgccgtggcacaatcttggctcactgcaagctctgcctcctgggttcataccattctcctgcctcaacctcctgagtagctgggactacaggcgcccaccaccacgcccggctaattttttttttttttttgtatttttagtagagatgaggtttcaccgtgttagccaggatggtctcgatctcctgatctcgtgatccacctgcctcggcctcccaaagtctttgtttattcttttattattttgcttcatctgactgtattttcaaataccctgtctttaaacactctagttcttctgcttgatcaattctgctgttaaaagactgatgcgtttcagtatgttaattgcatttttttctttctttcttttttttttttttgagacagagttccactcttgttgcccaggctggagtgcaatggcatgctctcggctcactgcaacctctgcctctccaattctcctgcctgagcctcccaagtagctgggattacaggcctgcaccaccatgcccagctaatttttgtatttttagtagaaacagggcctcaccacgttggccaggccggtcttgcactcctaacctcaggtgatctgactgcctcggcctcccaaagtgctgggattacaggcatgagccactgcacccggcctcaattgcatttttcgactccggaatttctgcttgattctttttaattatttcaatttatttgttaaatttgttgatgggattctgaattccttctctgtggaggaaatattgaatttctttgagtttcctcaaaacagctattttgatttctctgtctgaaaggtcacatatctctgtttctctggaattggccctgtgtgccttatttagttcgtttggtgaggctgtgttttcctggatcgtcttgaagcttgtggatgtttgttggtgtctgggcactaaggagttaggtatttattatagtctttgtagtctgggcttgtttgtactcatccttcttgggaaggctttcgaggtattggaaggggcttggctgttgtgatctaagttttggtcactgcagccatgtctacataagggggcactccaagcctagtaacactgtagttcttgcagacttttagaggttactacctttgtggttttggataacatcaggaagaattctctggattaccaggtagagactctcattttcttcccttactttctcccaaacaaatggagtcttactctccgtgctgagctccctggagctgggtgaggtgtgacacaagcatccccatggtcaccagaattgggactgcactgggtcaggcctgaagccagcacaagactgggttttgctcaaggcccgctgtaatcactacctggctatgccctacgttcgctcaaggccctagggctctgcaatcagcaggtggtgaagccagccaggcttgtgttcttccccttagggtggttagttcactgctgggccccagagaggtccacagttgctgtccatgggccagggcctggagtcggaaaccttagaaatctctctagtgctctgtgctactgcagctaagctggcactgaaaccacaggacacagtccttcccactcttccctcccttttccccagatataggagtctctccccttgtccaccaccaccacgggtctatgaggagtactgccagggtactactgctgatgttcgcctaaggcccaaaggcccttcagtcagcttgtggtgaatgtgaccaggcctgagactcaccctgcagggcagcggtctcccctcttgttcggccagataattctttgttaggatgtttatcagcatctctggcctctatccactctcccgatttatgacaacggaacaatgttcccagatattaccgaatgtccctggctgggtaaaatcgcccctggttgagaaccactggtttgtaccaattcattgttccagagaaatgtgacctgcccttgagtgtctttatcttccccaacaagaaaaggcctgtagtcccacaagatggactctaaaagaggggcagcattcctttgtcaaatacatttgagaagtactgcatgctgtgggcccacagcttggtcaatcaccatacacaatagcatattaaaggctgtgggaagttctccagtgaagaaacctctttagccgagatttaccaaatgtacttgaccttggaacccttttcctgtactacctattaaccttctgcaggacatactgtacttatgtttcccatctgggccctctgccctggtgcttctccccttctctgctttatggattcctgttcattctgcatggcccagctcacagagtgcaccctctgtgaaaccttccttctcccctctcatctccttccttaccgtatatccatacacattcacataatcacatccatgtttcgtccattactctattgaaattcttgaggactgggtcctgtctcagttaaatgtcagtagaagatgctcagtaatggctgttgggagaattcagaagggatattcaggtgtttgggccacagttttgggaagatgagtcactccttgcccccttgtttccccacttggtgtgtagagttcttctctgctatggtcttcgggagtcatttcccttctccagccctgatctggcagagtttgaagcggtggggtcatgtctttgctgcagatgctcagtcgatgcttacggaaggaagaaaggaagagaggaagggaattagaacctagtgactttctaggaagaaggctagagagcagaggttaagtaccctgctttcaggagaaaagcctcctaagagcacttactcccaagttttaatatctgggagaagtgatctatttttccctgcacctagtacctaggtgtaccagagttgtggtgaggccacagtcagaaaattcacttaaagcaccagcaccggctgggcgcggtagctcacgtctgtaatcccagcactttgggaggctgaggcgggcggatcacgaggtcaggagatcaagaccatcctggataacacggtgaaaccccgtctctactaaaaatacaaaaaattagcggggcgtggtggcgggcgtctgtagtcccagctactcgggaggctgaggcaggagaatggcgtgaacccaggaggcggagcttgcagggagccgagattgcgccactgcattccagcctgggcaacagagcgagactctgtctcaaaaaaaaaaaaaaagaaaaaagaaaaagcaccagcaccatgcctgatacatactaagtgctcagtaaatgtaggctctgactttaccggcttctgcccctaagatggccagttttgaacttggggcagcttgctgctggggcagggggagggggctgaaataaggaggactaggccaactgcccactcacttgtgtcccctgcaggagctggaggatcttcagaagaagcctcccccatacctgcggaacctgtccagcgatgatgccaatgtcctggtgtggcacgctctcctcctacccgtgagtatccatggggaccatggctttggattggggccaaattaggccagggacatgggcagggagggttaggactaggcaagaattttccctgcttgagatccttttactggaggttatcattgctggagggggcttctctctgaattgattgcttctgagatccagatacttctgaggttcaccttctgataaagatgccaaaggacttttgacttagtaggagaccccttccttaaaccggtagccaccaagcccaccacagaacttcaggagacaaacagcatcaaaaagaagaagaaataaagatttcttggacctttgtcaaggggtagggataaacttccaggctctcacagttggtagaatttgctcccgcaaacctaaattgtattttgtttttctgtagtcttatttcagaaaattgttacatatgaaaacacaaatagctcatttctactgttcttatttttctctgtttattatttggtattttcttgataaagtctctctgaaagcagtattccaaaatagttttcagagtgcaagatctctctttttttcatccgattattagtgactaaagatactttgagaaattaatctacacttttcattacttggaaataaaatttaagacattgaactttttgttagtcaaagctctttggaatatcaaaggaacaattcatcttatcatttaggacttggacttgtttttttttttgagacagagtcttactgtgtcacccaggctggagtgcagtgatgcgatgttcgtttcctgcaacctccactctggggttcaagcgattctcctgcctcagcctcctgagtagctgtgactacaggcacgtgccactatgcctggctaatttttgtgtttttagtggagacaggattttgctatgttggccaggctggtctcaaactcctggcctcaagtgatctgcccacctcggcctcctaaagtgctgggattacaggtggagccaccacacccggcaggatttactttttattgacaatgcagtggcctaggttgtgtcgtcttctctttaaactgacctatagtccagaaaagtagagaaaggcctgagtcaggtcaacatgggaacctctgtcaagtcccttgggttactgtgttgaaacgatccacttacctggcttagagtgaggacacctgttctaggcctcaggtgccgggagaagatgctcaaaggagctccagggactgattatatctccaaggagaccaactttgagatgatgaaagcaggggtgataggaaaacctaggaaaggtctcgtttggcagagtactatgaaatcagaggacctcaatagttggcaagaccaaggtggttaagtgcgccccaggaactggccacagaccttccagccatataggagtcctgaagaaacatgatacttgggaggaatcccagagctggaggaccaaagcttgatgtaagtcatcagctaagggggcctgaaggtgcctggtgaggccataaaggaggggatggttgactggcagaggaaggagaaccaggaaaggtcttttggaatagcacacaaattcctcctcaaaggctcagtctcagtttatgtgttcaccaaagtggccccacttgtcacatcttggtcatggaaggattcagctcgatgagtctttcgaagctaatagtaaaattctcattccttgagagtttcctgtggaccaagtgctgttttaagcacacgacatatgaggtcatattgaatcctctcaaccatccagtgaggaaggttgtcttcctcttaaaattgcagagatggaaaccaaggaggttaagtaactggtctggggtcactcagaataaggtggcaggagtggaattcagcggactccagggtcttctcttttaaccactccatgaaaaatgaatagttttcaaaattttttaaaaagtagcaggccgggcacggtggcttacacctgtaatcccagcactttgagaggctgaggtgggtggatcactggaggtcagaagtttgagaccagcctggccaacatggtgaaaccctgtctctagtaaaaatacaaaaattagctgggcatggttgtgggcacctataatcccagctactcaggaggctgaggcacgagaatcacttgaacccgggagttggaggttgtagtgagctgagattgggccatcgcactccagcctggatgacaagagcaaaactctgtctcaaaaaaacaaaacaaaataaagtagcaaaatcctttatttaacctagaacttagaaggtagtgggactttctcaactgactgtaagatacagcatggaatcctctggtccagcttctccattttacagacgaggaaactgatcctcagagaaagctcagtcatacagcaagcccgaggcagagctgggacaggtccccggagctctcagctccatgactctgctacctccttcctctgttaagtcctacgaagcccagaaagaagccccttcaggcaggacacactgatacccctgtcttagtccattagtgttgctgtaaaggaatacccgaggctgagtaatatataaagaaaagaggttaatttggctcaagcttctgcaggctgtacaagaagcatggcgctgggcatggtggctcacgtctataatcccatgtctttgggaggccgaggagggcggatcacctgaggtcagaagttcaagaccagcctgaccaacatggagaaaccctgtctctaccaaaaatacaaaattagctgggtgtggtggtgcatgcctataatcccaactagttgggaggctgaggcaggagaatcgcttgaacctaggaggcagaggttgcggtgagccgagatcacgccattgcactccagcctgggcagcaaagtgaaactccatctcaaaaaaaaaaaaaaaaagaagcatggcaccagcatctccttctgatgaggcctcaggaagcttccactcatggtggaaggcaaaggggagccacgtgtacagatcacatgcaagagaagaagtgaaagagagagagagcgagcaggtgccaggatcttctaaacaaccagctttttcagtaagtaatagagtaagaactctcttatgactgtgaggttggcacggagccattccacggagccattcgtgggaggtctgcccccaggacccatacgcctcctggtaggccccacctccaacattggggatcaaattcttttcttttctttccttttttttttttttggtgacagagtctcactctggagtgcagagcaagactcactgcaacctctgcctcctggattcaagcaattctcatgcctcagcctcctgagtagctgggactacaggcacacgctaccacgcccagctacctttttgtattttagtggaggcggggtttcatcatgttgcccaggctgatctcaaactcctgagcccaggcaatccatctgcctcagcctcccaaagtgctaggattacaggcgcgagccaccgccacgtaggtcttggggatcaaatttcaacctgagatttgaggagacaaaacatccaaccacagcaccctcccatcctgctctgaggcctcagctgttggccttctctgactgataggcacagccttttctccttactgagaccataaaaaatgagatattttctttatcttcctacttttttttactccatctctctttttttttttttttttttttttgagacggagttttgctcttgttgcccaggctggagtgcaagggtgtgatctctgctcaccacaacgtcagcctcccaggttcaacttctgcctctcggttcttgcctcagcctcccgtgtagcggatattacaggcatgcaccaccacacccggctaattttgcatttttaacagagacagggtttctccatgttggtcaggtttgtcttgaactcccgacctcaggggatctgcccactttggactcccaaagtgctgggattacaaacgtgagccatcgtgcccggcctagttagatcacatggctagtgagtgtcagagccgaatcacacccaggcagggtggctccaagtgctgggattacaaacgtgaggcaccgcacctgacctagttagatcacatggctagtgagtgtcagagttgaatcacacccaggcagggtggctccggagtctgtgtgacccccatactctgttgcacaggctaatgcatgtcaaacccttagcacaggacagcacagacaggtgctcagaaaagtgttcaggtggctcaaagtctagagggtcttctgctggctccttgcagctcccaacccctaggtcactccagcccctgagtttgtttgtttttaatcatagtaaaatacacataacaaaatttactatcttaaccatttttaagtatatagttcagtgtcattaaataggattaaataggattacagctgggcatggtggctcacgctcgtaatcccagtaatctggaggccagagcaaaaggattgctcaagtccaggagttcaagaccagccctggcacagtgagaccctatcaaaaaaatttttttaattagccagatatggtggtgggcccctgtagtaccagctactcaggaggctgaggtgggaggatcacttgagcccagaagtttgagattacagtgagcaatgataatgccagtgcactccagcctgggtgacagagcgagaccctgcttcagtaaacaaacaaacacacattgttgcacaaccatcaccaccgttcatctctagaactttttgtctacctgtactgaaactctgtaccccttcagtaactccccattcctttctttccccagcacctcatgaccacttttgtattttgtttctatgaatttgactattctgggtactgcacataagtggtatcttgcaaatctgtcctttttttgtctagcttatttcctgtagcatagtgtcttcaaggttcatccgtgttgtagcatatatcagaatttcattccttttaaggctaaataatactccattgtgtgtatatgccacgttttgttgattgatccattgatagacacttggtttgctttcaccttttggctgctagaaacattggtatacaaatacctgtttgctttcagttctttgggtgtctacccagaagtagaactgctggatcatatggtaattctgtgtctaatcttttgagaaatggccatactgttttccatcacagctgcaccattttattttcctaagctcctgagttcttaggatttcctcattttctccatttcctcacccccattctaatgttttaagaaaggatgttccatccttttcttccataatctcagaaagtcttgaaagctgagatggtccttagagctcatctagtccatctttatccacttttcaaatgaggaaactgaggcctagaggtgggaagtggctcacccgtggtcacacagcaaaagccaggatcagacttctctgcctcccaggccagtgccctttggtgatttcacattttcactaatccatgactcaattgtcaaatgaatgcaggtgctgtgtgtgtcctggctcatgattcctcctgggagtgaagcagaggatgcctaggaccctcggattggggcaggaagggaggaaaaccagactggagcttgaccccttttctctctgcacaggaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaaggtggggttgggctttgcttggaggagggactgatactgggtagagattactggagagggggttcacagcttattctgagcttgaaaagccccaaagagcggagataaaaattgtgagtcttggctgaacttactatgagatagaagggatgcttcctggacagactgacctcctcctgcctctcttcttatacctgtgcagttgtgacagaggaacgttgctgcggttcatgggagaggcagcttggctgcacagggaagggctcgggaaaagaaagcccgctgttccctctgtggactttgggcaagttttcgttcctttctgggactcggtgtcctaaatgacagtggagggaactggcctcataatgataatacctgtcacttgaccgagcactttcggcactgtgctaaaaacatcacctgccgacttcatttttatttccccaacaagcccgtgaggtagtgttgtttagtagacccggacatctgaggcatgtgagaggtgaagtggttgcctaaggtcatacagatgacaaacggcagcacttggctgactcgcaagccacatgtggctgttgcaactgaggaactcaattctttttcttttttaagacagagtctcgctctgtcgcctaggctggagtgcagtggcgcgatcttggctcactgcaacctccacctcccaggttcaagcgattctccggcctcagcttcttgaatagctggaattacaggcgtatgacaccacacccagctattttgtatttttaatagagaggggttttgccatgttagccaggctggtctcgaactcctgacctcaggcgatccgcctgcctccgcctcccagagtgctgggattacaggtgtgagtcactgcgcctggccagaactcaattcttaattgtacttaattttaatcctttttgttttttctactgagacacggtctgtctctattgcccaggcagttagttcagtggcgcaatcttggctcactgcaacctccacctcctgggctcaagccatcctcccacctcagcctcccgagtaactgggactacaggagcatgccactatacctggctaatttttgcatgctttgtagataccaggttttgccatattgcccaggctggtctcaaactcgtgagttcaagccatccacccatcttggcctcccaaagtggtgggattacaggcgtgagccaccgtgcccagcctgattttaattcatttaaatttagatgcctgcatgtggctaatggctaccatattgaacaacacagctctagagcctgtggctgaatcagtgtgcaatcctccacctggaccagctcaggagtttttaactcaggaaatgaaagtccttaggttggtgggagtgggagcagggagaggagtggtccttggatgagcttcagggggtctgggaactgtctgttttgcatgtggatgtgcacatctgtctcgggagatgggctgctgccttcactaggttcccaaaggcatctgtgaaagatgaagagccagggggcagtggtggttttcagtctttagccttagacctcttttgcccaaggaaaagtttatttggactaccaatataatggaggaaaacagagcagtttttgttgaaatggggataagacccagaaacctcacttatctcagtggcccctgtgatgaggagcttctctgaagccatggaatgtagttgtttgaaaaccactgatgtaatcagtcaaggccttgggtgtcaccagccaagaatgagcggggcgtttgatctggtcgtagagtaatcctaagcgatgtaacctttcccccaaggagtgagtgtggagtgtcaggacattgggaacgggcagccatgactcccttccctctgccctgatatcctgatctggcctgtctctccccagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccatttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaattctggagtgcagctgagtctttgatgaggggatggggtggtttcatcaggaccatagaggactagggatttaagcataaatttctgaccttgcttcccttgaatgttccctaaacatcataaggaatgttggccatggaaaaataggccatccttggacagaggagctttcagaaggtccacaggggtgacgtccccattttattttatttatttatttatttatttatttatttatttatttaagacagaatctcactccgtcgcccaggctagagtgcagcagtgcaatctcggctcactgcaacctccgcctcctgagttcaagcgattctcctgcctcagtctcttgagtaactgggattacagatgcccgccaccacgcctggctaatttttgtatttttagtaaagatggggtttcaccacattggccaggctggtctcgaactcctgacctcaggtgatccacccgcctcagcctcccaaagtgctgggattataggtgtgagccaccatgcccggccaacacccccattttaaagatgaggcaattgaggcacagagcacttcagtggattgctggggtccactctgccaatccacacccctgcaggtgagccagggttatggctggggtgtgttttgttttctgtatttttcatgagctgctttcatcagcacacatgccccaaatggctgataaagccagactggatagttagcaggaaattgtaatcagctcaggggtttgtatctcatgagcaatggaaaaacaaaaacaagccaaaacttcagccagggattaacttcagttaagggattaacttaacccagaagaagaactttctggttgcaattgttgtaagctcctggaatactgctggcttttcagagatagaatatggggtgatttgagtcaaggaagtcacccagatcccactagtttctagagaatcttctccagctcctgccctggagtcccctaacctgagaagaagtgtgaaaagaggggaagataaccagaagaagtgccaccagagtcaaaatgtaagttttttatttttggcgaccacttactgaacacttgagtggcaggactgggcaaagctttttgcccatttcattatctcgtttaactcttgcaacaccttcataaggttggaactctcattatcccctttcagactgtaaactggggcccagagaggttaactgtatgtgtcacacagctggttagtggtgggaaccaggccattgtcctttcccaaacaccttgcgcagttattgagacctcagcaggtgaggaatcccctatggccagagtttattatcccagagtgcagaggttcctgggccaagtatggagagagcactgaggggccagacaggattttacaaaagtacttttaatgcagttaaaaccaacgccacacacccttgcctaagcccctggctctggtgcctccatggagcagaagggaacccccgggccgtggctgctgagctgggcaccctgcccatctctgcccacagagccagtcacctcctcacttcttcttggtcttcaccagtcctttctgcacaaggctgcggtacagttcctggatgtatgtgtagacgcacttggagtcgggcacagccaaccgcaccatgtcatccacgtccagcagctgagcacagtcagccagtttcctaaggaatggggtggaatgaggagcagaaggtcaaaggtgaaggatatgggagccaaggggatgggtgcaggcagcccagcaatgacgaagcccataggatgggctgggatgttggggctgggagatcatctaagccaatcatcccattatatatctagatgagataactgagaccccaacagagttaagacaaacccaggccaggtgctgtggcttcctttaggtaggtcacaggatgtagacaggtaaccccaaagccaacaccagtgaataattcaataatgagttttaggccaggcacagtggc

SEQ ID NO: 16456 - DNA, 16549 bp, Human
cgaaaattataggtacctccaagaggctggcaaacggccttatccagttcaagtcctggtgtcagattcaccttggagccagaactgatttgaaaccacatcatcctgtggttgcggaagccaggtctcccccgtataatcccagagtgcattttgcaacatcagagaccagacctggaaaagatgttttagtttttctaccccaacctccttttactgatgggaaaactgagacccaaaggggagtgagttgcccagggtctcagtgcgttggcaacaaggctaggtaggacccagacctccttaacaccaccagtccagttatcttctgtcataatcacagtgactgtatgttcagaatgactattgatatgtgtcctacatgaagacattagtacagaatatgtaagctcaagatttccctgacgatcaatacaccagcttgctaaatcaatcctggggtaagagacaacaggaatgcacccttctcccctgaactcatagctttaacctctgagtagtggctattccagcattatctagcaaaataaattcaactgggtttaataaatagatattgagggcctattactactttagcacacttctcagatttgaggaaacttgaacaaggtgaaaacatccccggccaggcacggtggctcacacctgtaatcctagcacttggggaggccaaggcagggagatcacttgaggtcaggagtttgagaccagactggccaacgtggtgaagccccgtctctattaaaaatacaaaaattagccaggcgtggtggcgggtgcctataatcccagctactcaggaggctgaggcatgagaattgcttgaacccaggaggcagaggttgcagtgagctgagattgtgccactgcactccagcccgggtgacagagcgagactctgtcaaaaaaaaaaaaaaaaagaaagaaagaaaaagaaaaaaaaaaggaaggaagggaaggaaagaaagaaaaaaaaaaaaacagaaaaaaaaacccagccccaacctttcaggaaaacataatctaacaaatgactttaataaataaagtgacagttaaaaaaaaaagaagttggcacatatacaccgtggaatactatgcagctgtaaaacaggatgagttcatgtcctttgcagggacatggatgaagctggactccatcattctgagcaaattatcacaaggacagaaaaccaaacaccgcatattctcactcataggtgggaattgaacaatgagaacacttggacacagggtggggaacatcacacacaccagggcctgtcgcggggtgggcggagtggggagggatagcattaggagatatacctaatgtaaatgacgggtatatttacagttaacgggtgcaacacaccaacatggcacacgtatacatatgtaacaaacctgcacgttgtgcaggtttaccatagaacttagagtataagaataataataaaaagaaaacaaaacaaaaaagacgtgctaactgctatgctacaggtagagcgaagctcattaccagctggagttagaaatatgtgactctttactcatcacaccccagaagacccagaaaaactttcaagagaccttttccccctgacccatgccactgggggcaactcaggaaaggaggggacggcgcagaactgggtggaatttggcagacactcaggaatgaagagggtccttagctcaggcaggctattaggtgactgggggatgggaaattgcaaggggctttagggagagtgtgagcagctggtgagctgggatgaggatgctgcagaagagaacagaacagaaacagtagacagagtgcagataaaacattagtcccagagggctccagccagctacatcccaggcaatcaggagcccaggattggagaccccacccctgctgtgacatcacaggggagtggagtggagacgaacaaaaagggggtcccccgccctggtcctggcctcttggaagccagagtatcaagagcagagaatctcactaggattgcatggcttaaagggacaggctccccattcctccaacccctctaagctgccccctccaggtcgtgatctcgtctccctgtcctgtaggacctccctctcctgaggccaccactgggcccccttctgagtgtcccctgagcactctctcagcatgaactgcatatccgacttcttcacctatgagaccaccaagtcggtggttgtgaagagctggaccatcgggatcatcaaccgagtagttcagcttctgatcatctcctactttgtagggtgagtctgtggcctttcaggttcctggcggggtgggctgcctggtatcccgtcttcaccctcctgcctcggtgctaccatccagcttcctgagctcctctgctcctgggggaaacagtttcttctgtggagccgagtcttaaagactggcctctgccacccccacctagggcctaaattcacccaggtgaattcttttcccagttcgtcctccagggttgagattggtttcaagacacacgctcggagtagtagggtccctgccccggcactgccctccaccgagggagggctcaggagctccatctccaccctccctgctctcatctccccaacaagagaacaggcagaccccctcccacatcttcgaattcccctcagtcaagtcttcggggtctcaaaaagacaagacagcacaggaatagggaagggaaggcactgagacaagggggtggtggcaggttgatcaagttggtggccgggagggaaagagagaactggatctgttttagaatgaggaatttccttctggcatggatgggtgagatggtgagagagagaagggcaagggagaagccctctgctcttgaaggggaggacaaagagggaactgccccttgatgaggaaacaaacagaggcccaagggaagagtggccaaggagaaaaggagcttttctgaacatagtgccgctccctccccaggaatccagaaatgctcccctttgtcaaaaagtgtaagttccctacctctccctgaccctgtgccatgtaacccatcctaggagttgcttaagagccaggaaggtgcaaccatcccctcagcccccaccgcctgcaagcacacacctacacacacacacacacacacgcacacaaagggctgtggagcagacaatggctggggaagaatgcaggtcctgtccttcttgtggtcatttccacacactggtgggcaccaggaaatacaggcagaaacctcgaaggttttctttcctggcatgcgggtctccaatcttatgctgttctttcagacaatgggtctttgcatttgaggcagcaatccactgactgtcaggagttagttcaagcaggtcaaaggagaatcctgtgtgcctgtgggctgaagctgcatgcaaacctgcttgcttgaaatgttgaagtttatgcgagggtgtggagggaaaggtggctagatgtgactttttaggtgattttttgctctgtgtgctgggcaagccctggtaggcttcagtgggcaggtattgtaaaaaggctgtaccatccagtgctcctttgggagattttagaaaagggattcaagctttggaatagcattaaatggccacaaagttcccttccaatgttgaggttttgtgagatacgaggtttgcaaatgttcgctgtctgcatctctagagcttggctcaaagttggttcctaaatgttctgtgttcacgtgtatattcaatgctgtggttgtttatagccacaagatggtatgttggcccaggtgagtgcaaaatctggctcagcacattccccttctggcctggctccactggctccaggcagagattgatgggggagagagtgggctcctagaccagcccgctcagcccccactgcccttgtctctgtctcatcatgatcagatagaatcctccagtcctcagggctggagcccagcctgctggagcgagtgtgcgaagctctttagcatcttaatttccaaccccatccatctcctagcctgacagctccccacgggacactgccttccagttacatcagcgccctctgcagcccagccccctgacctgagtcccatctccgtgtatgtgaacccatgcacgttgtgacttcatgagtccaccgtcattaatttagcaaaaatgtaccagcatctctgcatgccaggcactgtggattgaggacggaatggtgggcaaaagcagacagggtcctcgccctcctggggcttacagcggaaggcaagagatggcattcatctgatgatctccacaaacgtgaaatgtcaactgtggcttagaggtgcacagttatagagagccgcttctgtgaaggtgtttggcccagtcagggagtaagggaaggttttctggagatgtgacattttagccaagacccgaaggatgagtaagagcagcccaggtgaaagagggaaggaagagagttcagggcagagaaacccacctctgcaaagggaaggaggctggcaaacaggggaaagaaaagaaggtcattgtggctggagccgagggagcagagatgagtgagggtggtgtacggtggatgggaacacacacagaggccggacctcagacacccttagagagcttttgtttttacaggagatgaataaacagaagccatggaagcattttaacccgtgtgtctgtgtgcacttttgtgtgtgtgtgcacgtgagtttgagagagagagagacagacacgatgagatctgagttgggaagagcacctgggctgattccctggaagtggaaggagtaggagtgggtgcaggaaaacctgctaagaggcagtttatgcagagaggtgacagtggcttggacccaatcgaatttgaagggatttttaaggctatagtgttaatatttcactgatacttcaatctcttccccatcatcccaaccaggtcaacaacctagactctgcctaacatgagtccatcatttctctgagaacttctcagcaacacaccacctggtcatctcacatacgctctcacccccgcccctggcctcagctgcttgtctgtggttgacaccatttcatcactattttcctttacccactccagggcacacagagaggcctggacttacctgatgtttctcacatcttttctgggtccacgtggtaatccccactcacctctgtggagtgggacttcccgagagcccatccccgttctggatcctttggggacctgagaagttgaaggaaatccctaggatctgagtccctggaagcaatagcctgtgcttggcctgaggttgatttccagggccttcctggaggaagctgcctccttgcaaactaggaggccagggacttcccaggcctttgatgccccattgtgctgaagggtcactggtggctgctggagcctctgaccccaccacagccctgccctacctgccctgttcctcccccatacaagacccagtccacaaacttgccatctgtacagccccatgctttggttcataaaattcagcctcatttcagatcttaggtgggagttcaatacataaagcaggtgaaagggaggagctgctctggtttaaagagaagggtctagaatcctgccttcttggctctccactccatcctctcagcccagggtatcactgtgaggcaccttgtcagcacaattaagtgacagatatggtggaaagagctgttatggtgggaagaactgttgggctgccccatcttttttttttttttttttttttttttgagacggagccttgctctgtccctcaggccggagtgcagtggtgcaatctcgactcactgcaacctccgcctcctgggttgaagcgactctcctgcctcagcctccccggtagctgggattacaggcctgtgccacgacgcccggctaatttttgtatttttagtagagatggggtttcaccatgttggccaggctggtctcgaactcctgacctcaagtgatccacctgcctcggcctcccaaagtgcagggattacaacatgagtcaccatgcctggctggatgccccatctggaccagtcatcctggtccagagagaggagtgactctcattcctgcctgccctctcccccaatatggaacgtagagcacttggttagaagcctggctctgacaccaactaggagagggcctcctaagagtgactttacatctctaagtctcagtccccatatctggaaaatggatttaggaatacctcctccctgggagttatagggaggggaggtaacatatgtcaagtgccttgcggagatggtgactcagtaatagatggcaactgcgactacttcacaaagacccccccatcacccctccccctttccctctgcccagctcacaccttcctaagagacccctctcctcctcccacacacacagcgtgcactcttcacacccactccccagcctcctccttggctccctgggggcggatgggagggtgctggggcgcggctctggcctctctcctgcacatcccacctgccaaggagctgccacacgccttccgctctataaataataaaccatgaatgcgagaagaaaatagtcagagcagcagagtaaatgccaagaatcgaaggctcaggcctgccctagctcctgagccctggcctccagagacagcctcagcccctccgttctggaaatgaagcatccccttctttctagctgccttgatgacatcccgaggccctgtgaggccattgaaattcttccacttgttatttaagtcagagagagaattctaatgtggcctctccaccccactgggcacaagaaggagccttgaaggaggaggaggaggaggtaggagattggttgattgttccttggagtcctcggccctttcctcctgagactttcctaagccaggagatgctttcactggtgatggagcaggagctggtaggaaaagcacagggtccggttcagggggccagcatggcctggctttgagctgggacacagctagagaccttcgagtgaagaggctgtgagtggtctggagcacgttgtctggttagagctgacataccagctttgcaatcctgggcaagttagcaccctctctgtgcctcagtttcctcattcatgacatgaaggtaataacgaagctgtctcagtaagaatgtagtgaaagattcggcttagcaagtgccgcattggttatataatactagtctgaactctgcatctccaaatgttcctggactttaaggacgcagggcaggggcctcagaaaaccatttccttaggtcgacactgagaaatatgtctattctgtggctaggcacattgaagctcggttccagaagggtgtgtttagaccacagtttgcactctgcgaatgtacagccaacagccatcttagctggaagcagagagcctaggccccagacctcactcccttcactctgcagggccccaggctgtgagctaataatgctcatttgggtttcctgtgacagggaggctcccttctcttcttcaaggacgtaatttggcagatgggatttctacgtgaggcatacttccttgtgaaatctgaatgaaacccctccccttccaaaaaaagaagaaaagaaaagtgctgggagataaagcagcaccacaaagccccatagaaggcggtatgcatgagagcattttacaagcacgcaagtcactctaagtggtgcgttaatcaggatgccgcctgcctgctctaaaggagcaataggaaagcaggtaacgggtttgaagccatatgctggtgctgtgactacaccctttctctcctgctcaagaaatcattcagaattcaagccagtaatactactgaaaaaatgataaatatgtgaggtagtaaatatgatcattagcatgacataatcattccacaaggtataggcatatcaaaacacccacattgtgccccatgaatacgtacaattattacttatcaataataaatagggctgggcatggtggatcccgcctgtaatcccagcactttgggaggccaaggcaggcagatcacttgaggccaggagtttgagaccagcctggccaacatgggaaaaccccgtctctactaaaaacaaaaaagttagccaggcgtggttgtgcatgcctgtagtcccagctactcaggaggctgaggcacgagaatcacttgagcccgggaggcagaggttgcagtgagccgagatggcgccagtgcctgggtaacagagtgacactctgtctcaaataataataataaatagtatttatttatcaaaaatttaaacttaaattagaataaaaagaaaaaaagattccagtgagcaaaggaagacccatgatggggataacaccaaaccctctcactgaaaaccgaacgaagagccacttgcaaatatccgctggggtttgcagtaaataggattgtggtgtccaaactataagtggctgggacccccggtacgttctgggagctgctgctgtttgcatgttccaacagtaggtgaccccagagatcattcagtccagcctccacctgaggaaggggcctcctctcagcacacctgccaggtgagcaacatgctgtcctggagtcttcccagacgtgtggcacgcgtgtggtgactttccgcagcaggcggttctgggattgaagtcctcgcccacctccttatagaatcctcaggtcagcccagctcctggctctgcagcttcccagcctctaactcctacggctttgtcttctctgggctacacagtctcaaattccttccactcaccttcatctggtgtggttttccaacctcgtgccaccctggttagaagcagaaaatgccctcacccagcatttccaaaagtgtgctcctctgttccatgagacgtcaccagtatttctccaagactggcttctgtggtcaaataagattgggagacagtgaggttaacaaaatgtaacagatgtatttgtttgtttacatcgtatgtttctcggggagggaggagggttgcatggcattttctaaacgtatttgatgaggttttctcatctgtcgaatgggaatggtggcagcatctacctcccagtgtgccatcaggaataaaggcaatcttgccaaaggctggaagtgtgggattaagtgaggctgagcggggacttcagccttgagggctgtgattggcgatttcaaatggaaaggcaggcactttataggaaagcagaggcacgagttgccagcaggtatttgcaggcccttttgctcgaggccaggaaagtctgagaaggaagatagggatggaaaaagggaaggcctcatccacgtggtcccattatggcttaaagctgtaggaaggcgccagtacaggtaaatgaccactgggtggcagcacaatccagggaataagatcagactcttccctccctcctcccccagcccccccaccttcaaccgagctcctttacctgccaggtaaaagctcagccgctgtcccccgcttcctcctctgttctcatctgacacctgggcagatagattctgccaagcaccgagctcccaaggacctttattgatttgtttactgagctactttgtgttggacacttagggtacagccgtgggccaaggctggaatgcatgggagcagaggcctgggatcctctgtccttctgtctcctgggtgcctgccagagaagtggcccccatcagcagcatggaatgactttgagccatgcattctcaatggggccatatggcccccaaggaggtgaaaattggttctcactctttttatgcataaagcacaaatttgcatacagtacataaacagatatctgtgatatcaaagtttcatggagggggggaccactaggggagaaaatgtctagaaaggcacctgaggggcagtaatgggacaaaaggtggagaaacgctattctaagtcaaccaagggctcactctaggtctcacgcctctggaaggaaccatccgcacaccctgccaggcatggccaagtgttggcaggaaggtgacctctcccagcttctgtctgctgggtctatggactcctctctttctcttcatttatgctctcctgccccaggtgggttttcttgcacgagaaggcttaccaggtacgggacacagccattgagtcctcggtggtaaccaaggtgaagggctccggactctacgccaacagagtcatggatgtgtctgattacgtgacgccacctcaggtatggtacccctacccagagaggcatgtggatgtccagacactgggcaggttggaagggagaaagcgagcaaagagtgccaatgggattcccaaactagaatccatgatgtcactgatccagaggacctctcccccagcagctgagagctgtgtgagagcttgggcctgcggtgctgggcatcaggaaagctgggttcctctccaggctctgccacaacttgtaatgcaatcaaggacaacacacatgggagaagggggccatgtgggtggctgcaaagagccagctctgcccctcaccagccctgtgaccttggccaagtcactagacacaagccttgctttcctcatctgtagagtggggataatcagttatagtccctgtctcactgattgggactgttggatgtttttctctcccttcttctcctcccaagggcacctcggtctttgtcatcatcaccaagatgattgttactgaaaatcagatgcaaggattctgcccagaggtgaggggaggacagaggttgggtgaagcaggtcaaggctgaaaatgttggtgggagtgggagcagtggcagggaggtatgagcagaggccccaagtctgaccttgcaactgggacctgggacctccaccctcctgaggctgttggttatggggaggtcgagggagtcgcggagctcaccaggccaggacagtgtccttcaccaacctgtgacccgtctgcccacagagtgaggagaaataccgctgtgtatcagacagccagtgcgggcctgagcgcttgccaggtgggggtgagtccagccccttacccaccccacaatcccaagtgttagtgggacccatgggggagagcccgtcgttggagagggagtgggaaccagcctgttccatgtcattctgctggcatttacagttgctccctgggtgccacacccagtgggtgctacaaaggtggcatggcccctgcccccagaggagttcccagtctaggatggtggtgacagacaggggtgcttgaagtggcctgtgctgtccaggaggtacaaaagactgttgagcctgggggagggggagagattgcttctgggtgagcagtacccaaaggcttccttgaggtggtgacatttgggatggtccctgaagatgaataggatttggcaggacagagggggcttcaaaaagttcattccagacagaaggaacagctgcagcacagactcagaggcaaggaaggaagcacaagaagaagaggtgtcctcagggttgctggggctcggagcacatgaaaggaaggctgtcacctccctttggctgggtctggggctcaggagaagcagcaggagagaagtcagctcccttttccctgcctgctcttttcccccacttgccagggtccctgatggggggaagggaagagggaggaaggaaagggagaggagcaaagggcaggcagccacccagcagctgtggctctcactttagggatcctcactggccgctgcgtgaactacagctctgtgctccggacctgtgagatccagggctggtgccccacggaggtggacacagtggaaacgtaaggctccaagccagacaggaggagacaggcccccacctcagctcccctttgcccatgtgggagccgtgcgtctctgagcttgaggagggtctgtggctttctccagtgttgtcccttcctggtgtggggggtggcctcaggcccagggtatcatcttccccagcccacccacctgcctcctcctcctgctgtgacactcaggcacagacagccccttcctatagcccactctcaaagtgccctttatctataagaggtctccctttggaggcatccaccaggaaaggtcgccctcaggtgaaagccttcatttccccctcttcttcctggaaagctaaggcctcctgtgctcacccacaggcccatcatgatggaagctgagaacttcactattttcatcaagaacagcatccgtttccccctcttcaactttgagaagtgagtccccactccttccctaaagccaagatgcaggcacccccggccctgccaacctgttttcagggaagtggagatgccccctcgccacagttcttcccactttcgctccactgacccatctccctgggcctaccattcccaatctcccagcgggccttggccactgaggatcaggtgaactttggggtcagtttctctgccagcctccccaccttggggctcagacccaaacgggagttttgcttggggtaggagagggacaacttaggcctagtcgtgggtcaaggatgccttcaacggttgaaaccctttcggtctcgtcccattctttttccccacatctagcccatgtgtggaaatcccttttctcttagtcagttcagccccccttcattgacttactcattccacagctactcagtgggcattggccatgtgcagagggcaatgccagtcactacagaagtgcactaggccaggcgcagtgacaaatgcctgtaatccctgcactttgggaggccgagaagggtggatcacgaggtcaggagtttgcgaccagcctggccaacatggtgaaaccctgtctgtaccaaaaaaaaaaaaaaaaaaattagccaggcagccgtggcacacccccgtaatcccagctacttgggagactgaggcaggagaatcgcttgaacctgggaggcagaggttgcagtgagccgagatcaagccaccgcgcttcacgcctgggcaacagaccgagaatccgtctcaaaaaaaaaaaaatgcacagagtaaccaagaatgattcctgccctctcgaactcccagcctggcagctggagattagtcaccgacatacatcaccctgatacacagggaaggcggtgatggggcaccagaaagatgcagggaaaggaaagaggggagggagatggcgaggtccagatgaaggctgagggctcagatcccccctaggcctgggctccggaaggcggggagagattgcacaagacgatcttcccatgaaccctgggctgacctctctctctgctcctccccaggggaaacctccttcccaacctgacagccagggacatgaagacctgccgcttccacccggacaaggaccctttctgccccatcttgcgggtaggggacgtggtcaagtttgcggggcaggattttgccaaactggcgcgcacggtgaggacctagccattcttccgcgaccccaaactccccaccttcagccctttcccagatttcagggccctttggccggcactggccaggagccgccgcgagacagcgccacctggtggaagcatcccaggccgccactggctttgtgcctgaatcctttctgctttccccgcgcagagcgatcttgccccccgcctccgccgagtccaccttcctcaagcctcagtttcccactcccatcttcacacttcacctcaggcaaaggccttagatctgtaataagccccaaacgacgggaaagtagacctgtggccactttctcctgtgttgtagctaaagcactgaagatcccaaaattaggactcagaggctccaatgttcgcatccgagccacaacctttttttttttttttttttttgagacagagtctcgatctgtctcccaggctagagtgcatggcgcgatttcggctcactgcaacctccgcctcccaggttcacgccattctcctgcctcagcttccggagtagctgggaccaagcccggctaatttttggtatttttagtagagtcaggggttcgccgtgttagccaggatggtctcgatctcctgacctcgtgatccgcccgcctcggcctcccaaagtgctgggattacaggcgtgaatcaccgcacccggccaccacagcacttctttactgagcagtatatgacatgtcactttccgttctccctgcctccgtctcccacctggaggatgggaggaaatcatttgtcaccacctccaccccacccccaccctggcccagagcagggagtcagagggcgaggggaaagctcatacccggcccgtttcttcaggggggagttctgggcattaagatcggctgggtgtgcgacttggacaaggcctgggaccagtgcatccccaaatactccttcacccggctcgacagcgtttctgagaaaagcagcgtgtccccaggctacaacttcaggtaattccctgtctcctgggacaccaggagaagaaggtgcgggctgttaacggcaatgtttattggggagacaagatcccacatccatccacccacccctggccccaagtcccacctcaggtttcatttcaaatcaggaaggactctctaacagccattaggatctagctggttgtcctgggagacagtgtctccttatcactgaaggggaccacgccaaggattcctgctgcaggtcagtagttagaagagagggccaaggtctcttgaaatgctagggttctgcgattctttgcctgttcctaacactggcctgaaactgtgacgtgcttaagtgacttccagataggcccattccctgccctgggcctgaattttctaaggtttctcgctctacaaagtaagggtgataactggtatcattttacattttacaagatggcaactttgcatttctctccgcaaacgtgtgtcaccagtagcaattataattgtctctggttcttcaatgcctctccaaacaagaactcagaccagtctttaaatatcatcccaatggctttgagacttcagggatcttttcgggttttgttttgttttgtttttccattttgaagaaagggagagaggaattagaggacaaactgtttggaagcaactgaaagcgcttgaacaagccatttgtcttctcccatcctaatttccccacctatgaaattgtgatagtaccactgtgatcttcaggattcaattaaccaatgtgtgaaaagcttcagctttctgttttgtttctctcttcttttttttctgaatcattcatttattgattcatccattaaacacataccaattgtctactacgtgctgaggaccgtactcagttatcttaggttagcagttctcaaagtgtagactacaaggtcaacactacttattaaaggttttgttttctttttaattgataaataacaattgcatatatatgggatacaatgtgatgttttgatacatgtatacattgtggatttcccccagtttttgaagatcctgaagtttctggcagggccctgtttaagtacacagcattatacactaaacagcttaaatagaacaaatagggagtgaccaggggaaaaaaatacataagaatatatttcatttacatttgaacataagaatgtatatttgaatatattcaaataaatgttactcaaatttcctttgttgaggtggtattctctgatacaatggcatacgtaagccaaaaataatcatttcaccttttaaaattgttaatttataacttaaaaaaataatcacccaccccattaagctttatatttaatagtttaaaatatacatgtatattctctggaaagaagaatctttaaaaattgaagtactttcatcatcaactccaaactttaaaaaaaccataggaaacaacacatattttaaagtaggttaaaaatactgtgcggctcactggcagaaattggcatatttattcagttggtatatcacactgagatcaatacaaaggatatttgtatggtggcttaaaatagtaacatattaataaaattctcatgatctaaaatgcaagttttcatcttcataacttccctttggccattgggaattctttaatcctccaaataactcatttggcagaaaagcttatgaagaatgtgaatattataaagacccccaactactgatatcgtacagttttagaacagcatctctcatctaaataagaattggtctggagttctttatctccaatttattgcactgtggctgccttccctccctccccacctgagcacagaaggatgcgggatagacctggtcctaaataagcttggagggtatttggggaggcaggacggaatatccccaaagaccctgcctgcataattcccagaggcctaagagaaaccaccccctcttaggatctcagataattgactcccccaacaaagtcccccaggccagagaagaa

SEQ ID NO: 16457 - DNA, 21164 bp, Human
attaggtagatcaattaatttctctgagcctcattttaacttgtttaagatgggattaatatagcacctacttcataggtgatgagaattagtgagaggatgaatgtaaatgcatggtgagcactcagtgaattaggttgctttccaccaccttcttttcctttggctgacccatttcccagaatccacaagctcatagtccctttgagcccaccagcttgagcactggggatggagaaacgttgttttgtgtgcagctgttcaaacgatggctctgatgttatataactttcccatggtttaggaggttcccaagtggcttcagagaataaagcacaaagctggggaagactctttctgggtcttgtccaaggacccccgaggagacacacaaatattctcctgtttctgtccttggtcagtcccttagagtagcagttctggtgctagcagcaaactttcctgaatgctccaaacacagccagaggataggcctgcagtgagatgacgatagaacatgatagctatattaggtcatcagagacaacctgtttgttttgcagatgaggcagagttatcagatttagcaaaaatacaaaatgccaattatatttgaatttcagatacacaacaatgacaacaaaatttattttaccataagtatattccaatgtaagcatttttaccataagtatatcccaatgtaagttgttttttttttttttttagagacagcaagtgtcttactctgttgcccaggctggagtgcagtggcatgatcaatgctaactgcagccttgaactcctgggctcaagggatcctcctgcctcagtctcctaaaaggctgggattacaggtatgaacccccaggcctgcctacttcgtgtgttttatctggcaatgctgagaggacagctagatgtcgaggacagccagatttcgaggacagccagacgtcaagggggaaagcaacttgctggctcacacagccagccaggtctattgtggagccctagtcgcaaacacatacaccccagctttcaagtttttaaatatttatttagttagttatttgttttttgagacagtcttgctctgtcacccaggctggagtgcagtggtgcaatttcagctcactgcaacctctgcctcccagattcaagtgattgtgcctcagcctccctagtagctgggactacatgtgcgcgcctgcactgcccagctaatttttgtacttttagcggaaacggggtttccccatattggccagagtggtctcaaactcctgacctcaagtgatccacccacctcggcctcccaaagtgctgggattacaggcgtgagccaccgtgcccggctagcttttttttttttttttttttttaattaggttgaatgcttgttgagctgggtgcctcacatccgttgtctgttatacaaagaactactgattatgggtctctacgagcaaaaatggcagaacacctacagggcacaggggagatgggagcagggattaggcttcagaatacttctccaaatgagggtgatcagggcccgacatttcactgctctaaggctcagtatcttaactatcaaatgggtacaatggggcacaaagggttactttgaggaataacggaggtgagcaatttccaaaaagttcattcctttaaaaactgcggagcacattttgtgtacatgctgtttttattgttactcatgaagacgcgggggaagctttggttgtgtaaagctgagaactgcacccaagcttccccgttcaccccacctaccaggggatttgggctaaattcctggcctggcccacaaagaagaccaagcggtcagtcccattccgtcccatcctgatttacaggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtaggtttggtgctgggcaggggtggggagtagggtggaaagcatggagtgaagaggtctagggagggggtctcctcacccccgccttcctgcccgccttgatctcgggggtctctataggcttgcttccacctgggacttctgcctcctcctaccccagcccctcccgcctcaggcctgttgtgctcagccccccaggacctcccctcccccacgcctctggcctcattgtttggttaaagcaggaccccctccccctcccaccacctcccctccgactgaacagatggacagagacccgggcccacggggagaggaagggccagccggtgccgggaaagggaagcggtttggggaaaacaaaacagagggaggagccagggagaaggtggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggtatgtggtcccttgtgggatgggggacgggggtggagacgggaggcgggatggtgcggggtgcgggcggtggctgaggattaacccttcaggctccggggaatgaggagagctcctcttgggatcattgagtgtgatccttgcacacgcactcgtagatggtggaaagagctcaggactcagacagatgcaagttctaatcttggcgggccatgtaggagctgcgcagcgtggtcctgaggacgtcacttttctcagcctactcctcctgatttataaaatgttgaataaacagatcccaccctgtccaccaagcaggcttggcaggaggatcacatagggcaaggagatgggaagcattttgtgatatcaaagcaagagtttgttgtagaaaagagctgtggggaggagaggtttggctgctgtgacacagacggtggtcccaggctagggcctgtgaagacagggaagaatggtagcaaacatacgtgggtctgggtgggggtcaatagcagtgagaggtcccagtggtctgggaggtcatggactagaaataaggctaagaagtgcaggatcccaggagaaaggtaggtaggggtgtgtgtatgtgcgtgtgtgtgtgtgtgtgcacgcgcaagttggtatcacatactcagcagatgatgtagttatgagcagggagtttggaatcagagaccttgttttgacccctagctgtttctcccatttctgtgagaccctggactagttaatatgtgtcggtatgagtttctctacctgtgaaatggagctaatgcgtggtttctcagtggaggatctgttgacattggggctggataattcattgctgaggggctaccctgtgcattttaggatgttttgcagtatatctctagcctctacgcactagattccggtagcatcttccctgctgtctccctgtgacaaccaaaaatgtctctggacattgccaaatatcccctgggagtcaaaattgtttcagagccgctggcctatactacttctctctccctcccttcctgcctcccttctttcctccttccctttcttcgttcccttcctaatgtgtactgtttttccacacccactaatgggttgcaacccacagtttaaaaatttactgttctaaatcaaggagcacaagttcaaatgtctgtactagccaagcaagtgagtcaaacaggtagatatttacaggaaattgcaagaacatagataaatgacaacactcagcttcactgtttggaaaacaacttcctacagggcagtaattggtcagagattacagagtccctgactatccctcatcttctgcagagcacattcctgtgcacccccaccctcaccctgtattgccccttctctgaggaattagtggtggtggttctaagacagattgctcatctgccgcactgtcagaaattactctcttgtacaggacattttccacatccacaccttctcttcctgctttgagtattttagaggactgtgcctcgtagtaagaaaaaaatgaaactcagtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggtaagaccctgcttgaattctctccaggtcatttgttggacactcccataagagtcaccaatccagacacttacaaagccatgcctctgggaagaagctgtaaaaatgggctattatatattgggggtggggtagagggatgtatcttttcattcttgaacattccatcatttcacagtgatgtaataggcacgattgcttgtaaaactctgtgactatacaagaacatataaaataaggtcgcagccactaaccatgtttcatggcaaggagaggtgataagaaagatgaaattaggcgcagtggctcacgcctgtaatcccagcactttgggaggccaaggcgggtggatcacctgaggtcaggagttcaagaccagcctggccaacatggtgaaaccctgtctctactaaaaatacaaaaattatcagggagtggtggtgcatgcctgtaatcccagctacttgggcagctgaggcaggagaatcgcttgaacccaggaggtggaggttgcagtgagccgagaccgcaccattgcactacagtctgggtgacagagcgagactctgtctcaaaaaaaaaaaaaattatcagagatagacctagagtagatgtggttagtactgccttctagctctgtgaccttgggcagatcactttaacctctctgagccttgagtcctcttgtgtaaaatagtgatgatgctatctacctcaaaagattaagaagcagaaagccaggccgggtgcggtggttcacacctgtaatcccagcattttaggaggccgaggagggcagatcacgaggtcaggagttcgagaccagcctgactaacatggtgaaaccccgtctctactaaaaataaaaagaaattagctaggcatggtggtgcacacctgtaaccccagctactcaggaggctgaggcaggagaatcacttgaacacgggaggcagaggttgcagtgagccgaaatcatgccactgcactccagcctgggaagactgagcaagactctgtctcaaaaaaaaaaaaaagaagcagcctagtgtctgacttagtgggaggtcaaaaaaatgtaaatcctctgccatcttgagggattactgtcaagtcccatttggtaattaccctaggaatggcacaaacaaattactacaagcagtggggacagagctattactccccagagagaattctaaaaaggctacagaatctttcttggctgggcacggtgactcacacctataatcctggcactttgggaggccaaggcaggagttcaagaccagcctggccaacatgttgaaaccccatctctactaaaaatgcaaaaattagccaggcatagtgatgcatgcttattgtcccagctacttgggaggcagaggtgggaggattgcttgaacctggagattcaagtgagctgagattgcaccactgcattccagcctgggcaacaaagcaagactctgtctcaaaaaaaaaaaaaaaaaaaaaaagagagagattgagagaacacttccagctcagatgatctgtgatcccctccaaagcagggaataccctccattccagcctggtccccaaccctcattcccaaggaaggcccccgactcatcctgcaagtatctttcatctctgccctttgttgcaggggctggggagaacaccaaaacaaacctggagagcatcctctcttaccccaaggacttcacctgtgtccaccaggccctgaagggcttcacgaccaaaggtgtcacctcagtctctcagatcttccacagcccaggtgagtgcccaggaatgggcagtgtctgcagaggagggtcctgagaggactctgaagggggacccagcgctggggaaagaaaggacagagggaatgttggagctacagtatcagggatggactgcagagcaggtgaagaccttggcaggagcattaggtcactccaggaactagactgttcttctaatgagaccttagacaagtctctggcattcatcaactgctttagaataaaaataaccgggcaggtacagtaaaatagtgatgatgctatctacctcaaaagattaagaagcagaaagccaggctgggcgtggtggctcacacctgtaatcccagcactttgggaggccgaggcaggtggatcacgaggtcaggggttcgagaccagcctgaccaacatggtgaaaccctgtctctactaaaaatacaaaaattagctgggcatggtggcgggcacctgtaatcccagctattcaggaggctgaggcaggagaattgcttgaacctgggaggcggaggttgcagtgagccgagatgacgccactgcactccagcctgggcgacagagcaagactccgtctcaaaaaaaaaaacaaaaacaaaacaaaaacaaaaaaaaaaacaaagaaggagaaagccgggccgggcatggtggctctcatctgtaagttcaaggagttgaaggtatgctaggactttgggaggccaaggccttcaagaccagcctgggcagcatggcgaaacctgtctccattaaaaaaaaaaaagttgggggtacggctgggcatggtggctcacacctgtaatcccagcactttgggaggctgaggtgggtggaacacctgaggtcaggagttcaagaccagcctggccaacatggcaaaaccctgtctctattaaaaacacaaaaattagcctggcatggtggcaggcgcctataatcccaactactcaggaggctgaggcaggagaatcgcttgaacccaagagagtgaaggttgcagtgagctgagatcatgccacttcactccagcctgagtgaaacagcaaaactctgtctcaaaaaaaaaaaaaggaagaaagaaaaaaggccaggcgcggtgactcacgcctgtaatcgcaacactttggcaggccgaggcaggcgattcacaaggtcaggagttcgagaccagtctggctaactaacatagtgaaactccgtctctactgaaaatacaagaaattaccctggcatggtggtgtgcacctgtaatcccagctactcaggaggctgaggcaggagaatcgcttgaacctgggaggcagaggctgcagtgagccgagatcgcgccactgcactccagcctggatgacagagcaagactctgtctcaaaaaaaaaaggccgggcgcggtggctcatgcctgtaatcccagcactttgggaggctgaggcgggcggaccacgaggtcagaagatcaagaccatcctggctaacaagatgaaaccctgtctctgccaaaaaaatacaaaacttagccgggcatggtggcaggcgcctgtggtcccaactacttgggaggctgaggcaggagaatggcatgaacccgggaggcggagcttgcagtgagccgagattgcgccactgcactccagcctgggcaacagagcgagacaccatctcaaaaaaaaaaaaaaaaaatggggcgggcgggccaggcgcggtgtctcacacctgtaatcccagcactttgggaggctgaggtgggcggatcacttgaggtcaggagttcaagaccagcctggccaacaccaggaaaccctgtctctgttaaaaatacaaaaattagccaggtgtggtggcacgcgcctgtagtcccagcaggagaataacttcaacctgggagacagaggttgcagtcagctgagatcgcaccactgcattccagcctgggtgacagaccgagactctgtctcaaaaaaaaaaaaaaagaagaatacccatatgcattcattaatatatagggctagagggctagagagctatagacataaaatagacaaaaaatttttttgctcatttttgggtcaaaggagtcttgggactctaattcttttaatttttgtgttatgtgaatttgttatcatttacatgtattatgttattaagtaggtaataatgataatactaataataaacttacaaaacgatccaatgtagttgttttcagactttgttcctcggagccctaggactttgcaaagctgtttctggagtcatggtgggagtggggtgtggggagcctgagcagtggggaagggttcaccacttcctgtgagagggaaacggaccagctgggctctgagctccccacccagcctcagccagggtccattttatattgtgggcttcagacatgcctttgtttgaaagcagttctgctgctttaaaatgtttgataaccattgaactaatctacccacctccctttttaaaaaaaaaaggaaaacttttttttaagctgttttttttgttttttgtttttttttaaactgtaaaaacaatacttaggtctggctcagtgtgcctgtaattccaacactgagaggctgaggtaggaggattgcttgaggctagaatttcgagactagcctctgggcaacatagacagacctcatctctacaaaaaattttaaaaattatccgggtgtggtacgtgtctgtagttccagctatgaaggactgagacgggaggattgcttgagccaaggaattcgaagttagagtgagctatgtttatgcctctgtactctaggttgggtaacagagtaggaccctgtctctaaaaaaaaaaaaatttaatttaaattttaaaaactcacctatcaccccatcatctgaaaaacaccctctttcagatgtgggaaaaacatggctcagaggtgttcaagaaatgttgcatttatttattacttacaaagctgtaagtcagctttatccgctgtcttgctaggttggtgaaaaatacgtaacagcattcaatattagggcttctatccccatctagctgcacactggagctgtgccaagcaaggttcttggtcttatgttgtacttaggcatcagcaaagcctgggaaaatatcttttttttttttttgagacagaatctcgctctgtcgcccaggctggaatgcagtggcaccatctcagctcactgcaacctccgtctcccagattcaagtgattctcctgcctcagcctcccgaatagctgggattacaggctggtcttgaactcctggcctccagtgatccacccaccttggcctcccaaagtgctgcgattacaggtgtgagccaccatgcccagctggggaaaatatctttaatctacttagtcctagaaaaattatctttcaagtgctttttttttttttttttcagtggactgaaggcttttgcagagcaaaagccaggaagttttgtcacaaacttccaccaaggccaggaagcagagtctattccgtgccaaaattaagggaagaaaagagggaaaatctaggcaaatggaatttaatatctcaaaaagattatcttgccgagccatagtcacatagcaagctgaggcagcggaggcttggggctacttctcttgttcttggttctgggtttaccttctttgggccttatttgccacatctgtaagaggagtgggctggaccgcgctccaccatgccgtattcactaagtgagcagatagaaccatagaaagcatgctcactctcaaatcgtgctcatggaaagaacgacgtgttcaggactcatgcctccctttctcaacatacccccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtggtaagggtgcccttagccagttagtcttcccattctgggtccttcttcccctcctggcttcaaagcccacttaaccccaagttctacaatcggatctcaatgtccctgcactactctttgctaacaaggcttttagctcctcttcatccttttcctacctgcattagagcaaccctcccacctcttccctctagccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtaagttcttaacctttccttctcctgtttgaaacctacttgagtctcctgactttttttctgctgtagtcccatcattttggggtacatgcttacaaattcatcacttctactccttccatctgtatttccaccctatcttttctccttctcctttctctagccttggccaaggcagacattgtatattttaggctggaaacaggattctcaagtttcttcatgcatctctactatattgaatggcaaaatgtgagtcgtgttcctattctacacatctgtttctttttccagtcaactcatcagaagactctggtggcttagcaagtcctgtgtgtatgtgggtacctgtgtacagcatacatatacatgtgtagacgtgtataagtatatccttgtatatgcatatatgtggtaagtgcatgtgtgcacatgagttaaatggcttaagtgcattagcagaaattgaacaatttagtttgatgagtagggagggagagaagacagaatatggagcccagaggatcccaactggcaagctatctcatccccagttaccagatatttccacctttttaggatggcaaaacacagacctatgagacagaaaacagtaagagacaatgtctcaatacctggctgagaaacaaaggctctgttcttggaacatgctaggcttggttccacattgggagctttccttagcttttgtttctgcctgtatccctcttcactcagatcctcacatagcttgttccttcttgtcatttgggtgtcagctcagaggtcaccttggtggagaagtcttctccccattaaagcagcctcctcctcaccctgtaatatcactcctgttttattatattcattacactcatcaccatctgaaattatgtcatttatttgcttatttgcctaggacattgtctgtctccctaagatactgtctctctacttgaatacaggaacctgtcttgtttccttctgtatctgtagtgcctagaacaatgcctcctatcataggtgctcattcagtgtttgctgaataaatgaatgaatgaaatagagggtgccaaagagagctactcagtaaaagtggctggaagacttcatagaggagggtttttttcgagacagggtctcactctgtcactcaagctgcagtgcattgacatgatctcagctcactgcaatctctgcctcccgagttcaagcagttctcctgcctcagcctcccaagtagctgggactacaggagcccgccaccacacctggctaatttttgtatttttagtagagacggggtttcaccatgttagccaagctggtctcgaactcctgacctcaagtgatccacaccctcagcctcccaaagggctgggattacaggcatgagccacagcgcccagctgaggaggttatttttgaccattctttgctcagttatttatccactcatggacttatccacccatctatccatccctatctaatgtatttgaccattcatgactcatttagcagaaccaggacagcctgtataaggcacagaagagtgaatatatgtgacaggtccagagcattgttcaaattcaagatacgttgggggaggtataaatatgagatttttttcaaatcaattggaatggctatttaatcaaagccatagatgttaggtggaaagtaggaattaagaacttaacaagttaggtttaaatgtaactattcgaattataagaacaagtatttcctctctaaaaatgtttttaaagtttcacacaaaactctaaaccaaaaatcattgtaaaaatcccttgggagtagactgttgaaaccattgaggtgaggtgataggttaaggtgagcattctggacatataatatcaataataaatattcaaatacaaagcaggtataatatgaagagtaatttctatctccccaagccaatatgagttttgtttgtttgtttgtttttcttttgagataaagtctcattctgttgcccaggccggagtgcagtggcacaatcccagctctctgtaacctctgcctcccaggttcaagcgattctcctgccttagcctccctagtagctgggattataggcgcctgccaccactcccagctaatttttgtatttttagtagagatggggtttcaccatgttggccaggctggtcatgaactcctgacctcaagtgctcgtccgtcttcggcctcctaaagtgctggcattacaggcgtgagccactgcacccagcctgagttttttttttttttttaagccaaaggaggaggagtagttttgtgcacaaaagccactatttagagttccttaggttttaaacagataattaatttaatgtactaacaaatgcaaaattaaaattttacttatgccttttaattttaagctgaacttgctacattaagagtagggtgatttggctgggcgcagtggctcatgcctataatcccagcactttaggaggctgaggcaggtggatcacttgaagctaagagtttgagaccagcctggccaacatggtggaattctgtctctactaaaaatacaaaaattagccaggcatggtggcacatgtctgtaatcccagctactcaggatgctaaggcacagaatcacttgaacctgggaggcagaggttacagtgagccaaaatcgcgccactgcactccaacctgggcaacacagcaagactctgtctcaaaacacaaaaaaagaataggctgggtacagtggctcacgcctgtaatcccagcactttgggaggccgaggcaggtgaatcacctgaggtcaggagttcgagaccagcttggccaacattgtgaaaccccatctccattaaaaatacaaaaaataagccgggtgtgatggtgcacgcctgtaatcccagatacttgtgaggctgggacagaagaatcgcttgaacccgggaggcgaaggttgcagtgagccgagatcatgccactgcattccagcctgagcgacagagtgagaccttgtctcagaaaaaaaaaaatagggtgatttttatataaaaacactctcatttgttcttgaattaattgccatattgaacagattaaactcctttaaaccattttttctatctacaaacataattagtattcccataagcattttaagctccctttaaaaatttaatatgctcgattttcttttttcttttatttatttatgtagttttcccagacagggtcttactctatcacccagtctggagtacagtgacacaatcctcacttactgtaacctcaagctccttgggatgaagcagtcctcccaccctagcctcttaagtagctgagattccaggcatgagccacctcacccagctgattttctttttaaacacatctaatacctgacaggtcgtaattacgactgtgcttggccatatcatcctaacacctaaagctcacttgtaaactgaaaattaaatttgaagggtgaattaacttctagccaacattccaatatcattctcacatttaatgaaattatcctacaactttgcttaaaagcataaaactagcatgtcagagtctcttaaaaattacaatcactattttaaataacaaacatacaggttaccctgaacttaacacctggttttaacatgatgaagttggtttcttttgtcattcttatactaaattctaaatcttcctggcacttaaggatatttacccaaggaagggggtgagatttaccggctcaggtacaccgaggttactggcttgaaaattcaagaccacagcatggtaaatttttcttcagagattcaaggttcatacataggacttgaagggcacatgctactcaaatgagtatatccaacttgagtgctacatcaacagggaccccatgtccactcttttcagtcgaaattggcttactatctacttcttctgggctattcaggttccgacaattgattgctttcagttaatttctttattgcccagttgaattctgcattcttctagattctttttgttccttcagcctcaatcataataccatttaatgacagtctcatatcctattagactagggtttctcagccttggcactattgacatattgggtcagataattctttgtcctgtgcattgtagaatttagcatcttccttagcttctactcactagaagccagtagcactgtgtgcacatcctccttgccccctgccagctatgacaaccaaaatgtctccagacattaccaaatgtccactgagaggcaaattcactccgagttgacaacccctgtattaaacccaggggccctgcacttcttacatacttttgtctggtcaccagttgaaagtccttcttcttttttttttctctttttgagatggagtctcgctctgtcaccaggctggagtgcagtggcatgatctcggctcactgcagcctccacctcccgggttcaagcaattctcctgcctcagcctcctgagtagctgggattacaggcacgtgccaccacccagctaatttttgtatttttagtagaggtggggtttcatcatggtggccaggatggtctcaatctcttgacctcgtgatccgcccacctcggcctcccaaagtgctgggattacaggtgtgagccaccgtgcatgaccaaaagtccttctaatagcaaagtggaaaggtaggctgtgaacaatcttgaatgccatactaagatttgtacttattctcataggcagtgaagagccatcaatagtttttacagaggctgacctgataactctggcggttcaatgtgcatgctatatactatatgcacaacacattaggaaggaagggaacagcgctcagagaaatcaaatcacttgcccatattacatagctcgtcagtggtggagtcagggtataatcagaaactcatgctccttcctctacctctccccagcacagagttggatcagcactgttcacccagctggtatccccatttcatggtaaagcctggaagcttaggtctgactgatgcttgttgaaatacagactgtgggagcagactgcaggacagcattgtgacagagggtggggccaggagagagatgcggtaggaagactgttaagatgcatctcttattttctaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattgggtgagctctggcagcttagggttactcccaggccatcagaggagaaaggggggatccctaagatgtagttagcattctctagagtattttttacatccataatctcagtttgtcctgcaaccctgcaagttagaggggtaggtgctattatcccattggatcattgtggaaatggaggctcagaagctttatgtgacttacccagagattccatgatttacccttgagctagtcagaggcaaaccagaacaccgacccaggtctccagctctcctgagttttttctatggttccttgtgacataggcagtggaacagtgggacaggtaacccgaggtgaattatggatgctccttccccagacacatttcaaaacagtcagccaccccgtggaatatgcaagaagctatctggaagtgcagatactggggggttttgggtttacggggggcccccgaggccccaatttcttttttttttttttttttgagacggagtcttgctctgtcacccaggacaggctggagtgcagtggtgcgatctctgctcactgcaagatccgcctcccagattcacgccatgccattctctcgcctcagcctcccgagtagctgggactacaggtgcccgccaccacgcctggctaattttgtttttgtatttttagtagagacggggtttcactgtgttaaccaggatggtcacaatctccggaccttgtgatccacctgcctcggcctcccaaagtgctgggattacaggcatgagtcaccgcgcccagcccagagactccattttctaacctttgtttttttgtttgtttgtttttgagacggagcctcactctgtcacccaggctggagcgcagtggcatgatcttgggtcactgcaacctccgcctcctgggttcaagtgattctcctacctcagcctcccaagtagctgggattacaggcacctaccaccacgcccagctaatttttttgtatttttagtagagatggggtttcaccatgttggtgaagctggtcttgaactcctgggctcaagtgatccacccacctcggcttcccaaagtgctgggattacaggtgtgagccactgtgcccagcctcattttctaacctttgatctcatgtccagccctgtcacttcatttcttgttagagaatttgaccgcctaacacatgattccatttccttgtatatgtcatctgtataggaagaaaacctcttttttattttcattcaacacttctggccaccaaacaggtgtgggagtgttttctaagcaattctccagttatctggggacaccaactgggtgtcctacaattgaatccaattctaacactctacctggaaataacatcagatcccgtgcagtttaagtgctccgccccagcaaatttccccccgtttccaatgtcagttacaagactgggttgtcacctgtgcatcagaccaaccagctataatttggagattcccacaactccctgctagggtttcatcatttgctagaatagctgacaaaactcaggagacacttacatttactggtttattatgtaaaggattaagtaaaggatacagatgaacagccagttgaagagatacatagggcaaaatctggaagggtcctgggcccagcagcatctatcctgtggagttctgtttgctaccttcctgacacatgtatgtgttcaccaaccagaaactctcagaaccctgtactttaggagaagtcatcatgtaggcatgattgattattacccaatctccagctcctctcttctccccagaggatggagagaggggctgaaagttccaagcttctaatcacacttggtctttctggtgaccagccccaatccaggagccagcaggagtagcctcattagcacaaaaggcattcctatgacccaggaaattccaagggatctagtagctctgtgtcaggaactgggatcggagaccaaatattagatggtctaatatttggagctaaagatgctcctatagcatattttcccattatttcacagcatcatggcattgcatataacctcattttttcatatatgacctatctctgatctattacctcacttccaaggtcctgggagataaggaggcaatgacatcatttttcagggttgttttagggatgaggggcaaggcctctcaccttgagagagagtggcagtgttgggcccactaatagaggatcccacgaactgccagagggtacagtatgtaatctggcaaacaagggaagaggaagagagcactgggactcaggatgaacccagagaattcaggacaaaggtctccatcagctgagggtatcatgctggcttctgactctgtttttctctggttttgccctagaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgactttctctgctttgcctttgtttttttattttttattttttattttttttaggcagggtctcaatctgtcacccaggctagagtacagtggtgagatcatggttcactgcagccttaacctcctgagctcaaacaatcctcccatctcagcctcctatgtaggtgggaccacatgggcttgccaccatgcccagctaatttttaaattttttgtaaagacagggtcttactatgttgcctaggctggtctccaactcctgggctcaagcaatcatcctaacacagcctcccgaagtgctgggattgtaggcacaccatacctctcctttgcctttgaatatcagctgcttcaatactaaaggacaagagcgcccatggttcctgtatcagccagctattgctgtatagtaagtcacgttaaacttagtggcttcaaacagcaaccctttgttattttatgtaagtttcagagttgactaggtgttttgctgatctgggctgaacctggctgatcttccctgggctcattcatacatctgtaaggtatagttgttgggttggttaggggatgactggtcttctgtggcctcagccatgacaccaggacaacttggctcttctacatgtcttgtatgtccttccaacaggctagtctgtaatggaaaagagtcaaacagccagtctctttttgtttaccattgtcctgcagccaaagcaaatcacaggaccaaacctagagttagactggaaaagcactacaaagtgacagggcaaagagacgttaattggggactattcatgcagtccatttctcacagcccctatcttgcttatttgtctgcaacaactctgacaacaataatgacagtagctaacgttgggaacataggcagtctgctaagagttttgcaggcatttaatcttcacaataaatttatatggtaaattcagagaggctaagtcttgttcaaagtcctgtagttaggaaatgatgaaactgagatttaatagcacctcttatgactcttttttttttgagacaaagtttctcttttgttgccaaggcttgagtataatagcacaatctcggctcactgtaacctctgcctcctgggttcaagtgattctcctgcctcagcctcccaagtagctgggattacaagcatgcactaccacacctggctaattttgtatttttagtagagacaggttttctttttttttttttttccgagatggagtcttgctttgtcggccaggctggagtgcagtggtgcaatcttggcttactcaacctccacctcccgggttcaagtagttctgcctcagcctcccaagtagctgggattacaggcgtgcaccaccaagcccagctaacttttgtatttttagtagagacggggtttcaccatgtggaccaggctggtctcaaactcctgactccaagtgatcttcccacctcagcctcccaaagtgctggcattacaggtgtgagccactgtgcccggcctagtgaaaacaatcttctttactcagtctaccagctcaaataccagtctcttcaggaaacaacctcacagacacacccagaaatgatatcttaccagttgtctgggcatcccttagcccagtaaaattgacacataaatttaaccaccccacaccttcccttctcagtttcccaaagtcaatctctcaggctgctgggaagaccccaaattcctgtctgggtgggtcccgctttgattcttatgtgaggaactgttgaaagcaaaggcaccccccaaattcaggaagattcccctctccttggggagatcctgacatgatgaaggtggtgctcagcaccaacctgaattgtgaaccaacaaagtcaggaggtggaaggtgattctgacccctgtgggggtcaaatctctttgacccttccaatcatgctgagcccggtaatgttcccgtttgtgaaatgatgaagccaaaactcagagaggttaagta

SEQ ID NO: 16458 - DNA, 21451 bp, Human
atggtaattgttcttataattttgtatattaataatagaggttaaacatgttcaatacagagcctgaaaaacccagaaaagcattaccatctattgataaagaaccactgttaacattttggtgcatatcctttgagtttttttaattatacatgtaactatatcctattttccctctactaaaatggaatcttaacatactgctcaatagcctacttttaagctatctaagctattcattttgtttccgtgttttttttttttttttttttttttttgagatggagtcttgctctgtcacccaggctggagagcagtggtgcgatctggtattatacccaggaggctttttgttccatgcatggtattttataatgttagtaaatacttttccttaattttatagtaagcagaaaatttttatggttggggtggatgcaaaagtgatacataatagtttagaagacaaccaattttgttttaccagctgtttgggcatttttagtacccccttcttgatttgaagggtttaatcttgacctttttttttttttcttcgaaatagagtctcgctctgtcacttaggctggagtgcagtggcacaatctcagttcactgcaacctccacctcttgggttcaagcgattctcttgcctccgcctcccaagtagctgggattacaggtgcccaccaccatgcccagctaatttttgtatttttagtagagatggtgtttttccatgttggccatgctggtctcgaacttctgacctcaggtaatccgcccactgcagcctcccaaagtgctgggattacagatgtgagccaccatgcctggtcctgtttccgtgttattttaagaccatcttggtcatggtttactaaatgctttgtccatctgaatcactgttgcatagttgatgttgatacctgtgaggcaggccttctgctcagggcaaccttgagtatttgttgacagtgggagtggttttgtagaacaaacaatggcttatttggagagctccacacaatagattatcctctcctgtgggagccagaaagagatgagctcacagataatgggtttcttccttcctggtagttacgaataaataatagtgtgacagactcaccctctagtggttgttggtagtactgaaacaggaagaattgtctcctggtttgatttttcttactttcaattgctttctctgttcctagtggctgggcttcccaaatgtgatgttggtgaataggcttcattttgaaagagctggaggtattgtctttagaaattggaggatggaatcttacctcttaacacatttgttgagtagcagacatgaccttggaatgactgtgaaaattacttttcaagtttatacctcatcagtaccaaagccagatcctcctgtgatgtagcaggaagccctttattagtttttctctatcaatccatcttttataatttccaaaataggataaggagaagcttaaatatgaaatgtatttaaaggtcttatcctaccagttgtttcctgtgtgtaaatgcctaatttcctgtttggttaaggaactgttctcagacttctgtggcattgagtcagttgctttggttaattctgttctctgagagtttatcctgatctctacctagacaagttaataactgtcagatatcattcaaataaatgataagtagtaaggatttggttctttctttttgattagcctttcctgaatgcttgttactttctaagcctgcagacttcaaagaaaaaaatgtagttttaattaaattgcaggtgtttttaaaattattaccttttatttttactaacccattgaggaaaattgatcagtatattattcatgcaaaggagagataagatgagcacactgaaactccagttaatcctcctttgcagatgagggtaatgggaatgtccaggaagctagccataatgacttgatgtattctcttggttcttccaaaacttctcaggagctatgaagacatgattggtgaggaggtgccatcggatcaatactactgggctcctttggcccagcatgagcgaggaagtttagcaagcttggatagcctgcgcaaaggagggcctccacctcctaattggagacagccagagctgccagaggtgatcgccatgcttggattccgcttggatgctgtcaagtccaatgcagctgcatacctgcaacacttatgctaccgcaatgacaaggtgaagactgacgtgcggaagctcaagggcatcccagtactggtgggattgttagaccatcccaaaaaggaagtgcaccttggagcctgtggagctctcaagaatatctcttttggacgtgaccaggataacaagattgccataaaaaactgtgatggtgtgcctgcccttgtgcgattgcttcgaaaggctcgtgatatggaccttactgaagttattaccggtgagttctaggcctaaggaaaattgctaagtcagtgttactctctagtgatgttgagaactagagggatttccagaccttttacttttgatgaaaggttgtgaactggtggctgtgggtcaaatccatctcacagatttgtttggatcacacagcatttttgaaattttaaagaactggttgctgatgtttaaaattcagaagatttcacttaaaattccagattcttggcttctattaaaaacgtggaagagttgttaacaatggatctcttttcttccttagcagtatttggtctgaactgattggagcatgtgctctctaatttacactaatctccaacacattctattatctgaccaactacagctgtttaggaagttgtttcccaaacatggagctgtcaactgctattttttcacatgcttgtaatttcttttaattatcttcctctcttgactcaccggcttgacccatatagacatttaagcttgtggttcttgctttatttagagcagtagtttttcagattgtgggttgtgatctatttgtgtgatccgttagtgaataaaacaaaattttgtggagcataatcagcattccaagggaaaggaataaagaaaaagtagtatagaccattgtttctcagttgtgggccattttgcctgccctgccctgaggacatttggacatttgcagtgttggagatatttttggttgttataacttggaacaggggagagggagtgctactggcatctagtgagtaaaggccaggggtactggtaaacatccaacaatagacaagacagctcctcataacaaagaatcatctggccgaaaatgtcagtggtgctgaggttgaaaaactctggtatagacagatcggagagcattgagcattgcttatagttttgtttgttttttttgagatggagtctcgctctgtcacccaggctggagtgcagtggcacaatctcagctcaccgcaagctccgcctcatgggttcacgccattctcctgcctcagcctcccaagtagctgggactacaggtgcccgccaccacgcccggctaattttttgtatttttagtgttagccaggatggtcttgatctcccaaccttgtgatccgcccgccttggcctcccaaattgctgggattacaggcgtgagccaccacacccagcctgagcgttgcttatagttaaacattgtttgtttcatgatctgtatgtttattttgagctataatgtagaatatgtttcttggtgagggtcgcaaacaaagcttgaatattactataaggtatttggtcactggggaagactgagaagtgatacgatagggggattctctttgacgttcttcagacatattgtcttgaatgctcaagagccatctgatgaattgtctcttccaggaaccctgtggaatctttcatcccatgactcaatcaaaatggagattgtggaccatgcactgcatgccttgacagatgaagtgatcattcctcattctggttgggagcgggaacctaatgaagactgtaagccacgccatattgagtgggaatcggtgctcaccaacacagctggctgccttaggtaacagtagggactttgagaatatgaagatgaatttttgaggactgacttaaatttcctaaaaaaaaaaaaaaattaaaattctttagcctattctttagcctccattcctatctgtattgcatactgtaactccaacctttctatctttgttgctattctctcatgtataccacatgtacctatatcagttttcttgctgttccccacacatcctcttcacttttatgcctctttgactttgttcatctactttggtaagcttttgttcagcatctaccacatgtaaggtggtctagtcctggacttgtgtgtgtctatgtccttgccctagttatttgtatttcaagtcaggctgtgataaattcagcaaaaggggtacagagtactaggaggttagggcatgggtgaggaaggtctgttctttctgtgatgcctttctcttcttatttatctttttgtggttaaactcaagtgcctttattttattaaagttttcctgaattctttttatatcctataaatgctgctatataatctttctctctttggaatacacctctgtgtgctgtgttccattctacatatgtattatatacttccatacgagaagtatatattccatcttgaattactgcatctggtacatatcattaatccctaccccacagtgatataaacattcagaaggcagggactgttaatcaactttctctcaactgcagtaccttgcttataataggtatttactattacagtgagtagaaaaacatattcaggaatcttgtaggtgttgagggatatttaagggaggatttctggatttgagtcatcttgaagcttctggtttcccctcaggaatgtaagctcagagaggagtgaagctcgccggaaacttcgggaatgtgatggtttagttgatgccctcattttcattgttcaggctgagattgggcagaaggattcagacagcaaggtaagtgctgtcttacctttaatggctgagtgaatttcattcaccacaactatgaagtatctgtaggtcagagacctatcatctcaggctttcaagtaacattaaatatttatactgtcccctaccccttatttttgagacagagtcttgctctgttgcccagcctggggtgcagtgatgtgatctcagctcactgcaacttctgcttcctgggttcaagcgattctcatgcctcagcctcccaagtagatgggattacaggcgtgtgccaccacacccagctaatttttgtatttttagtagagacggggtttcaccatgttggcctggctggtctcaaactcttgacctcacgtgatccccctgcctcagcctcccaaagcattgggattacaggcgtgagccactgtgcccagccaagcccttactccttaaagtgggtattcaacttaaaacatgttttttgtttgtttgtttgtttttttgagatggagtctggctctgtcccaggctggagtacagtcccgtgatctcggctcattgcgacctctccctcctgggttcaagcaattctctgcctcatctcctgagtagctgggattacaggcacctgccaccatgcccggctaatttttgtgttttagtagagacagggtttcaccaggttggtcaggctggttttgaactcccgacctcaggtgatccacccgcctcggcctcccaaagtgctgggattacaggtgtgagccactgtgcccggcttttttttctttttttttaaatctgtcacctatgtattttaaagctgcttagctgtcttccaaaattgtacattgtctaagtagtaagaatgatgatccaatttcagtcacacaccaaatagtggcagaagccaataagtccatagttggaccttccattagcctgaggctaccgggatttcaagaagcctggagcacttaagaggcatcctgagaagttatggattgggttatgcatttgaagatcaacattttaatacctgagtcatggaaacctgtacttgtggagaaatcacaatagacattcttttttctcattggcccttttatgtccctaagcttgtagagaactgtgtttgccttcttcggaacttatcatatcaagttcaccgggagatcccacaggcagagcgttaccaagaggcagctcccaatgttgccaacaatactgggccacatgctgccagttgctttggggccaagaagggcaaaggtgagtcttggttcctgtttcttagtctttaatgtgggatagggaaaggaaggaacactttagcttaaggtacaaaatacttggcaacagtatgggagtctgcctggttatggatgtctttttggtttgctgctttccctgtgttgtgtgcttcattcaaggtgtggtgatgggatggtggttgtgatgtgttggtggtggtggtggtggtggtggtggtatcaatgagtggggcagtggaaaatgagaactcaactaatctgggaccttcttccccatacgtcctttgcattttctgtgtttttcttttcttctctgtgcttccctgcttatttgcccatgattctgctgacatctttctcctgcatttttcttatttcatttctcttctctgctttctaccttgggtgatgcactggaagatgagtggttctccagaggtgagtggagtcttttaaggtgcttatctacttctaatttgcatgttttgattttagcttccctagtatgtccttgcctaacctttccctgtctatgcatgtaggaaagttcagttgaggaagacactgaaacaagtttagctctttggagctaatagctcacggcatgctgtttctgggcagcagtccccattatcagaactcaggacaatagcatcaacagtggtcatcctcatcttacctatctgctgcctgttttctatccttgtttctgaatagtcccctgctggaacaagttgccctcacctgccccttttcccctcgtggtgcatctgtgatcaaaaggttctgactgaaggatgaaaaatgtgccaggtggaatcttttcttttttaaactggcttaccccttttcccgccctttttcatttttgtagggaaaaaacctatagaggatccagcaaacgatacagtggatttccctaaaagaacgagtccagctcgaggtaagttatcttctcagtctccaaaggtctcataaacatagtacaaagataagatatttagtaacctaacagcagactttatgtaatacgtttattgtcctctcttttccaacttacagatttgaaatgattgtgaaagtattgggaagctgcatagtattatagcagtaacttaaaaaggactgcttgttaaggcagttattcaggttacttgaggatagaataaggtcctgatggtagtatagagcagaaatttaggaaccataaatggccactgtagtgcctgagacttaaacctcactattaaaagaggcttctttaccaagaaagatactttttaggctgggcacagtggctcatgcctgcaatcccagcactttgggaggccgaggcgggcagatcacctgagatcaggagtttgagaccagcctggccaacatggtgaaaccctgtctctactaaaaatgcaaaaattagctgggcatgatggtgggtgcctgtaatcccagctactctggaggctgaggcaggagaattgcttgaatctgggaagcggaggttgcagtgagccaagatcgcgccactgcactccagcctgggcgacagatagaaactccgtctcaaaaaaaaaaaaaaaaaaaaagaaaagaaaagatactttttgtactttactaaaagaaatttggatctttatattcatcaatacagtgagtccaaagttcacagctctccatggatataaaaattgtaaacgtttaatctataatggacccttgtagtaatcgcagaggtgggaagaatgactgggttaagttagaaataattgatttgagatgaggaatttttaaccttgagtgctgtcaatgagctaaatggagcccctgagcgctcatggtagaaccaaaggcaaagctatgggagaggaggcaagaaggaaggaaagagaggagttgagtataatgagttgatatttgttctactcttaccatggattcattattcttaagacatggaatttggcctctaagtttgctgtagagagtgtgagagagtttagggaacctgatggtatagaagcataaatccatcaactgagagtactaaggctggactccagccagctagagcctggtttattggtactgattagcaccctctgcttctatttctcttttgtgcaggctatgagctcttatttcagccagaggtggttcggatatacatctcacttcttaaggagagcaagactcctgccatcctagaagcctcagctggagctatccagaacttgtgtgctgggcgctggacggtaccttttagaaaagggatttggagatgggaaaacttagataactagtttgctgccatttgtaatttgttccacccctttctatttgctattctagtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtgaggagttgaatgctaactgttacctcaaaatttagtacagtgtttgtagtccagcaggtgcctaataatttattgaatttattgaaatgactgaagggaaggaccctcccccgcttcatagtttatgaatgcgagagttggtaagggttttagtttaatggttcttggaaagaaaacaagtgacaactcttcaaaaataaaataataattgctattatttattgagcacttactttgttactaagcgttgttaaacacttctgtgtttccatttaatcctcaccactttacaaaggtccatttttttaaataggataaggaaataactcatggaagttaagtaaattgcccagagttaatgtagctagttagtagcagaacccagttatttatttatattttaaattcataataactcttctattaaattattataatattcaagatattttcattagagtatctgaaaggactgtgtagcttatttaatatacagtatttacactttcaatgtggttgaagtagaaaagaaataaaggaataggtaggacagtaaatccatggctatttcaggtccttagcccttttgatatgataatcctataggataatgaagttgattcatgtggacagcacctacacttgatatgattaatgcagttaagtataatgtaaggctcttcatgacctgacttgatcttttctccctgcatacattctttcttactaggtaaacatgctattcctaacttggtaaagaatctgccaggaggacagcagaactcctcttggaatttctctgaggacactgtcatctctattttgaacactatcaacgaggttatcgctgagaacttggaggctgccaaaaagcttcgagagacacagggtattgagaagctggtgttgatcaacaaatcagggtgagcttaccacctaaaattacagtcaaaagaatttgagtgagtggagagttgttttcctcttttggttactaagaaaggaaatttccccttatttacgtgtaatgtgtgaagagctattgctctattatctgtcttaatgttgatccataaattgataatagattcatgtcaaacttttcttgtgtcgctatttgggatagaatacaggatttggtaaaaatttgatttaacccattttggcatttatattcttttttgtttgtttgaggcagagtctcgctctgtcacccaggctggagtgcagtggcgcagtctctgcaacctccacctcccgggttcaagtgattctcctggctcagcctcctgagtagctgggactacaggtgcgtgccaccatgcccagctaattttttgtacttttagtggagatggggtttcaccgtgttagccaagatggtctccatctcctgacctcaggtgatccacctgcctcagcctcccaaagtgctgggattacaggcaggagccactgtgccctgcccctggcatttatattcttatgttattagaggatatagggtctaagcttttttcctgattttatatccaaattccgtatggtgttactttcctccaaaggaaccgctcagaaaaagaagttcgagcagcagcacttgtattacagacaatctggggatataaggaactgcggaagccactggaaaaagaaggatggaagaaatcagactttcaggtatagtaacttttgagaccaagacttttactttttttttcttggtcccaggataatgcttctgttttctttcgtttcttccatttcaccatcatgctaaacctattttttttttctttttcggagacagagtctcactctgttgcccaggctagagtgaagtggcgcaatctcggctcactgcaacctctgcctcccgggttcaagtgattcttgtgcctcagcctccccagtagctgggactacaggcacatgccaccatgcccagctaattttttatatttttagcagagatgaggtttcaccatgttggccaggctaatcttgaactctgagcttaggcaacctgcctcggcctcccaaagtgctaggattacaggcatgagccatcacacctggcctcatgttaaatctatttttgacccatatttcttaattaggaattatttggccaggtgtggtggctcacacctgtaattccaacactttgggaggctgaggcaggtggattgcctgagcctaggagtgtgagaccagcctgggaaacatggcgaaacccatctctaccaaaaataaaaataaaagtagccaggcgtggtgttgtttgccagtagtccgagcaactcaggaggctgaggtgggaggattgcttgagcccaggaggtagaggttgcagtgagccgacatcacactgctgcactccagcctgggcaacatagctaaaccctgtctcaaaaaaaaaagaaaaaaaaaaagatttggtttactcctcaaaaggatgatgtgtctacaattcatttgttgccgacacagctcaggtatccctctatgtcataacatactttaggtgcaggtgatgatgaaggatgatggcctttttgacttttgcccaaatctaccgtagccctttgagggaatttttactattctctgaaactgtattttcttctgatagtgtcaatatttggatcctttgtaatctcctgttctggaacacaaatagaagccataatatcctagtttgtctcactgtctagggtatttattcaactcttataagttgctttttcatgattctatttgggaataggaacctagaggtttatgcccattagagcataagatagggtgaattcagtattctgtcacattgtcgcatttgtgtttgcctctaggtgaatctaaacaatgcttcccgaagccagagcagtcattcatatgatgatagtactctccctctcattgaccggaaccaaaaatcaggtgcagtatccagaaggcacaccctctccttttagccactcttgctgttctaggtggcttactaagaaataggatatatattatttctgaattagctagccttttgtgggaggggaataattttccactccaggatcctaacgcagaaatgggtaggtcttaagcattagaaatcaaaacaaaacaggtaattagcctgaatgtgattcctttatcattgcttgtgaacttaaaacactggaaagtgaactctagtctgttttgtctattttttctccttttaaatttccatttaatacttaatattgtaatagatagttactattttaaaattacaaaatataaacaatcagaaaaataacaaaaaatcacttgtttcttttatccagagaaaaccacttgtatcttttaaaacatttttatcatgtgagtaaacacatttttcctctgagatgaattatatattttgttttgtaaattttttctttttcacataaagtgtatattgtgaccattattatcttaatcacacttggctttttccttgattattggttcttaaagtgtggtctgagagtcccaagattgttacaatttgtactgatggcacagaaagcagtgatgcttcttgctggtggcttagcacaaaccagggcagtgacataaagctgaatgagtcattgtagtcttcattgccactcacataggtaaaagcagagagccattttcacttaactggagaagaaaaaacatcaggccaggtgtggtagctcatgcctgtaatcctagcactttgggaggctgaggcgggcagatcacctgaggtcaggagttcaagatcagcctggccaacatggtgaaaccccgtctctactaaaaatacaaaaattagctgggtgtggtggcagacgcctgtattcccagctactcaggaggctgaggcaggagaatcgcttgaacccaggaggcggaggttgcagtgagccgagattgcaccactgcattccagccagggcgacagagttgagactccgtatcaaaagaaaaaaaaaatcacttttattgtttttctacccttgagtatacatctttttaatattctgtgctgatgaaatagcatattaaagcatgatggttgtcttaaggaaatgtacttgtgttattgtttcagttactagttagactagccactttttaattgtttatttatttattttgagatggggtctccctatgttacccaggctggtcttgaactcctggggtcaagcgatcctcctgccttggccaagtgttaggattacatccggcgctcagccacactagccactttgtttaatggaacactgtttttacttggaaaaaaatgtgtggtagacaaagggattattcagatgtgcgcatttggcagacattttctcaaaaacgaatgcgataagcttgttgctttgaggaaaataacacagtgtttgctgcctgagctttcaagtggaaattgtagttttgaaaaacttttatttgccactgtgagcctggtaacttcccaatactgaaaagacttttctaggctgagtgtagtgtctcatgcttataatctcagtacttggggagactgaggcaggaggatcatttgagcccaggagtttgagaccagcctgagcaacataatgagaccatgtctgtacaaaaaaattagccaggcatggtggcacattcctgtagtcccaattactttgggaggctgaggcagggagatcacttgagcccaggtggtcaaggctgcagtgagctgtgattgtgctactgcattccagcctgggcaacagagcaagaccctgtctcaaaaaatacatgattaaaatgaaaaaagacttttctaatgaaataaacagtgatgttaacgaatgtgatttcaaaatattgtgtaatgctatgtgttagcattttgaatatctggataacttgaagcagtattttgcaagtgacaaatacatatgtcaaaatcgtacataggtaattgatccgttaaaagtgcaagatggaccaatggattttaactaaacagaatatgaagtgattgttaattatagattccacattactgtcaacctttaagaaactactactaattagtatactattaaagaagaataaccacaattatctgaaaagactattaaaatcatcctcttttccaactttttatctgtgtgaggctggattttcttgatatacattaactacaataacatatcacaaaagattgaatgcagaagcaggtatgagaatctaagccaaatttcaaagagatatacaaaaatgaaaaggatgttattaaagattatttatgataacatgtaagaagtttaccattaagtgaaatagatactttaaacttgtcagtatggtaacaattaatacataaaactcacaccaatgaaggttctttagatccttataatttttaagactgtaaaacggccttgagaccaaataatttgaaaactgctagtttagatggaattgttttttgatttaagagtctgtaggggccaggtgtgatggctcacacctgtaatcccagtactttgggagactgaggtgggagaatcacttgagcccaggagtttcagaccagcctgagcaacatagtgagacctcatctctacaaaaagcttaaaaattatccaggcattgtgatgcacatagttggtgctaagtagaagtgtgaatgaagggaaggaaggaggaccagagagcaattttcatgatgtgtacagattttgaagaattgtttttgacatggataactttctgacttcatacagataagaaacctgatcgggaagaaattcagatgagcaatatgggatcaaacacaaaatcactaggtaggtgattaattcctgcctaaggatgtggagtaatatttcactggctaaggagagctgtctagctctatagttttttttctaatacccttaccatttaccatcctgggagagcattggctgatcatttccattttgaaggatgtaaggaaatttaataaaatctgatccgtctactttttctacattcctacatgctcaaaggttttcagaaatctttctatgcctctcctattactacacattcaagtttgtagcccattatattcctaccccagtctccttctctggagtgaatggatacatctgtttctgcccaactattctgcttgctattctatctattcactctatagtttgattctgctcatgtaatacctcttactggtatgtccttcccttttgtctttctaaattctctttatctccaaaggcttaactcaagtcctgttttcccttgtcaggtccttcctaacgattgcagcatatttcactcgctcttcttttaattcccataaccttttcagacaaacctcttgtttagctttattatgtcatattctgggtattttatacatattgtcttccatcttagattcaagttctttttttgagacagagtctcactcgttcacctgggctggagtgcagtggcgtgattctcatacctcagcctcccgagtagctgggactacaagtgtacaccatcacacctggcttattcttatatttttagtagagatggggtttcaccatgttggctaggctgatcttgaactcctggccttaagtgatctgcccgtctcagcttcccaaagtgctgggattacaggcatgagccaccacggtcagccagattcaagttctttaagtcggggaccatcagactttaatgcctttgtggagcatttgacaagctcagttcccaacagtgatgcctaattacacctatctgtttgatatacgttttacactagaggggaatgtcatatttctgtgtacttttttttttttaaccagataacaactattccacaccaaatgagagaggagaccacaatagaacactggatcgatcgggggatctaggcgacatggagccattgaagggaacaacacccttgatggtaaattctctttatatactgctatctgtctaaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacacactcatgaggttcctgtctctactcatactaacaaattgcatgtgttcacagcaggacgaggggcaggaatctctggaggaagagttggatgtgttggttttggatgatgaggggggccaagtgtcttacccctccatggtatgtccttcagtcacccccaagattgttcttgaggaaggaggctcctgagtgccagcaacttgtcaatcacgctaatctgatcaggccagagactaagtagtctcagccacatggggctcgaggggttctgcttttgtgattattacctcttacgagtctgggacatgcagctggtgatctgattctccgttatgtgctgctttcctttctccagatttgctcaacttttttggggggggtctccttaatcccaaccccattaacattctctctttctcttttttctccacagcagaagatttagcaccactatctccgttccatctgggcttatatgtacttttattttttggtggtgaaattgactgatgattttcctttttcttcgctggactattgtgccaactgccaggctgcctcctgcccttacagccctaagtggctgccttctttccatcaactcccaacttcttcctgtgaagtttaattgtctcaacgcctccccctcccccattccctccatttttctcccaagaaacctgactcaattatttgcatattttgagaaactgctgcagattagttctttttgccagttttccctggaactcctggccttttgtggaggggagggatggagagaataggaatcttcactagaagccgtgggaagaattggaagttacatgctgtatatgcaatgtccagcagtctgataaactgacgattcttaatcaagatttttttcctgatggggaagggacttttattttcttttagagaggggaaagtgtgagctcttcccttattcctaatggctatttttgaagcaaagaaggccagcaacattggcacatgccacctggcaaaggacccttgagtaagtgaaggtctcctaaaactgggattaagaaaccttgctctcctcatctccaaggcagggaccatcaagaacctacagactccatctcttctgcaagcctcatgccaaccctgggctattgctgctgccccttaaacacaggctgtccttaacccacctctcctgccctgtgatatgtctgctgagttggcctggccatttccaagaggctgtagaaaggggagaatgtcaaggaagacttttggtagagaaggagcagaaagatgtgtttttgggaagaagaagacctctaggaggagctagtaggaatgtacatgaagcaattagtctgaaactggcttccccactcccccgtttctccttttcctatccttataggcctgtcccttgcctctgccctggattggttggcaaactaaaggacttgatgtacataactcctgtcccttttcccttacaaggtggggattgcccctggctttgcctcttctttgtgcctttggcctggggtgcatctcctcccgcccttccatgtgcctttctttgcctctgcagtctcatttctcataattttgcaaattatattttgttgctttcttacctactattggccctaaatagcagaaagaagagaagtgaccgagagaacctcagattcttcattgaggattggtatagccatgatttcagtcatagcaagcttttgctcaacagcatatgggtgggattttgcaaaaatcctattctgatgaatctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcataaagaattaatgacttactttaattactggaattcttctgcaacatttgacaaaactaaccttgaataaggcccactgtaatacgtagctctcttaaatataacacttaggactagaagattagaaactaccaatcccaactacgtaataggaaaatgtaggatcaaaaggcccatgtatataagtactgaccactgggccataatgttgcttctcaggctatatgcagtcctttagtcagaagtcaataggcctatttattaatattttacagaccatattacctggattaccagggactatctttgctgcagagatcaagggttaagatctatgggaagatacttatttttctgaggtccttatgtcctgtcatataattaaagactcaagagaatttatgtgaaatgctttctgtatgcccaaatctttagattaaaattatatagctgctcctgatgatggtcctgtcttgttttattgaactaggacttgggtatgaaaactttcatgggctagtgagaccaggaaatcaactagcttttaaagcttgatttgtgtctaacaattgtagtgttagattagaggttgaagtacaaagccaaaaagctattaagagtttactttccaaagagttttgatagccctgcttgagatgatttttatctaaatagaaaagcctggctgcttgtcagcaacactttatttccctgttatgttcttatcctttggcattgagctagatacaaaccctactcttctctcttccttctggattggtccatttgtttatctcattcaataaatatttgccaagcacctcctatatgctaagcgttgtgtcaaggttaggtttagattagagagtgaaacagatggatcttttctcatagattgcaatccatgagaatcctctatagctaagatctatgatcagacgagatcgtgtgcgttcagggtgatatggccatagacaagatctatgatcttaaaaacacttctctctgtgccatatctaaatacaatgagatgttacacagaatgatgtgtaaaggccctatctcacaagtttcttgacactgatgtactttgtgacagaggtcaaagctgggacctcacttggccacttttttttttttagacagagtcttgctctgtcactcaggggcacaatctcggctcactgcaacctcagcctcctgggttcaagcgattcttctgcctcagcctcccgagtagctgggattacaggtgtgtaccaccacgcctggctaattttgtatttttagtagagacaggatttcaccatgttggccaggctggtctcaaactcctgacctcaagtgatccacccttcttggcctcccaaagtgctggcattacaggtgtgaggcactgcgcatggccggccacttgtttttcttgctgaactaattttctttgctacaaactggaatcacctcacccaggaagaactaagaaccagtctttccatatcatttttttctcattttgtctatttttatatctgaagcaaaggttcttaatattttcatagatggaattgactagacctagccctgtatatctgagcaagttacataagaattccctgtatgcttgttgaaaatgcagagtcccatgttccatttccaaaaatcgattcagtaggtgggactgaggaatctaaaatcatggtaagtcatccaggttatcctctttttttttgtttttgtttttgtttttttttttgagacggaatttcactcttgtcacccgggctggagtgcaatgccacgatctcagctcagtgcaacctctgcctcccggattaaagcgattctcctgcctcagcctcttgatgagctgggactacaggcacccgccaccacatccagctaatacttgtatttttagtagagacggggtttcaccatgttggccaggctggtcttgaactcctgacctcaggtgatccatccacctaggcctcccaaagtgctgggattacaggcataagccaccatgcctggcccatccaggttattctgatgtatgtggtcagttaactgtgacttaagggactgatctagtgacttgcttaaggttatagcctcaaagtggaacccaggattactggcttcaactccactggcagtaatactagcatggtgaatgtagacaatatgatgtggtgatcaccattttaagagagcattcatagaggaaactttatctcaaaggaatgcattgctttcaatagagtttgagataatggtaagtgataggttggtgtgtggtatctgggtaggagaagcttctcatcctgaaaatcatatgtaggtaatgctcaggttgctgaggcaggaagctagcccttaatttggggtcctgtaggtcacagagaatcccctggaattgccgactttgacttaagtgtcacttctagctacaaag

SEQ ID NO: 16459 - DNA, 38084 bp, Human
  misc_feature (1)...(38084): n = A,T,C or G
aaaagtttgataacactttgagaattgtggagaaataggcactctcatacaggctggtgggagtgtacatttggacagcttttatggagaatgatttgcaatatctgtgaaatgttacacatatgtatactctttgactcagcaattctgtttctagaaatgtttcctacatatttacctgcattgtataaatttccacattcattcactatagctgtatctgtaataggaaaagttggaaccatcctaatgtgcaatgtaggggtggaaaaggtgtgatacttttctttacccatcttaagggtcacagctgacactaccataacaaaaaacaggttagcaagataaatggataacttattgaatcacagttttatgggatgtaagtgccttcagaaatgaagacccaaagacccagggaaagctgtccatttttatgcttagatgagatgaagaatggacagctgtgtagaaatgtgattgtacaaaaggagtatgatctaatagtaacagactgaaggaggaatccagcaagtcctgtctgttcagattcttcttggcctctctgtgcagctttccttcttcctgagtgtagggcaagacccttttggaacgagggtcttatgacaaggtacatcaaagaatgtctttatggccagctcttacacaaaaaggtgggggaaggctagattaatatttctaggtttttctagaataatgtttctggcttgcttgggagaaaaggggttctagtttccatgacccgccttggggaacagaaattctggtttctattatttgctttaggagacacagaggggtgggagacaagagggcaggagaaagtcagagacagactttgcttttaaggcttctctgaggcactttcagtcttctttagttcaaagcactcagtgtgccaaagagccatactctggggtgtcgtttcctgagcaccaacaatattggccaaggacattgtgactatccttaccagtgctgtggtcctttaggaagttgagaaggggctagagttccatgagagcccaggtgtagatgtgtatttggtagtcatcggcttagggtcaaagacagaagtgatatagaatcagttcatctaaggcaagagtaggttcaaaaggttgccccttaagggtaaggaccaaattttattcatctccgtaaggccaggatcaaacacaatcaagatttgataaaacaggccgggcgcagtggctcacgcctgtaatcccagcactttgggaggccaaggtaggcagatcaccttaagtcaggagttctagaccaccctggccaatatggtgaaacctcatctctactaaaaatacaaaaattagctgggcgtggtggtgcgcacctgtaatcccagctactcgggaggctgaggcaagagaattgcttgaacctaggaggtggaggttgcagtgagctgaagactgcagtccaggctgggcgacagagcaactccacctcaaaaaataaaaaaggaaaaaaaaaagatttgataaaataatgtacatataggacagagctggagggaaacccaggaaaggtgaatcagagagagaaaagacgccaagataatgtggtgacttgggagccagagagacggagcctgagacttggagcagggcacagcacaggaatacaacacttttcaccagaacgacattccgacctctgaatcaaccctggaaaggcccttccattgaacttcttgtgatggaggaaaagaaaccctcagtttcgtcatcgcaaggcggaagagtttaaataccatacctcaagatctccctccagccctgacacgcgactccgcggccctttcagcgtcggtcgcctaggagacaagcgccacttccggcagcgaagtcacttccgcggaggtcctgcctctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgtgagtacgaggccgccgagcagggagagagggcggacgggggccgaggcctcggggctgggggcaggcgtctccactcaggccgcggccgtacgcgggcagcgcggacagcatcccgcccggtgctgctgcggccgcgaccccaaagtgggaacctccacgtgtggccgctccgcgggagcctgggcgcggagacccctgccgcgtcgccccccgccgccccgcctgggcctccaaggggccaggaagggtcggcccggagccggggttgttttacgccgcacccggttcccgggggcggggcagtcctcctcggggtcccgggacagcctttcccttctccctcgctggctgccgccgcctccagagtgcagttggccaacttagtgcgggtcggaggtggtctcgtgtgtggagcagagcgagtgtgctgggcattggttagatgggctccgtttctggagagccctggcaccggtgatcgccgctagcttttttttcagccgagcaccctgtccttgaggccgagcccatccgcttacacaggccagttacttctgctgtattttgtggccgcagagaacctccgcccacattcctaagctaatattttcggcgcagcatcattcctgggtaaagaaatatttgtcgtgcaaaggagaggattggctttattaccatttagggagtcgtttgcaaaagacaacttgtttattaagaggccgaagtcaaaatctttagatgaaaaaaattatatataagaaatatacgttgagtttaacttaagcccaccacaaagtattttgcactgaataacacgaatttgcttgtgtttcatctgagaatatgtttggaaaaatatttttaaactacagtcgaagccaataatcttacttaattttaatgtgttaaatgtatatctagcctatagataaatgtgaagggaaaaagatgagatgctagagaaatggtgaaatcaatcaaaataactttttgattgcccctacttaagaaaccaagaaattggcagtttgggaccagattttgtttggagacaaagagtaatgttttgagcattcaatgactggttgttccttgaaagtacaggcgtaacccttgacgaaagaatggtttcctccatgtgcatttttatagtgtattgaagttaatcgcttgtcagtctgtaaagtgtgggcagttataatttgtagtgcctctgttaaattgttgctcaagaaaatatgcaagccattttaagtatagaactaatcagagaataagtaggtagctttggtaccaaaaatgtattctaaagcaaattttaattacttttggattacgcatgccacaaacactctgctactatgattattaatgttatttgggatgcagtgttttgcaactgctaagggataatttacagataacctagaaagattgtataagttttaggtgaggcttttgtattcgtgttgaactgaaaaaaaagttattattattttttaatctatgaccaggagagctaagacaccccggaaacctaccgtgaaaaaagggtcccaaacgaaccttaaagacccagttggggtaaggtatccctgtaaatttatgtgtggtgtttaagaaacttatctcttcagtcctttctgtcttatgtgtatgcttggaagggaaagaagaagacatgtggaagtataatcaaagaacatttagttaaatggatgtactacattgtgtaaaactagtgctagctgtgaaattttctctataagattaattaaattagtccagtaaaatgaagtctttggttgtcaactgcataccttctgtaattataatttggagagttagataattaaaaatctccaactgggttcatattcatcccagagaatatgaactgagttcatgccatacagtaactgatggcatgaggagagttccaaacttcttgggaccaagtttaattcagttaaattatgaagaaaaaatgaagcaggcaaaaagaataagaattttaaaacaaaacaacaaatggcaaacaaaaagggttctttgctctgaggtattttaaatctatccctcgttgccactggagtgggtccctggctctgagttaagggaaccgggtgctttgcacacagctgaatgagttttcctcaagccccctcccctgctttcaaaaatgtctctgtaggccgggtgcggtggctcacatctgtaatcccagcactttgggaggctgaggcgggtggatcacctgaggtcaggagttcgagaccagcctggccaacatggcgaaaccctgtctctactaaaattacaaaaattagctgggtgtggtggtgggtgcctgtaatcccagctactcgggaggctgaggcaggagaattgcttgaacccaggaggttgcagtgagctgagatcatgccattgcactccagcctgggtgacaagagagaaactctgtctctaaataaataaataaataaataaaaatgtctttgtatattaaatgttgggttaagctgacaagtttttaaattgacatccatttccaagaaattctaacagttttaaaaatctcgtgtgacatgttgttgacttttagagatattagtagtagtataactattatttgtgtacaatataatagtgaatacactgcaatttgatttttattaaaatttattttaattttgtgtgtatttaaagtattctcatatctaatacatacttgtatttgtcaatctcaagtagcagattttaattttcttagcccttggagatacagagctcttaaattgagagactgaatgtttgttgaatgaatgaatgaatgagaagcttaagtgaaaaatcaggcaaaaggtcaaactttcttcttaaagcaccttcctatttcttcaggtatactgtagggtgcgcccactgggctttcctgatcaagagtgttgcatagaagtgatcaataatacaactgttcagcttcatactcctgagggctacagactcaaccgaaatggagactataaggaggtaattctgatttggaccaagttgtttttactcaatatgttgtttcctgaatgacttctagatttttagatgtaacaaagttcatttgtgagcccacattttcaaaagacttatttacttcattataaccactgtatctaaagtgtttttgacttctgggatgcacagacatacctttggtatgctggggttagaggattgcttttagcagataatttcttacactgagtattattgtttcttagagcatgtgttagggatgatttaatgtggaatgatacatgattgtgctaggcagttttatatatacaacttgatgtgtggaaatgaaaataacatttaataatagacattgtttacttgcatcaacctcctatgcagtgtttttatttttagtaaagttttgagtcagctcaaaaatattgtttagcaaatgtgctaagctaatagttggagggtggaaggagattaaaaaaaagagcatgacatactccttgcctttagaaagtttataacttaagatatatggtaaacaaataattctcatataaataagacagaaagttagatgtgctaaagatgaggggaccgtgggaatgcagtaggattaattcaggctaccatttctacttctagctgtcactcactcttttgtgcctactattcctgtgaaattgctcttcagaagactaccagtggcctctttgctgctaaatttgatgtatacctcttcatcctcattttaacctgtttgtcagcagcactctcctgtctccccctccagctctccttgtatctccagctgaaaccttttctctggctctcaacattcaaccacttacttgatatctctgcttggatgtcacatgtgcatctcaaattttacatgcccaaaaaggagttcttgatttttcttattccctctctaaatacttcctcccttgttttcttctcaaggaatggcactatcgtgtgtccagttgctcaagccagaaacctggtacctaccttttacttgcctctccttataactagttcattagtagctcctatcagttatattccaacatgtgtcttgaaactgtcctttcatttccatctccactgccaccaccctagtctgagccccattattaatcactgagaccagagctactgtaatgaaggagtagcttttttatttttaatgcgtcacagctgagacttttgtacaacttgtgctagatggaactgcccgtgtgagttagacaatagggaactagttcataatctcttcatagagatgagcctattgaatacatgctgaaatactgataattgagcagtgccagatggaggctcatgcctgcagtctcagcactttgggaggccaaggtgggtggatcacctgaggtcaggagttcaagaccagcctgaccaatatgatgaaaccctgtctctactaaaaatacaaaaattagccgggcatgatgacgtgtgcctgtaatcccagctactcagtagcctgagacaggagaatcacttgaacccaggaggcggaggttgcagtgagccgagatcgcgccattgcactccagcttgggcaacaagagtgaaactccatctcaaaaaacaaacaaacaaagaaacaaacaaacaaaaaacaactttctaaacatttaagtagtctggtaaccaatctcagactggcattggtttgctgagtgtgctttgggtatcattgacaagacttccaaagcccaactgcctccacttggaatcttctctaatccatttctacagagcagacagtgatcttttaaaacataaaatctcattttcctgttcaaaacctttcaaagaataaaatctttgaacagacaaaatcctgcttcatccgtctcccatctgtctctccaccttcattcatcttttagtattcatccaatcctttgagtttcttggataaggcagaatcctggctgttagctgttgccttaacctggacttctctttttctgggtcttagcatgggtcatcgttgggtttcagcttaaatatcacctcctcgggttgtatagactacccaatcagaaacagcaccccacaacccctctcccctggtctgtactctgtatgcctcctttacattacttaaccacaatctatttgtttacttgtttattgtctttcctctaccataatgtaaacttccagggaatatgtaccttatatgttctgttcatcaaatagtaaatatggcttcagcaagaatgaatggtctgggagggttttttggaggagcaggtctttaaggatataatatagttaaacactgatttactgagttttacttctttaagtaaatttcaagtatgtataaatataggtatcgagtaggtatcgagtaggtataaaaaggtttgatggggattaaaaatagtcactgctttctgacagaaggcaacattgtataatgaaaagagcattgctgccgggcatgatggtttacatgtgtaatcccagcactttgggaggccgaggcagagggattacttgagatcaggagttcgagactagcttggccaacatggcgaaaccccatcactactaaaaatacaaaaattacccagcgtggaggcatgcgcctgtaatcacagctactcgggaggctgaggcaggagtattgcttgaacccaggaggcagaggttgcagtgagccgagatcctaccactgcactccagcctgggtgacagagtgagactctgtttcaaaaaaaaaaagaagaaaacaaaaacattgcactgatgatggctttgatactaattaactccatgggctcagagaagtttcaccttcgggcctcagttttctttaccttgaaaggagggagtcattcatgaggactgtgaggtcatgtatcttctcagtattagcctatgtgtatcctttcagttccaagattctttgttctttttgaactctaaagctgatttttacaggatattttattaattgtatttagagagccttgataattgaagtattcttgctttcttaaaggtcacaatttatttaaaatgtatttcatgtaagaactcagagatgagataatatttacagtttacttctggttttaaactatagtacatcaaaacgtggtattatgctgctatgccattttattttatatgtcttttttctttttcttttttgagacagggtctcacttgttgcccaggctggtgtgcaatggtgtgaccacagctcactgttttttggtgaggtttttttgttgtttttacttttaaaattttttattagatgagcttgcccaggctggtctcttaactcatggcctcaagtgatcctcctgcctcagccttccaaagtgggattataagtgtgagccactatgcccatgctttgctattttaaatgacacctttataaagaaaaactaggaaacagtaaagttgtgtatgacataatgcttgtagatttccacaaatctgtgactatgaatcgttacaataccttttgatctctgtcacttaattaaaacaaaatcagccttagattagaagcattagtagacttaagacttttctacatttttggccaggtgtggtggctcacgcctgtaatcccagcactttggaaggctgaggtgggtggatcacctaagatcaggagtttgacaccagcctaacatggtgaaacccgtctctactaaaaatataaaaattagccgggtgtggtggcacgtgcctgtaattccagctacttgggaggctgaggcaggggaatcgcttgaacccaggaggcagaggttgcagtgagccgagattgtgtcattgcactccagcctgggcaacaagagcaaaactctgtctcaaaaaaaaagagttttctacattttctttagtagttgtgactgaaaacgtttaccagtttataattggtatgatataggtatgtcatgactttttagtaactaaataactaagggttccaactgtaaaaagaccatttatattttttctttgcatgcttagatcttaaatgtcataaacaccttaagtttaaggagatgtatttttagcctagataatagtggaattctatttagtgcatttttttctctctccacagactcagtattcatttaaacaagtatttggcactcacaccacccagaaggaactctttgatgttgtggctaatcccttggtcaatgacctcattcatggcaaaaatggtatgatatgactcttggagttttgttagattttcctttttctcctcttctgataaaacttttttgatatttatatatttgatttatgtttggtgttgaatccatatttaatttgttagggtggtgctaaacttgccttttttgagctggctaattgttagtgttttctaatgcagtgaagaaatactctaagtggagaacttctaagatataactcattgtgacttgctacactgtaggtcttctttttacatatggtgtgacgggaagtggaaaaactcacacaatgactggttctccaggggaaggagggctgcttcctcgttgtttggacatgatctttaacagtatagggtcatttcaagctaaacgatatgtaagtatgattcttttgtgttgtgactatcttactggactaagacacctatggatacagtagtagtaaagaagaaccaaagcactggattcattttgaaaccttaactgttccttagtttttaaacatatttcttactatttaagttaaattctaaaaaacgtggtgtgatttttttttttttgcccccacttcaggttttcaaatctaatgataggaatagtatggatatacagtgtgaggttgatgccttattagaacgtcagaaaagagaagctatgcccaatccaaagacttcttctagcaagtaagtaattatatttgtctgcagcactggcctaggggcacaggattctttcctgtggtttgcccagacatgaggaatggtgaacattaaatagagaagttgacttttgtgagattaaagttaaggaatgttcttaagttctttgctcagatgttttctctttggctttgagcacattttgtttcaatcactgttttaagagggtgccactctggatggggagagggtataaaagccattgttgtgtgttcgggaggacgtgggaatactgttggcaaaccatgagtatgaataaagctgctttgtgcatttctgcttgtaattgcagatatttattttatctgttagtttccccttgggatcagttacttttttttttttttgagacagagtctcactttgctgcccagggtggagtgcagtggcatgatctcggctcactgcaacctctgccttccaggttcaaacgatcctcctgcctcagccccgctagtagctgggattagaggcacacgccaccatgcccggctaatttgtatttttagtagagacggggtttcaccatgttggccaggctggtcttgagttcctgatctcaggtgatccgcctgcctcggcctcccaaagtgctgggattatagctgtgagccaccatgcccggctgggatcatttacttttaaaatggacttataacgtatacaattgaacttttttttttttagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtaagtaataaagagagccccttcttagctgttaatgttggggaagttactttgcctcaaggagttttagtttcttcagttatgaaagagaataatgcttgcatttgttttcagaatgaaatgatataatttgtatatcacgtggttttgtgtttgagtatgtttattattaactagatatgtacctgtattagggaactagtgggttaaagcatctaaggagaagagggacccaaatattcatcttggagattacttttgaaaactctgggccctgggctatgttttgagaaggatcttaattatataattaagaacgtttcaagaacctgagacagtaaaaggagttttgtaggctctttaaccacccgtgtcttggtgatttctacagactggagcctaaagctgttatctatacaagtaatacttacatatcttctatcattcattaatatggtatgatatctgcactgtaattccatcagagttgaaatactacttcctagatttccttgggtcttgcctttctgagacgtaagactggttaccacttggcatcacaaatgataaatctgcatttgtgccagagttgaccctgggatcttatgtttaatattagtatcttgttcctgagttgatggttttgtttttcagctaaaggcttgtctttaatgctgtctttattagggcctctcaggacataaataatacgaagacctgtggcttatatttaactttgtatatctaagggaacattattggagaaacagctggatttagaaaatcattagactgagaatacataccagtatatccacttttaattacatgaagaatttatggactctggttgaggccatacttgatacaagcatttctgtggttcttagtgagtcacattttgatacagttatcttcaccagagtccttgaattttcatcacgtttattgggaaaacaattacaatatggctaagtaagctaaatgtaaaaatattaacactcttaatactaagagtttatgccaaggaagactctttggctctgtttaacatttcttcaagtgagaactttacaaagggacttatttctggagtgacctatctatatttacccttggaatgttggtaatagtaaaaatacttgggttaggttgtggagcaatacatggaagagttaaaaccttgtgagacagttactttttatttatttttgagacagggtcttgctctgccatgtcagctcactgcagccaacctcctgggttcaggtgatcctcccgccttagcctcctaagtagctggaactacaagcacaagccaccatgcctggctaattttctaatttcttgtagagataggagtgataagggtctcactaggttgcccaggttggtctcgaactcctggcctcaagcagtcctcccaccttggtctcccaaagtgctgggattacaagtgtgagccacgatgcctggcctgaccatcactttttatatcaaactaattactttcccatttgttttaaagtgtcaactgtcttgactctaatcttgagtatacccattttcatgtatgctcgtgtgccaactttttgtttggtttgttctaaatgagattattttcaaaggatcatatcttggctttatttagttatacaaaagaagattgacaaaagtaccttgtgtgctttgtaacctttctgggtaactccttaaatgaacatacaagggtgcttgtttggccctgaattcagatttaatttgttaggttggtgttagacctgcttttttaagctagttaacttttagtacttttaatacaatgaaaaactattacaagtggagggtttttaagatatgactcattgtgattgtcacatagtctggactgaacatgttggtgtgagatggctgctgtagaaacagtaacttctaccttattcctttggtaggtggaacagttgcagcacacccatgaggaacacagattttgtgtatgtgatggtgttggctcttttcttaaggagaagggtgcagttatactatggttggcattctgtggcatgtttgcatgtaggttattttccattgtcactgggctggctgctgtctctaagccctccttgcttcctgaaaaatctgctattgactatcagtgatggtggctggtaaatgtctctaccctcaccattcacaagacttaagaccaaacaggtagctctcatacccaaccttcatcttgtcatacagactaaaacttcataagccactttgaaaggattgccactcctggtatataccaaactctttctgaatttgttttctgctgttgctgaggaggtcagaactggttctatctgctagtcttttcaaattaggaaaatactagattttgatgcttaacctgtgcatgtgatgttgctgtaatactactttggtctctaaattgtttagtgtattgtttcatgtgctttcttagagcaaattagagcaaagcttttaaaacaaaattggtttctgttatcttgttacttaactaatcttgactatttagctttacaatcttatctaagtttaatatttctctggagtattatacgttatatatatattataaaatatatataattttcattagaagaataacatgtcatgtcacttggcgttttagtcctagtcttaaatgaagataccagcatctcataatttaggagactaatcttttttttctttcccatagacctccacaatctaaattgcttcgtgaagataagaaccataacatgtatgttgcaggatgtacagaagttgaagtgaaatctactgaggaggcttttgaagttttctggagaggttagaaacacctagaactagaaaaatacagaatgatgaatatcacctagagttgctactaagtttgatggcaattttttttgacttattagaaagcatgtataatgaaatgactgagttcaggtttgaccaatgatttctctgttgtcctaggccagaaaaagagacgtattgctaatacccatttgaatcgtgagtccagccgttcccatagcgtgttcaacattaaattagttcaggctcccttggatgcagatggagacaatgtcttacaggtaaagttgtagtatgtggagtttttctggttctaactctatccttaatttttggaattagagtaatccagccaacatggcaaaaacctgtctcgagtaaaattggaaaaatcagccaggcatggtgatgcaccactcctgtaatcccagctacttgtgtacctgaggcaggaggatcgcttgaacctgggaggcagaggtacagtgaactgagatcgcgccactgtagtccagcctgggtgacagagtgagaccctgtcttgaaaaaaaaagttaaattagagaggttttattgcaatgaagattgctctagaataaatatacagttggttctctgtatctgtgagttctacatctatagattcaaccaactgtggattgaaaatattcgaaaataaaatgctgcatttgtgctgaccatgtacagactttttttggtcattattccttaaacaatacagtataacaacttgttacatagtgtttacattgtattagatattataagtactctaaatatgatttaaaatatacaggagggctgggtgcgtgcgtggctcatgcctgtaatcccagtgctttgggaggccaaggcaggaggatcacttgaggccaggagtttgagaccagcctggacaacaaaacaagactcttgtctttgcaaaaaaataaaataaggctaaaaaataaaaaaataaaaaaatagaactttaaaaagtgtatgggaggatgtgcataggtcatatgaaaatactacaccattttatacacaagatttgagcatccatggaatttggtatctgtgaaatttagtatccataggagatcctacaactaatccctcgaggacaccaagggatgactctgtatgtaggcgatgacattaaaacttttttttccccattattatagttttgggaagctggatatcgaatcttagagcctgaattttgctgtgaaaaaagtttgcaaatctttaaaaatccctttggtagaagtgataaaataagactgtgattttttctctctggcgactccttctgtaagtggaaattcagttagtggttttaaaatgtcagtaattcatttttcagggtaggtatagtttaggaagtggctagtgttataagttgttcatctcttggtcgataggccagtagggtcccccatatgcagatcactatttactgcctggcctgccacagtacaaggcttgtgtcaattagtaacagcatttgagtctgagtatacataatctaataactgtaatccattaaagtgtaattttattcaaactgtatcatgaaattgtggcattatgaagatttataagtggcaggagtggtattgaagacctccaggatttgaatgctcatttctatttatttaccgactagctataataaaacctccttataaggttgtgagaattaaaggaggtaatgcgtgtaaagttcttaatccagtgcttagcttatagtcagccctcaataaccgttagctagaaaatagttataagggccaggcgcagtgactcacgcctgtaatcccagcactttgggaggccaagacgggtggatcatgaggtcgggagattgagaccatcctggccaacatggcgaaaccccgtctctactaaaaatacaaaaattagcagggcatagtggcgcatgcctgtagtcccagctacttgggactgaggcaggagaattgtttgaaccaggaaggtggaggttgtagtgagccaagatcgcgccactgcactccagcctggcgacagagtgagactctgtctaaaaaaaaaaaatggttataagtcagccttccatatgcacctgatttccattgaatcacatctaatattacagcattagttcggtaccacttgactttcacttctttttataagaattatttgctgggcgtggtggctcacccctgtaatcccaagcactttgggaggctgaggcgggcggatcaactgaggtcaggagttcgagaccagcctggtccacatggtgaaaccctgtctctaccaaaaatacaaaaaaaatgagctgggcatggtggcacacgcctgtaatcccagttactcggaaggctgaggcaagagaaccgcttgaacccaggagggggaggttgtagtgagcagagatggcgccactgcaatccagccgggaggtagagcgagactctgtctcccaaaaaaaaaaaaaaaaaaaaaaccaaaagaattatttatagcattatgaaattataagattattaaatatctgattatagaagaatttaggataatcctgttctagactcttattcagcaaatatctgctgagttcctactcagtggtaggcactgtgcagcatgctggtgataaggtagtaaaagacagagtccctgctctcagggggcttactgtctgatgcagaaggaagaccagccaattgacaagtaatcattaatgtcatgagtatatttatcatactcttctagcaaactctcccctaaaataggtatcctttgcctgtcctgtgcattttgtactgtgcaaatgttcattaagacttagcttgttgatatgaatctatttaaagaacattataaaccagttataacccattttaagttattggctttgtgatctttttaggaaaaagaacaaatcactataagtcagttgtccttggtagatcttgctggaagtgaaagaactaaccggaccagagcagaagggaacagattacgtgaagctggtgagtaaagcatggtatttatttattgctacaactttcagaaacttgcaatgccagtttattatctacttatcaatgggtggttctttgttttttaatttttattttattgagacggtcttactctgttacccaggatggaatgcagtggtgtgatcatggctcattgcagcctcaaactcctgggctcaattgattctcccattgtaaccttctgagtagatgggactacaggtatgcaccaccatgcctgtctaatttttaaaaattttttgtagaggtggggtctccttatgttgcccaggctggtctcaaattcctgggctctagtaatctctcaccttggccgccccaaagtcttgggattacaggaatgagccactgtaaccggcctcgatgggtggtttaagcacaattgtcctccattagataatttagaggctaagtttatagttaggctggtttggtattaatctattacaatacactgatttctttaagaatgaggaaagttgtattcaattagtctgggtgcggtggctcacacctgtaatcctggcaatttgggaggccaaggcatgtggatcacttgagcccaggagttcaagaccagccttggcaacatgatgaaaccccatctctacaaaaaatacaaaaaattagctgggcgtggtgcgtctatagttccaaggtacttggaggctgaggtgggagaattgcttgagccctggaggtcaagactgcagcaatccctgatctcaccactgtactccagcctgggcaacagagaacctgtctcaaaaacaacaacaacaacaacaaaaaaggactctatttttagtgttgtaggtcagaattgggtccttgaaatgttatttcaatacttattagtggtaaaaattggcttctagagatgggaaaattctgaacacaagccaattgaaggctttaaatatatatatagccaatctgtatatgtgttttttaaaattcatgcatgttatgtcctgttacctttttgtagttttttaaaaattaatatatcatagttgtacatactttttgggtatatgttatattttgatagatgtatgcagtgtgatcaatcagtgtaattgggttttctgtcaccttgcatgttgtgttttatgttaataaacatgtattgagtacctactatgtgccaggaattaaacacaaattaattcccattaattctctctgctggagcgagcccatcctaatagaggagatcagtagataaactagattgtttgagtagagtatgatgggagtgcagggtagggctgcctaaaccaatctgggagtgggaaggtgaaaaattgagtaggagtgagctgtatgaagcaggataggattaaaggcaacgttcctgtcccaggaggcagttgcttggtcctgagatactatggcagagtcaaagtagctgaagtagaggatgtaagttggtgaactatgagaactgaggcaggagagcaaggcaaggtcatgaagacccctgtctgtcatatcaagaagtttgaattttatcttgaaggaataatgttagctgccaactattaagggtctagtgtgtatgatagtatccacacactagataggtaggattgtatcacacccatttttcagatgaggaaataggtttgggaaggttaattttctcaaggctggagccaggttggttggactctcatagcttgtgtctttatactatgtcatacagcctccccttaaagaaggattagtcttttagaaagatcattttgccagtgtagagaaataatttaccaggagcgagcctaaatacatgaaagagcagttaggagccttttgccccaattcaggtaagcaattgtgtgacctggaggcaaaggtcagacaacactgagagctagttaggatgtggagaataaggaggtgtttgattgaggagaagcagttttaggagcaggtataggcaggtaatgagttgtatttgaaatgttcaatttatgcaagtgaaagtgccttgtaattggatgcagaggtacatggatttggaaggagagagattttgacttgaggtttataggtttaggctttgccaatagagaaatgattggctggatgcagtggctcacgcctgtaatcccagcactttgggaggccaaggcaggcggatcacgaggtcaggggatcgagaccatcctggctaacagggtgaaaccccatctctactaaaaatacaaaaaaattagctgggcgtggtggtgggcgcctgtagtcccagctactcgggagcctgaggcaggagaatggcgtgaacccgtgaagcagagcttgcagtgagccgagatcgcgccattgcactccagcctgggcgacagagcgagactccgtctcaaaaaaaaaaaaagaaatgattgaagcaattgggtgagataagataattcatagcgaatggagaggaacaagctgagagcagaagcttgaggaacagcaagcccttgattattagcttgggatggacagagaagggtgatagctaaaagggatttgagggattatgaaatgatgaaaaaatacacacacacattatatatgtacattagaagatagtaaagacttgagtttattcatatgctgaagagatgatgtttaagtccagtggtgagaaatggggcctttagagctgcctctaccctggcccaaaggactcttgcaatttgtctgaatcatttgaatttcatgagagtggactgtgtgtgtgctgtctgtcaatgtctacccagtgcagcttacctactaggtgttcataataaagtggtgattattggcggagcaagatcctggaagaggcaggaaaatctgaatctagatccaagaggaaggattaactttgatgggacaagagctggtttgggaagaaagtaaaaacttgaagttttggatgctttggggaaaagctagaaaggactgttagtgttaatatagagttagggagtgagagtagaaaaggagattgtagttggggcatatggcagaggctccaggtttttagaagtggtacacttctgagggatagggtttgggctgtcagctgtaatggaatagagataaagatttactggagctgggacattgggaccctgtgactacagcatatgagaatgattgttgttctcatggacaccgaaataaaccagggactggcatgtaggaggaatatttcaaggcaataaggaggaactaggaaaatgttgctagcctctccctctgtttaccatacttgtagaatgtcagcctttagaaaacaagtagcttttttttttttactccaaaaggctacagggctgcagcaagagataaatggttaggttgcagggctgtgtgccatggatgtagggtgaagcctatggacccttcctggtatagtatttctgaaggtataacacagagaggattacagaggaaaccaattgcattgaaatgtgttttaaaagtattcttaagtttgtcatacagtaattatgtgcttctttattaataccttaaagacacagcagcaggtctgattaaataaatgcagtgtaatgatgaacataaatatcttgatgagcaacaaactgtaacatgctataaaaatatctgtgatttgtattgataccaattacaggtactactaatgctgtggtttttggcctgcattcataattgaaggaactagtgaattccagttggtttggtaaaaagtaaataatgtaatttattttccatctaagtatgcagacaccccatcatgttcccccggacaatatagacctcaggttaagaacccctgaccactagggaaagctatcaatggattattttgtgagagatttgaagatgcagggaaatctgttaataacatgagttcctgagagcacagtggaagaagaaagaacattaggagtttgggtcaaggaacgtaaatcatgaatcatggaatattacagaggtacagatgagttctgtattttgggaggtgtatccaagatcctccaaggaggccaagggtgaaagcataatcgagttagctgacctcaatcaaggtttcaaaatgaactcattcttatggggtctaatcagatgagagctgcattcttgaaagcttgattagactgttagacttgccttggctcagaaatccaaataagagtggtcagaagtaacaagtatgccacctaagaaatccttgctgagatgtagaggggacagagttagctgattctgaagacacttgactgttagaaacaacaggagagcccctctagatgcagcaagagcttcagactcttgcatgcttcttatgagaatctaatgcctgattatctgagctggaatgatttcatcccaaaccacacccctcaagcctcaacccatctgtgtaaaaattgtcttccatgaaactggtccctgatgccagaaagtttggggatctgctgccttagagaatatattttatttatttattttttattttattttattatttttattttttagccacataaaaggtagcagcacacttatttggaaaacaataatttcaaaatcatctcctgaactcagaatcgatgggtcagggtagacaccctaagtaaacaggtgaaatcttcattaattgttcacttattaagtaaaaatttaaattaattgattatgtacagcagtgtttttccacatttccctgataagaatcatttggagtactctgtaaacacagcttcactggagattaatcccatcaaattgatttagtggctctgggatgggccacagtagtttggaaatttttatttttacaaatgcttcctgatgatgaccaaatccaaggaaatttgggaaacactgatctggaacataactttcagttttccctgcagtttttaagtcttgaacgactgatcatcctagagataacccactgaaaagtcttgtccaatccagttttatgaaagaaaactctagaacatttggtttgataaaatttttccgaagcaccagaagtactttactttggctttttaaatttctggtccatcccttctagttcatgttttcttgaagaatccatcttctttgagttgagccacagcaatctaatcttttttttaaataattggtttcttattaaaggattgcgacatttaatagccgttgcttgcttttgtctttctcccttctccctgaaacttgttaagagatgactcaatattctggcctttccaccttcaatctcatactgaccacgccgtgtatgccagcctggatctcatagttttctttaactggttcaactccctttgttgtcctggtcaagataacatctccttcttccaaggtcatgatcttagaaacatagttgatgatgtaggggatggaaaaagtcatggaggatgtctcaccctcctgtcttgagttcgccgttgaccttgagccagagcctcagattgggaggatcagggatcttctccttgggcacgaacgcgctgactgggcaggaggccataaagctcttggccagagtccaaggcagccccttcttcttgcactcatcctgcacgtccctggcagtaatgtccaggcacagggcatagctgctcacgtagtccatagctgcgcggccatgcttgcccatcaccatgcccagctccagctcgtggtgcaggttgcagctgtacgcgggcatgaggatgggcgagccctcaggtgtgtaggccgtggacagcttcagaaacagcacggactcgctcaacaccgcgttggcatctccctggtgtggtccccatagttcctccccacacagacgatattcttcccccacccccagaagcgggacggtggcctgggggtcgccatgattcctgtcaattgcctagagaatatattttaatatgaggatattaaacatctctatataagatattccttcagagaatttaggatttggaagaaaccttatagtcattaactgtaatgttgcattttgtggaaaatcctgttggtagaatccctgaaggatggctgtttaaccttcccagaaatactgctattgaaagagagcctggaccatgcatagacagctctttatattgagccacaaaaatttgttatttataatttctatctagtagttgtttgaagttgagattttataggcaaacagaacacactttagctactatactgttgttctgaaatggcgtctatgtatttttttctgtcaggtaatattaatcagtcactaatgacgctaagaacatgtatggatgtcctaagagagaaccaaatgtatggaactaacaaggtaagcagcagccttctctgttcttttgtatagtttcatttgtgtgcattttttttgcgtaacacatttggatatgaatgtctttgtagatggttccatatcgagattcaaagttaacccatctgttcaagaactactttgatggggaaggaaaagtgcggatgatcgtgtgtgtgaaccccaaggctgaagattatgaagaaaacttggtaattttaatgtatttgtcctataaagtcttgagtttttgtcgggaaaacagttacttggatgagcagaatgacattttgaatattttaaaaatggatagagaaccattgattgtagaagtaaactaggcttggtgtggtggcttatgcttataatcccaacatgttgggaagctgaggtgggacgatcaattgggcccacctgggaggtcgaagctgcagtgagtcgtgttcatgccactgcactccagcctggtgacagactgtctcaaataaataaaaataagcaatctttgcttcatttagtaatttctgggacttggatatccttatttttttttaaactccatttgttttgtgttttagcaagtcatgagatttgcggaagtgactcaagaagttgaagtagcaagacctgtagacaaggcaatatgtggtttaacgcctgggaggagatacagaaaccagcctcgaggtccagttggaaatggtatgatttggtgttgtatcatttgtccactcattggtctgtctgtttctctcttttttaaaaaaaattatttcatttaagagaaatgtttacataccttctgaagaaccaagcacataataatttgaacaaaatttaaatgagcttattttgcatactatgattcttaggtaagtaaacttatgtcagctcaagaaattgcaatggttagttgcactggggctgtatgcagtgttaaacttgtttaaataagctctttctctcctatgtaactttttgtaattttctataattcaatacagaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatgtaagggcaaaactatttgaaataattttatttaattattttttttttttgagacatagtttcactctgtaccccagggtggagtgcagtggcacaatctcggttcactgcaacctccgcctcctgggttcaagcgattctcctgccttagtctcccgagtagctgggactacaggcacatgccaccacgcctggctaatttttgtactgttagtagagacggggtttcgccatgtaggccaggctggtctcaaactcctgacctcaagtgatccgcctgcctcggcctcctaaagtgctgggattacaggcatgagccaccactcccagccaatttgcaataattgtaacttctgaaattgaaagtattttcaatgaatctgagttatatggtagattgcatatttaaggaagttaaagaaaattgtgtctttagaactttgaagcactcaaggcattgtttgattagtatgacaaggcatttttccacagctcttttttgtattctaaggaagtcaaaaagaaaaaagtgagcgtgtgttctttcttttgttttttacagtgatggagacacaaagaaatattttttagtttcccctgtctacatagtggggattgtaattgtttctacctcaggatatgttgtgaagataaataagataaagtatgaaaatcctgtagaacagtaaattctggtacatagtgaatgtatctcagtgaatgaatgtatctacttttttttttttttttttttttgagactgagtctcgctctgttgcccaagttggagtgcaatggcgcaatctcggctcactgcaacctccgcctcctgggttcaagcgattttcctgcctcagcctcctgagtagctgggattataggtgcacaccaccacgccctgctaatttttgtatttttagtagagacggggtttcaccatgttggtcaggctggtctcaaactcctgacatcgtgatccacccaccttggcctcccaacatgctgggattacagacgtgagccaccatgcctggctctactatttttattatcattattcatttgaatctttaccaaaaagttgtgagataaagtggtatttaaatttccatactgaaatgaaatttgcccagaaatattaattaactcgcctaagtcataactagtaagtgatgttccaaggatttcagctcaggtttaattaatcccaaatagtagtgttgtttctatttttgcgtttgttgttgtgaagcaaagtacctgtaaggattgggaagagaatgctatagtgcacagtgaaagacttgagtattttttcagcatttaacagaaagcttctgtgaatatcttgtcaactggagaatgaagctcctgatttccctctaaacttgttttctcattatagactgattctcacagagatttgctgaataactacattttatctagtgtctgctagcaaaagttgatatcattgtttgttttagaactggtgtaaaacttgacctgtatgtttttgtttcagctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataaggtttgttttgacattattatgatagatgtatgtgctggtgttttagcactgttctctgagggagatattgtgctccaacggcctgtaaatgctgcttattaagagttctcggttgagtgcggtggctcatgcaggtaattccaacactttgggaggctgaggtggccagatcatctgaggtcaggagttcaagaacgagcctggccaacatggcaaaagcccatctctactaaaaaagtacaaaagttagctgggcgtggtggcgagtgcctgtaatcccagctactcaggaggctgaggcaggagaatcgcttgaactggggaggtggaggttgcagtgagccgagattgagccactgcactccagcctgggcgacaagagcaagactctgtctcaaaaaaaaaaagagttctcaggctgagtgcgggggctcatgcctgtagtctcagcacattgggaggccaaggcagggagatcacttgagcccaggagttccagaccagaccgggcaacgtggcgaaaccccatatctacaaaaaaaattagccaggcatggtggtacatgtctgtagtcccagctactcggaaggctgagatgggagaacagcttgagcctgggaggttgaggctgcagtgagctgggattgcacgactgcactccagcctaggtgacagagcgagagcctgtctcaaaaaaaaaaaaaaagttctcaattggttgtttactaatcctcatcccatgctaaggaggaaatgtgagtgaaatgaagaatcatatgttctttaattttatgagagttttaacagttgaaaaggatgttctctgacccaaacaagggagctttctagagcttagctttggttgtagcttgcttttgaatttattagaaatatttccttagtatgctttttttttttaatgagataaatgattaaatgaaatggtataaaagtgccagcatcgggccttggacgtaacagatactcagtaaagcttaattggatctgtatttggtttacaaatcgattgtaaaagtataaactcaggattaatctcttacaatggggtagaaggaaataccgttttgttgggaagcattgcagcactgtgtaatgtatgtctgttctctcatttacagagggtcatttagaggtttggtgggggtacacattcataagagaagttagtctcaaccaatatagtttttttaaattctgaaaatagcctaaaaactaaattttagcccttaattttaggagaaagtaattttcacatgaagttagttgtaaatgtctttgggtgaggagcttgtttaacatgttttcatttctgagaatgggggtgggaattcagatgaaatgttagagaaaaaagtgctttctccatgatgtttctttccacaaatatgcttgcataagcaaattaaggaagactattttatagcgacatgaaatgtttatataccaaatattgaacatagtggtctaccttcctagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgtgagtatcgtttgggtagtgcttgtctcagagtcggatgatttattttacattgtagttaggttcaatattttgaattattgtatttgcggtagggttttggtggtggttgttaactctcaggaagaattggagaactgtcatttttaggaaataaagagattgggtaatctggtgtactcgtttgctgtgatggaatgataatatacattgccactgataatctgtaggagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctgtaagttatttgtaattgtgtagtaactttgtactagagaaattttgttcagattagatgactatttctatgaggatttttacattttataatacttacatttctgaaatttctctaaaaatattttaaaatttagaataaacacaaatttagcacaaaaaaatagaacaaataattatttgtaatgttaagtcttcatgtgctaacattatagaaaagtaatgaattgtttctctcagtttttcagtcttgctcattaatttttctccaatttttctagctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcagggttagtgccagtattattttaacgcattgtagcaatagattttatcttctttgttttttgtaacttgtgtctgaaagttcattggaaaaatggttgggctatagtataaagaaggtctaatttctcagttaatttgaaagattgacttacggaaattgaggcctggctcctcatctgaaaaagcctaaacacatctggcagcggaagtgtgttcagtgaacacaggtcagtttggtgcatcccagagtagtctgagcttttcagctgcatacgctaataagctttgcacagaattggtgaatgtgtcttaaagcatactttccatatttttcttttggttccccttccccaaattagattttttatacctcctttcatgccctagttttaaaaattgttttcccaaatttttattttgaaaaatttcagacccaaagcaaagtagaaagaatagtatggtaatgtctttccctccttgcctaagtttaccaattgttacttgatatagatatgtaaacctttttcccctaagccttgtgaaaggaaatcacagacttagagacacttaatctctaagaataaggacattgtactacctagccacaatctttatcacatccaagaaaaatcaacattaattaattatcctctattgagacattgtgcagttgtcccaaaattggattggcttttctttttttttttttaaagacagagtctcactctgtcacccaggatggagtgcagtggcatgattatggctcactgcagcctcagtcttcctgagctgaagtgatcctctcacctcagcctcccaagtagctgagattacgggcaggccaccatgctaattttttattttcagtagagacaaggtctcaccatgttgcccaggctggtattgaactcttgaactccagcaatcctcctgccttggcctccaaaggtgctgagattacaggcaagccactgcaccagccagcttttttttcaatccatgatactatgaaagtgtatgcattgcatatcatgattatgtctttcatctcttttaatataaaatagtctcaccctgtccccctactttttttatttttatgacattgactattttcattgaagagtttaggccagttattttaaaattactgatttccatgcccaataaattgcttttaatcttgaggcatttatctcaatttacatttgcctcattcaagggtatttaaataaattcactttcatatttttcttcttaaagattaaggtaaagtttcttttgaatctgaataaatggaccaagttaatgtttgcgaattttatatttagtaaaatcttcacaaagctctcttagaatatttcttctaaatcttacagtaaacatttactttagattttcttatataagtcagggtatagatgaatgttcatttatgtggcctgaattcctgattattaagggatggtgatgaatcccaagttatttaccagggaaacagatgattctaaagtctcttaagttctttactttgcagatttttccttaaacatttttagacagcaaattaggtaaatggtcattctgaccaactctagtcagtcattttatgaaagtttataggctgaaaactattcaaggcttgcgtatgccttgcaaaccgtaatgagatatctaatttggctatgagatatttaagggaatttactagagattcttacgtgaaatcaaaatctctttagaagtgcagcagaaaagttactgtaaggttagtatctgtgcatctaagtttgttggtcaaaaattatgtcaggtggactgaatttatacttcagtgaggaaaaaatttaaatatttgtttcataaatgctagtagattgtatggattatcatctttctgaagcgtgtttcatcatatgcttattgttaaatgtttgaagaaaacctttgtttttgctaaatggtagatgataaggaccagactttctttcgtgttcaacattaaataaatcattgtaggaatggaaagttcctgtttgtcttgaggctcagcatctttagtggcaaactgtattgcccatgtcttagagctgtcactagtgctgcatttgtttcttgttaactatatagcgaaaatgattcagttcctcagatgtgcattttgaaattgaggtcttcatacttgactagctttgacagatttggcctgtgatagactttttccatttgctttcagttttgttttttgggttttttttttttttttttttttttttttttgagatgaggtcttgatctgttgcccaggctggagtgcagtggtgtcatctaggctcactgcagccttgaccttccaggctcaagtgatcgttctacctcagcctcctgagtagctgggaccacaggcatgtgctatcgcacctggctaatttttaaattttttgtaaagatggggtcttcttacattgcctaagctggtctcgggtgatccttctcccacctcagcctcacaaatgttgggataacaggtatgagccactgcacccagccctgctttcagttttacaaacaggagatgttcataaaattctaaagataattcattgcttcaaactataactatggcatatatgtgacatattattttcttaggctgaatgtgcttaatttagcattcccaggtttacatgacatttgactggaagcaacttgtttgtttttgaggcagggtctcattctattgcccaggctggagtgcagtggtgcgatcttggctcactgcaatttccacctcctgggctcaagcaatcctcccacctcaacctcctgagtagctgggactacaggcacgtgtcaccaagcccagctaatatatatatatatatttttgtttgttttgttttgtttttgttgagtctgggtttcaccatgttgcctaggctgaacttgaacttctgagttcaagtgattcctccacctcggccttccaaagtgctgattacaggcatgtaccaccatgcctggcctagcaactagtcttttattgtgtgatagagactgatttgacactgtattatttatttgtttcttggaacctgtatgaaatgtttgggggaaaaattagttggtatattgtagccattactgtatttgaacttttcatgaagttctattatgagattttaaaatcttaactgaaagcactcagaagtatttcacatttctttaatcattttattcatatggttcttattatacctatgttcttaggattgttttctgttttgtttagaagcctagaaaatgtgtagggctttcattgatcttattgaagattttaacagagttgtggacataatagattacctctcaatagcagggataaatattggtttttgatcaagaatatgaaatgagttgtttgtcctgaaccacccccaagcaggaaagacttgcagcattaccagaattttttcttttatcctttattgaaagggaaactcccagatagaatgtgtaacatacaagttggtgttaaagatgtttgttggttttgtgtttaaatgcaaagatcatgtttaaattacttgaataaaatatttagctttggaaaggtttgctatgatactgtcatcaactaatgtagccaaacctgctgcacttctaataatacccttaaattaattctgggttatgcttgtttctcagttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaaggtaaaaaactaattttcacaggagaaaaaaatatatttaaaaattcaacaaaagtccatttgtcctgctactcctttggtgacacacaggtagtgtcaactggaacatcagtaggtatttgatataacctttttgttagcagaaaattagtcactgcttaggttttaagtctgccaaactgggactaagtatgctttaaataggtatagattcttcggtttcttagaattctagatccatgatgtactttaattttttaatgactgtatatttagttttaaccactacttaaagtaatctaagcaaagaattcctattgctctccatcagttcaagataaaaaaacaaaaacaaaacaaaacgaaacctatgttaaaatttgacccgtcaaaattactcagtattgagctgcctaaagccgttttccagaaagagacttgcctgactatagaagaattcccctttgatcatagggtcagtgaataatcaggaaagtaaaagataagaccaaaaaaaaaaaaaagctttttatttcaatttcaatttagagtttttgttcttattataattagctacaaataagactatactgtcatttgaatatgggcaacagggggcactcagagaagaaagtaccatgccttagagcgtgtagaaacttccagcaaatttcttgatccttagtgcagtttagtttttaaattacagatggagcaaaaggaatatttttttctgcaattatgaatgttactgattacattgaattggacttcttttatttgtgagagatatgtactcaaatttctaaattattttgatagtacgtactcagcaagtaccaagtaccatctgattttgtggatgggaatttctataaaatagaatcatgagaacagtttgaaatatatatgtgtgtttttcgtttgggtgtatcaatgtgtaacagtgaccttttcttttggctttagggtgatatttataaaacaaggggtggtggacaatctgttcagtttactgatattgagactttaaagcaagaatcaccaaatgggtaagtaaccatcaaaaatctctgtataaaagttggtcattttcttagctgctcattttggaggaacagaatagcctgtgaaatgtatcattaattctccaaagggatgtagatagtattcccctacttctaatatttttcctcttcttagatggaaaaataattgttgcatcatgtttcccctttttcagtagtcgaaaacgaagatcttccacagtagcacctgcccaaccagatggtgcagagtctgaatggaccgatgtagaaacaagggtaggggaaaaattaaatatttgtctgcctactaaaattaggtttgtcatgttttaaaccccacagctctagatttttatgctctttgaaaatgctgaggtataatctcacattgccagtgcaccatgtaggcctattcctagaataacaagaatccacttcatcaggaactcccttgcaagtgttattcctgaggagaatctcttggaaagaacatgggaaggtaggggtcaggaggctaagctatggccttagccaccaactctctttgcaaacttatctaaaatgagataagttacctggatgacctaaagacctttctggctcacaacatttgtggcctgtgccagaaataaattacgagtgactggtgttttaacgtaagagtctttgctgaactagaaagcaatattgcatttcacctaggtgtggagcctgctaaataactgtgttttatagactattgagaggagctgatctttttcctcttgtcattttcctctcagtgttctgtggctgtggagatgagagcaggatcccagctgggacctggatatcagcatcacgcacaacccaagtgagtactgactgtaattggggtcttgctgtgtgcttttttcctcctctggtctttacattatcactccttctaccagccatccacttattcttcagaagaaatatatggttttggttttccccttggactatctgggcctccatgggcagactgcagtaggcagctggaatgctgagagcctcagaaggctggataagagcaatcagagctgcaaggcaggcggtggtggaagattggtggctcatgttcatattctgccaacgctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttcttcttctgttaaacttatactcaggagtctgacccagtctttttccatattttaataaaatcccttctttacaaatacatacatatatgtatatcacatgttacatacatatatgtatataaaatgttatatgtatataacattttaaacatttacataccttactgagcaatttagaaaattgttgcagcaggataaagatgggaaatcctttctaaatttaatactaagataagcatattttataaaagttgtttgctttctcagagggacttgaattatctcatcataaaacagcagttctcaaaggcctcctaaagattgatttgctatgaatgtgttactaattgcaaagttcaactctaagtgctggttgttatgttttaggcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaatacatagttgtgtgatggctgttcattcaacacgtcctcccagcacctggcacagtgccctgcatttacctggcactcattgtttgcgggatgaattaaaagaaagctctaaaaaatacaagataatatgatgttaaacggacaatgcctttttttatgtgacaaccataattatctacatattaagtatgacttctagacatttaaacaaaaagcatagtttggggacaacataaattagaaaaaatactgtcgaaaccatggtgaaatatcccattgcatgggtgaacacacattttacttggatttaatttggatttcttttgaggctgagcttttttttttttgagatgagtttcgctcttgttgcctaggctggagtgcaatggcacgattttggctcaccgcaaactctgtctcctgggttcaggcaattcttctgccttagcctccgagtagctgggattacaggcatgcgccactacgcccagctaattttgtatttttagtagagatggtttcttaatgttggtcagactggttttgaactcccaacctcagccacctgcctcggcctcccatagtgctgggattacaggtgtgagccactgtgcccggccactttttttttttttttaactaaaatgatagtttaatcttttgttattaataataaaagtgtgatatcagtccttgccaaaagccaactcaaaagttaagggagaagacaaaatgcactagtcactcacagtatagtagtaaacaatgtcatatatgtgtgtgtgtgtgtgtttttgaggggagggatggattttcactcttgcccaggcttgagtgcaatggcgcaatctcggctcaccgcaacctccgcctcctgggttcaagcgattctcctgcctcagcctccccagtagctgggattaaaagcatgagccaccaggcccagctaattttgtatttttagtagagacggggtttctccatgttggtcaggctggtcttgaactcctcaggtgatccgccctcctcagcttcccaaagtactgggattacaggcgtgagccactgcacctggcctatatgtgtgtttttagaatgcttcaggacactaaaggttaaattgctattgcagtagatacagaatttatttcttgattttcttcttaaagttttttttttagaaacagggtcttgctctgttgcccaggctgaaatgcagtggtgcaatcatggctcactataacctcaaactcctggattcatgtgatcctcctgcctcagcctcccaagaagctgggactacaggtgctcaccaccatgcccagctaattaaatttttaaaaatatttttgtagagctggtgtcttgctatgttgcctaggctggcttttttctttcttttttgagatggggtctcattctgtcacccaaaatggagtgcaatgacatgatcacagctcactgtagtctcaacctcccaggctcaagcaatcctctcacctcagcctcttgagtagctgcaactacaggcaaatgccagcacacctggctaattttttattttttgtagagatggggccttgctctgtggccttgtctggtctcaaactcctggcctcaagcaatcctcccgacttggcctcccaaagtgctagaattacaggcatgagccacagcacccagcctgctttttaaattattatttaaaataatagagacagcccgggcatggtggctcacaactgtaatcccagtactttgagaggctgaaacaggatggcttgaggtcaggagttcaagaccagcctgagcaacatggtgaaatcccatccctacaaaaagtttaaaaattagccaggtgtggtggcacgcacctgtagtcccacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16460 - DNA, 47683 bp, Human
gagtgcagtggcgcgatcttggctcactgcaacctccgcctcccgggttaaagcgattctcctgcctcagcctcctgaatagctgggactacaggtgtgtgccaccaagcccggctatttttgtagtagagacagggtttcaccatgttggccaggctggtctcaaactcctgacctcagctgatccgcctgccttggcctcccaaagtgctcggattgtaggcgtgagccactgtgcccggcctcttttaagtatttctaaaagctcctggatatcttttttccttccttttgaatggaaaagcttgcttgtcagttgcttgttcaagtatttctctctatcactctttgatctcaggccttaatcaggattcagtgcacatgtttacataaacgtagaaatcaatgaaagtctaaaatgtaaggggaggctgttaactgtagctagtaacttctctggtttacactgacagtttcccaggtagccagccgttgtgttctctgtaaacttccattgctgttactgtcatctgtcttaacccttcaggttttttttgtgtctaacaatccctaatccctaaatcaggaaaatgctaataaattattatttgctcattgattagtgagggaaacccatattcatgcaagagtgttgccatatttagttcaaggacattttcctgtgttggcttatttctggcaaaagtcaggtatattttattttattttgttttgtttttgagacaaagtcttgctctatcacccaggctggactgcagtggcatgatcccggctcactgcaacctccatctcccggattcaagcaattctcctgtctcagcctcctgagtagctaggactataggcacctgccaccacgcctggctaatttttgtatttttagtagagacgggatttcaccatgctggccaggctggtcttgaactcctgacctcaggtgatctgtccacctcggcctcccaaagttctgggattacaggggtgagccaccccgtctggcctcagatatcttttagatgaagtatcaccccccacaaaagactttctaaattgaaataattcaattgttcatttttttgttttgtaaagcattttacccattatcagctgactcaacaaaatgatatttcttaccttttttgagtaagaaaaacgaaatgtcaaatattgttcaattatgatttcacaaaaacaatttttaaacgtgcttcaatgacatgaaaaaaataagtccactgtaaacaaatgttagggacttaaaaaatctctgacataatttttctcttcaatttaactttttttcccttgggttggatttaaaaaaaaaaaaggaatttctgattacatctccaatcatgtcactgaaaaatcttgattgctgaacacatgaccaaaaaatgattagttagcttgaggtaaatgttcaattatcaccaagattggtaagcaatctaaaacagagggagtgaagataaattgacttccaaactgctttaaatggttgtagtcgtttaagttcacaggaaatttaacaggctagtaatgaacagacagccctttcactctattgttacaagttagtattattgtttagatttttctcatccttttgcaaattttgcaagcaagtaacttcagaaaccctaatgtaaatttccagttaataaagatcttgatttaactggcattattgaggtgttcttcgagaggcttttggaactcaactagcaggtgcagagagtactacaaagacccgggtttccgtccacgttcacgtaaacctccctacgaggggaaactacaggcgcgctgccggagggcgccgccagtgggcactcacgcacagctgctttggccaccacaggcgccccgggccactctcttccctcatctctctcatcccagcttccgccggaagcggctcctgtcagttgttctcaggtgtttgggcttgttgttccgtatactcagtgggttcgcggccgccggcccagtgaggctgggttcgaggagctggagcgggaaactggagcttaaattctggcggcgagatggacattctgaaatcagagatccttcggaagcggcagctggtggaggacaggaacctgctggtggtgaggaccctgcggtcgtgggggtcgggatgtaagagtgagagtatgtgtgtcggggttttggggtgagggtgacgatactcagaggattcggggcggggacggggcttagcgagtgtcctgccactacccctggtaggcccccttagatccaacccttggcgtctcactgttgaggctggagaatagggtctgagagcagggaacttgagtacaattcgtgctgacttcccaaagctggatcaaaaggaaaacacctgggtctgggggcgggaacctgaggccaattaacgcccacgtccaaaagccaaaccaaaagaaaaatcctcatcttcccaccaccgagtagcaaaggcttcaggctgcggctctccccgcatccctgcctttccaccacctctcagatgggaagggaacgtgccctgcattggccgtgggccaatcacgggccatcccttcatctgcatagggcgccagttcacctcagtctttagccacagaccgaacccttcatccagatacggggtagctgatagggacctcagaaggagtacctaaaacccggaaaactttgtaaccggggcctcgagccgcttgctcgggcccactcacaccctgtggagtgctttctcgcgttcataagtccctacttttgctgcttcattcctgtgttttgttactttttttgtgcgttttgtccaattctttgttcaaaacgccaaggacccgggcaacttacactcacggccttctttccggtaaccacttgggagccttagggatgcaggtgtgggaattgcaggaaaacccgaggctttgtttgttttcccccgactgaccctgtttccctccagtttacctaactgccccctatccccgctcctacctgttggcattctgcggacgtgccccagtgctcctgagagttcccttctgtcgccttacgaagggtttgtgcccaactgaaacatggaggaagggccgccgggcgcggtggctcacacctgtaatccccacactttggtgggcagatcacctgaggtcaggagttcgagaccagcctggcaaacatggtgaaaccccgtctctactaaaaacaccaaaattagctgggcgtggtggtgcgcgcctgtaatcccagctactcaggaggctgaggccagagaatcacttgaacccgggaggcggaggttgccgtgagccgacatcgcaccactgcactcctgcctgggcgacagagtgagacaccgtctcaaaaaaaaaaaaaaattccttctagccaggtgtggtggtgcgcgcgtctagtcccggctgcttgggagaccaaggcgggaggatcgcttgagcccaggagttcaggctgcagtgagctatcatcgtgccactgcactccagcctgggtgagagaccgagtccctgtctctaaaaaaaaaaaaaaaaaagtaataaaattcctttctaatagtaaatcccaattttttaaattctattcctcctccttctctcttcttcaacacatgaaaagtctgtaggcctgctcttcactgatgggaatgctaagactcttttggaaaggtactaaaaagggggagaaagaattacatgatttaggaacttcctgaagatgatctcccttactttattgtgtagcagtaacttagaccgctggttctcaaagcttttggtctcaggaccccttcacactcttaaaagttactgaagatcttgaaggacttttgtttatgtgttatttctatccgtatttaccatattagaagttaaaactgagaaacgttaaaaatactcactgatcgatcatttggaaaacattgggttactgaattatgcaggtctcccacctgttgacacatttcattacaaaatatgaaaagatcacttcatttaatatccactgatctgagaaacatctgtaagcattaggaaactgtcaggctcctgatgacagatctaagttcaccacacttaatttccacttggaagctggaattttatcataggcaacaaatattatcagttattttcttgaagtgatctgctcactttgttcagtttggggaagttgtctgccaaatacccaagtctgaagaaccatggtttgccgggtgttcttaagtgtaaaaatggtattccgtgaaaaagccagtttagcttgcaactcaattactttcctccacacaaccagcaaactttagtataaatgagaattgttgtatgcatctttcctgttttgtcacataatattaaaaagatatggccaaagatcaagacttaataaaaatagtaattttactcctttatcataaggagtaaatttgtttagagaaactggctccctctggctgcagtggcagtttagagtcactgccttggttcttgctaaggctttagcaaatttaccattgcttttcacctacagtgcagatgtcatcagagtgagcaggcagataatgccttactgtagaaaacacttttgacctcatgagtcctctcagagggtctacaggacccatggaaatccgtgcatcacagaatatctgacttagatatttggatgttgtgtacgattgatgtatgtgatgtagtgtaagtaagttagagttcttagcttggtaaatggcaaatttcatgatcattgaaactttaaaaacaattagaaaagtggaggtaatagaatgctgtttggtaggtatggggaaaagcttgttcatatttgtaaatgtttttatgtctactgcagggaccttttgatgagtggttgggagtattttaaatttaggtgttggagtgcatagtggatgttaggaagggccagggtgttgaaatctaagtgctttaaagggaaaagtgaatcacaaaatattcagcccaccctcaaggttcacaacatgaatatttgcataatcatgttcttcgtcattgaaatgcaccaatctacaaaaatgatcattaaaaaaaaaactttagattcttcagggtcatttataatttataatatataaacttttcctgggtgtctttcattttttaatttggtagttgattgaattatcacataattccagccagaagataagattgattttttcaatcacagagcagttcagaccaacaaagggcgtacatgaaatgggaattaaaatactgacattcggccgggcgcggtggctcacgcctgtaatcccagcactttgggagcctggggtgggcagatcacgagattgagaccatcctggctaacacggtgaaaccccatctctactgaaaatacaaaaaaaaaaaaaatatatatatatatatattagctgggcatggtggcaggtgcctgtagtcccagctactcaggaggctgaggcaggagaatggcgtgaacccgggaggcggggcttgcagtgagctgatattgtgccactgcactgcagcctgggcgacagagcgagactccatctcaaaaaaaaaaaaaaaaatactgacattcatagtttatattagcagtaatgttaggcatcatgcaatatgtgttttctaacttgtacaacaagttgccattgttcccatttacagatgaggaaactggaagctaagagaagttacatgactataggattatgcagctagcaagagatagagcctggatttgaaccctggtctgttcctacttcagagcctgatctgttaacctgtacagatagaatggatatttattcaccttacaaacatagaactagttttgatagggctaatgtaacaaagcactggaaaattattagactaacatgatttatatttttcaaagtgctatatgctatctgatttgagctttacaacggttaattagtgcacaaggcaatgctgttttcatggatgatgaaattgaggcttagagggttacacgatgttctcatattcctgtggccagccgggatagatctcaagtcttagaccaacttgagggtgagtgctcttgcatgatgtaagggaacatacacaactaggcgtcttttctgttgtatccatgggaagacagtctttagatctgcagctctatcatttcatgcagaatagttgctttatatttttcatctttctgcatcacagtgtctgtcagtaacttacagactttttcactgccccgttcatagcaatacatttttatatattgatctgatatgtatgtgaaaaaagttttatgaaataattcttacaaccacaaatgattttatcatgttttattcagtcctccttttttgttatcagttatttaattaggttcttcttaagaaatgtagaacaccaatttgtgaggataaattccatgagtcggggcaaacacagatcgcaggtagtcctggagcttaggaatagctttgatttttggtaaaatttgtgactccacagctttctgatcaatcttgtgctgctctgtaatcttgtatttatctttttctgtgctgaagatctcagcttcctggtgtctgggcttctgcagctgctgctgcttgaataagcatcagtgggatgttttgggatttttacatcgctgataacaattttggttgaggtggcaatgacagatttctggtgttttcttcatagaggaactcgattgaggaccagaggtccagtcacaagtaacaagccactagccaggtgcttcaggaagaccgccctcttgcctctgtggaatccagtgaggatgatcagaacgttccccggggtaatgctggttcgcagttttctcacgtgtcaactgagggtttttttttttttttgccatggctcaacagcttttgaggcacatcttcagtaggaaaatatctaggcattttatgaagtttaaccacctgggtactaccattcttgtcaccaccaactggttttgtaacagttgcaagaaccttctttttcttttcaacctcgtacttagcggctgagtacttcctcttatacacagcttttctggaatacatagcacatcgggaatacctgccaattcctctgacaaggacagggttgtgctgcaatggggcttccccttcttgggcttcttagccttgaggtgaccctttttcaccttgtcaccagcctcagccttcttggctttgggtttcttctctttagtatccggcttctcaactttttcacccaccatcttacaagatggggaagagcaagtccctttgttttaattttttagaaaacacgggtcagggatcagtagattgttgtcattaccgcatctgtagctggaaaacagttgtctgtgtggtgttgctcttgcagaaagaagagccacctcatctttggtcatttcaagtggtgtcccagctttttgtggttaatctgtgatagttgaaataatcagtacttagcttgtgagtgcctctttctcaaattgcagagaagtgactaagatatcctcttaccacctgtcctaaagtgccctgcctggtgtaaccaccctgaggtaaatgtgtctgcattgctagaacaccagtgttttggagcctagaattggtgagttttcatttaatgcaaaacctcgtgtggaaaaccaggctgctctagaaactcaatggggagtaattagtagttttactagtcgtagttatgaggatgagctatgtgcagaattttagctttttttccttccagtatttactgcatctttcctatatgcaagatactatgctgtgctgcagtaacaatgctacaataatcaaaacagcatagcgctggcataaagagcaacagctaacaccactagagtataacagagcacccagaacggagccacccttacacaattattgatttttgacaaatacactaaaaccaaatggaaggaaagatattttcagtaaatgatgctgaacaactggatatccatacggaaataataagcaacaacccctaccccacattatacaaaacattctgaaatgaaggaccaatggaaggaatggcaggaaccaacatgggagacattggaaaataaaattagtaaggaaaactgtatactagttctaatacattggaaaatctaagtgaagtaaatggctaaaaagtacaaaaaaatacaagaaatagaaaatctaagcaaaccagtaagtgaggaagacataagaagaatctgtcagctaagaggagaaagttactgaaggaaggaaggaatgagcagttaaatcgaagactggatgagatcagtcagagaagtctctttggatttgtatcttagacattatttatgaccccaaggaggttttttcagtgaaacagaatggatgtccacatgctgtggggctgcaaagagaattgggggtaaggaagtggacacggattagattaaacagtttaatgtggttctgctgtaaatgatacccagggcagagtcttgagcatacttaaatgataattgtcaagagccagtagagaggggaaggatgaatatgcgaaggagaaaacagcattgatggtgagaagtccctgaggaattgaggtctggagtaattggcaagggatttgccctagacagacagaggagggttctctgtttcactgtgaaatgaaaggaccaatgaagatccagctcatgactggagttgggaggaatttggaggagttcctgactggttgcttccataaaatgagatggtttagtcatctgctgaaaatgaggggagaatgaaaggatgggaagttcgtgagaatggagacagtggaatggtcagtgtagacaataggaaagaaaatgaaatgggtaaataccccaggaccaataggcaatgttgaggccccagtggtttttgccagcattgttttgcgcatgctataggcatggagaacgccaagtggacttaaacttactggtctcaggtctcattctcaattattgatagacccagagagcttttatttacataggacacatttattgataattaccatattagaaattaaagccaggaaattacaaaatgtatattccatgtagaaatgcaataataaacccatagtatgctaacagatatttttatgaaaagactatatttgcgaaaacaaacacttcagtgagaaaagtgacattgttttagaaacctctggcatagtagttggattctatttctctctccagtctgttgctgtatgttgttttcaagtacacgaagaaaattcatccacagataagtagttagaaaaaggagtatcttaatagccttttcagataattgtggatattcttcttgatactacaccaaaactagacaattggtttcttaaagatcagttgcaatgtggattctgaaatcatttcaatgaacttttcatacattaaagcctgttctattttgctctttgaatggatctttttacctagatgtgattttgtaacatcttgattttgtaatgtcatggttcagtgaattatgcagatcttcttaatgttgacatttttgattagataatattaaaaaatctcattaatatcaccactgatttcattggaaaaggcttcaagtattgggaagctattaagctcctggtggtgggtacaagttttccacttttccagttctcacttgacagctggaattttatcatcggtggtaaatactatcattgttttcttttagctttaagcttgttttgttcagttctgagaaaatgtctaccaaacacccaaatctgactaatcaaacaattgcacaagtgcttttctttgaggaaaccattctactttagtatgtaacaaaagtgctttatacattttattttttcatgctgattattaaaaggctgtgtactcaaaggttgagatttaggaaaattatgctaattatacttcgtcaaggacattcttaagagaaactagactttttatttttttgtaagtgcatgttggtgaagaatacagtttgaaggccttgcctttatttttgctgatgccagtagtcccccttcccaaatcctccccccatgttgcttttggactgtcagtgcaaatctgagcacaatgaaaacggggcacataatgtcttagtatatcatgaaaataaatttgaccttgcaaaacctctgaaagagcctctgtggaccacattttgagatgttctaggcttgagattttgttaggtgtgttcaatggaattgagacatggtcatcaaagataacatagttaaaaagattggaccatggcctccggcctggagagtgttttttcctttctttctacacatcagccctttctgagaggataccaatgtgtgtttgccaacttatttgaaatatgacaattatatactacctagtcaaaaacaattttagatgccgaaataatattttgggagtgaagaactgtagcttggaagactagatcagaacaaagggtttaaggaccagagttctagttgctactcatcattcttcctgagttctgggaatgtcacctaacctaattctcagcgttctcatctctaaaaaggggttaatactatttgcccccaccgtactcagggtagttttgatgttcagatgataccatcggttccttaccccagataacatcttcatctttatttccgtaaaactgtgcttgttgtgtggtagataagtctggaaatgtttattgaattaaggaatgaacttttagaaaaaccttattctgaaagttttaaacataatacaaaaatagataaaattttatgatgagcccctgtatatccttcccctgaaacatgcagctctagaaaatgacatgttcctttaaaaccaaaatatgatcacacccaacaaaattaaaattagtttgttaattttatcagatactcttctcacattcgtatattttccaactgaattaaaatatgtacatacatttgcttttacagttggtttttcaagtcaggtcaacacgaagttcaatccttgcatttgcttattatgaatcttggtttcttttaatgaagaacgttgtcattttctcaacttggctgattttttccatgccattgacttgctggagaaactggggctagttttgtaaaatgtctttgatttgtgtaattgcttcctggcatattgacacttagttaattcctctcttccctacatttaacaaggatacttcgtagacgatggctgggtaattcctgtagtataacataggtggtacataatcttttactgatgtcaagcttgatcattgggttcaaatggtggcaggctcatctttccattgtcaccattggcctttttcataaggttttagcatccattgatgatcattgtctgagtgaatgagctttggaactatgaggtgctaaatacttgtgtggaggtagtacacaggtaatattatatcattactgttaatacagtcggggacagtgtctttatttgaacaaagccatctttggaataatatccaagaggcagagctgcgatggcaacaagcctccaaattacggactgtagatgtaacaataaggataattttatgtataatgtggaaaggactgacatctttttagccacagacaagatttagagcttgtctctttacatcaaatcatatcacaacaaataccttgtgagaggatcatttgaacccagggagtcgaagttgtggccttgattgtgccactccactccagcccgcgtgacagagagataccctgtctccaaaacaaacagaaaaccagaaaaacgcacaaaaaaccccaaatatccttaaatcattttttaaataaaagagttcaccaagaccaccctatatgtagattattttaagaactgattgatataataaggttccaggtaacaagaaagaacttacactcctggagttcccttgttatgtgggatatcaaatgtaggctatatatgtcataattttgtttctgttaggaaaaaataattgaggtataccattttatgtgtttcataatgaatccatttgaagaaattatcattgaactcagacattaagaagtgaaaacatttggaaaatattcttggtctcctctttgctgatggacttgcctactgattgatactgcaagaaaaatacttgaacttaccacatatcggtgcccatagtcgtagtggagggttgttgatgtgcttggggaatcaatgtattcatctctggaaccaaaaaatatttattttatccaattcttgaaaaactgaagagtgtttccaaagttttctaaaggtatttgttgactatgggacatgaaattttgctcaaggatatattattgacataatttattttctttaataggaaaataaaaaatatttcaagcgtagtgagctcgccaaaaaagaagaggaagcatattttgaaagatgtggctacaaggtatgaatgtctgcttttatgttaaattgtacatttctgagtttaaatttatacagctgttgttaaatgacaatcattgatctctgttcaatttatcaatatacgttagcctataaatgagaagccatctggagaggtatgagtttttgtttttgcatttttaaaaaaatcttgaattcaggaaaatacatgcatgacttttggcttggaatggtttggctttttgtggacggcatgaagtggcttgagatcaaagcttgaatttttttttttttttaataaagtcctgaatctgagactgcgttattttcagctccaccaccactcctctcccccacctctcccaataaaacagtctatttggaaagacttcaaaacatttattcatccagccacagtaatattagtggtggtaattttcctgccttctccggaatattttaagccatcgattttatgtttgcattgttaatacgtccttttgggtcctaagaacctctgcctaaagtataaagccgtatatatttatatgcctttgttgtaataaggtatcacatttcaaacactgtttagtctgttggatagaaaatgtcatcttgaaatatttcttagaaacaaatgagttgtctggaaggctttgcttgtatattttagaagaaattagttgataatgtattgtggttttattgggaggggttaaagggtataaggtggagaagttacgtttaaattattttaaaagaagactatatctagcttaatttttaactcaaagctcagaggttctattggaatacttttgccaaatcataaacttgtaattaaccttttgcttgtaaaatatcaatataagataatacttttgtgcatgtaatggggaaagttctggaaatggatttatcctgcatagcatttttagaaggaagcatgaggaatgcacatggtatgtatatgcatttggtttgattttgtagtgctgggagaagacaagtattaaagaaaaatgtagttttcaaaagataccaagaagtgacttaaaaaaattttaaaatgtaattatatttctgatgtttttaaaatatgggaaagtttaaacttgtattttgattttttccataaagatatttgttttatttgcttaattagaaatgaaaataagttttatgttaataaccattgagtagatagatattcagaaaggaactctcatttttgccttgcccagtgttgtctaacacacacttggtctggaataagaatcacttacataggtttactctgctggcttgtggcattcccagattcttaaatttgaaccttttcaactatttgataaggtaggaaagtaacttaatatagtggcagtttttgcttttgtttagtgtgtttttttgtttttatagaggaaagccctgaaggaaagtaattactgtaaagataattgttgataacttcgagtccagctcatgaaatgacttagattttttccccagagctattaactgccattatataattaaatgtgtttttaatcctgagatttttggagaaatatgtttccatgcttaaaaagtaaagcacaggtgtttctttctaaagatttttaaagatttccttcttggtagtaatgacatggtatccattccttttattcttttgtagaaatgagttagcattttttaaggcttggtgctgatttgacctgtgaaaatagaaaggcttagtttgttaccttaattttacctcagtatcaattagttacggtaaacataaacttgaactgtaagctatagaatcatgaattatgtaatttttaccatatagcctttcttaatgtgagtttcttccttaatgttgatcttcttttatgttcttttgatcttactcctactttcagcattttggatttatcttatggtcagatgggaaaccacgtttcagtatcttttttatagactccacaaaggggcttgtaaattgctgaattcagttttcttaaactgagacttgagcaacagatttgagaaaatatgtgaagagattgtttttcctacaggttcatatgaacaagaatgcccactgtttccctgggtggcgttagtagacaggtgcttttttccttgtgtttctgcaaggttggtagctcagtttggaccaactcttcgtagcattaggaatttttctgtatgtccaacatgattttcttacatttggaataatacgttttgaaaagcaggataggaaaagctagagcttgaagtttctcaggttgctgttggaaagaaattcttttatcttcattttgaagccgagcaagaatcaaataaccctgcaagacaatttaaagaggaagagcaagttgctggtttttaaggaaaaagtacagtctttagaatctggggagaaagagagtgcaaatttcagccctgttaaatttggattttggaaatcgtggtagtcgtgtcactcttttatagcaagaatgctgattcctctgtgcatgctctggacttgtgatgcccctgacgtgaatacgtttgactctcttttataagcatgtacacttattgtgagctctttgctcagaggaatattagaaaatcttcagtgttgaaaacatgtttaacttccatagctaaggtaatggaatgataaatatcaactatatttttaaagctgaatttcatttcttttggctattaatatagatacagccaaaagaggaggaccagaaaccattaacttcatcgaatccagtgttagaacttgaactggcagaggaaaaattacctatgacgctttctaggcaagaggtaagtttatttgtgatggtttcatgagaataagatctccacggtgtttacatttatctccagcttttccaataagttaaacgtcattatttcctgcgtaaaatgacttatctaaaaatgctgtgcagctagttttcttcatgaagttctaaattactcactgcttcttttcttggtattattatcttaactttttttagagcttatccttctaaactttaaaaaataaacatgaatattcaaaaataagtataattaaatgctcttatgctaaatatttgtacttaaattattttaattattattttgtaacatacttccctttcccttatttaataatacgtctttccagattaaaatatggagatctacataattttgaatgagtgtataatttcccattgcttgtttgctccataatgtttctttatttatttatttattttgagacagagtctcactgtgtcgcccaggctggaatacagtggtgcagtctcagttcactgcaatctctgcctcccgggttcaagcgattctcctgcctcagcctcctgagtggctgggattacaggcgtgtgccaccacacccagctaatttttttttgtatttttagtagagatggggtttcatcatgttggccaggctggtctcaaactcctgacctcaagtgatccacctgtctcggccttccaaagtgctgggattacaggtgtgagccaccgcgcctggccgcaccgtaatatttaaaaaatcatttattgatgatcatttagattgcttattataaataatactaagatgaacatccttatgtagacatcattgcatacataataatgtgtgattatttcctttggaaacatttctagaagcatgatttttagggcaaagactacgtatatttttaagacttgatatatattaccagatagctgtggaggtattagccatgttgtgccactttatactcctagctgttgtgtttatagtgtttgtctataccttgatcagtaccaactattattttacttaaaagaaatcataaaatttaaagataatcaagtgatataaagaaatcaaatcaatacaaaaggctgtaaaacaaaaatgtcttccctttttcttatcttccgtttcctcccactccccctgtgccccgatcagtcctcctacccagttcttcacttgtacaagcgtcagtgtgtatgtgtataccttttttccctttcacacaaatgagatgacatgcatttgtgccttagtcttttcacttaaaagtacattttgaaggccattttatgttggggggtgtgtgtgtatgaacattttttacagtaaacatgtgctttgggcaggttatctggtctgtttctcaatttccttatgtctgaatgagggtaacaattgggtctacctcaggagactttcatgataaaataaggtaatgcatgaagagaacagtccttaatagtgagctactcaacaaatttaggtattgtttttagtagtagttctgtaatttattaaaattagctctttactgatggatagattacttccagttgtttgcccttacatgcagtgctaaggtgaacttccttatacatatgtcttgatattcgtatgagtttatcaataggataatttcctaggaaaataatttctggtcagagtgtgtgtctatgtaatttttgattgtgtggaattgtcctacaaagaagctgtgccaatttacattccaactgtaagtatgtaagacttcctagcatttctgtcaactctttattttaaaatgtttcagcctttgccaatctgaaagcagattattattttaaatttttgccaaactgatgggtgaaataggtatcttgtgttaatgtgaaactttctattagtgattattagaattgaacatgttttcacgtgttcagtggtcgttaatgtctcttgttttgtggaattgccatttttatattgtgaaatttgtctttattgatttgcagatcaacatatttatatgttaagggtgttaacctgtgttcataagtgtgtatgtatcagatgtacatagtgtatatatatatttgtcagtgtatcatttattttttgccatgcagaagttttacatttttatacgatgacatcagtctttttcattatgtttttttttttgtcttgagcatcatgcttggaaaggtttcctctgttcctaagagttaaacaaagatatattaatttttttccactacctttatgaactcattctttatatatagaaaatataattttctttatattttaattttgtatctcaaatgagtatatattaacttcatagtcaaaatacttgaaatttcacgtcacttacatattttagaattctgttacttttcgattttttgagacaaagtctcactgtgtctcccaggctggagtgcagtggcatgatgtaggctcactgcaacctccgcctcccgggttcaagagtttctgaagcctaagcctcccaagtagctgggactgcaggtatgcaccaccaggccttgctaatttttgtatttttagtagaaacgaggttttgccatgttggcctggctggtcttgaattcctgattcaggtgatctgctcgcctcgacctcacaaagtgctgggattaccggcgagggccactgcgcctggcctagaatttactttatctttaaacattgaaaagcttgagttaaaagacgacgtagttttaagaagttgttctttttgtgagatccatcattagtaaaccattgttactgattaatagtggtacatcagttaagtagtagacatgatatggggaagaagttcctgcctttgctcagcgagcgtctattgaaatagtaaaagaggactcagaggcttaagttctttcactgatgtccctttagtctctgtgtcattttttgggggaggtggtggtggtggtggtggtggtggtatatttcagcttctttatttaaaaaattagaataatagaattcttgcactaaaagaaatttcgaagtcaggtagtttattaccttgcctttagacagaaccactgttatataattccaggtagatgagagttagctatttaaactgataaccagaaaaatattatgcactcctcacaacttggcctaagttatagcacccaatcttaagcagtgttttacagtaataactagctcacattccctttcttttttctgtcgaggttgtttttgtctttgactgactgacttagggtcatctttcatctttgagtcctcagtagtctcttcctgttcgacctctgtagttgtggataggactgaatgtaagtcatagaaataaagcgtctagatcaaaggcttatgtattctgtacttctcgcaagttgacatgtttgtagtattattatttagttctacattaccacatgtttatgacggacattgcataaaaggaaattttcaggggaatggtgactgactctagaaaccatcatatgaagatgaggtgaaggaatttagaatagtgaggctggagagaagaattactagagatatctttaaaaatccaatgaaagtagctctgattttggaaaatcagaatattctctgtagtttcataaagtggaactgggataaatgggtagaagtttgggggaagtagatttcagttttgagaagcaaaacatctctgtctaaacaatgggatgggatgtttcacgaagaaatgtgattcctgccatttgtcagccagggatctgacaagggtgtttgtgaggtcatttctgcattgattggagatagcactagatgacctcttaaatttctgttttaatctcaaacttctgttaatccactgggagccctctcaatggattttaggtgtgatgctatttatgctcccaggtaaagctcttggtgtttctcattattgctttatttaaaaaatttggactagtatttattacgttttctgtttctttcttcctttttaaaatgacatacatagcatgtatataaagtgtatgaaccatgttagggcaatatatgtttgttacacatatatgaataattataaaataaatattcatgtaaccatcacccaagtttggaaatagattttcagcatcttaaaagctctgcatatgcagattataactccctgttttctgagggagaagtttttggtttcatggtggtattacaatgcagactgtccattatggtaattatcagctggcttcagatttgattttccttctctctataaatgctgtcattccctcccatcttagtgtttttcctgtgtgtcctgccacacagattggtcctatcgaagcagtgagctaaacgacctaaactttatggttacttaaggtgtgatggtaacacagtatatctgtttatggaaaattaaaagaataaacagattacttttttcatctacatttcaaaacaagtgtttgatcaccaaaaatatgctgacataagggattactattgtctttccattgtttttaaaagaagactaagaacagttataattatgtaaaatgagggccacagacatgccccttttcttacaaaaaagaattttttaaaaatctcacagtaaaagaggtggtttatattagggtctttctttagacttgaattgtagagtcataggtcagaccactttctaggagctgttcagtgataaaattaataacagtgacttttgagtcaaaatagatttttaaagtacttgattttctctttgatttggaaacatctttgtttagcttaattgaaatgatctaaaatatttgaaggattttatactttacacagaggcatgtatttggataattagcttttattaaacccaggcttggcttttaaggtacaatatacaaattgtttttgagatgtttagttttttcctctctcaaaagtttaatagctgggcacattagctcacgcctgtaatcccagcactttgggagcccgaggcaggcggatcacaagggcaggagactgagaccatcctggccaacatggtgaaaccccatctctactaaaaatacaaaagttagctgggtgtggtggcgggcgcctgtagtcccagctactcgggaggctgaggcaggagaatcgcttgaacctgggaggcggagcttgcagtgagccgagatcgcaccactgcactccagcctgggcaacagagtgagactgtctcaaaaaaaaaaaaaaaaaaaaaaaatttactgggtatctgtttcactttgtaggtcatcagaagattgagagaaagaggagaaccaatcagactatttggagagactgattatgatgcttttcaacgtttaaggaaaatagagatcctcacaccagaagttaacaaggtaagaggacagaacaaagctagaaaaataccactgtactgcattcactagaatagagtttgactaattgcattattgtaggcaacaatggaaaagtaaagtgagcagattattgctgctgaatggaagttttcattaattttttgaaaagctcatatcttaagtataacatttaatgcattttgacaaatacatacaagcatataaccattgcccttataaagaaatagaacattttcgtcaccaaagaaatttccccgagagcatcaggaagaatagcgaatggatgctgggctcaatagctgggtgatgggatgatctgtgaagtaaaccaccacgacacacgtttccctatgtaacaaacctgtcatcctgcagctgtatccctgaacttaaaagttgaaaaaaaagagaaaaaggaaatttccccagtaccccttctcagcctatcctcatatttctcctcatcccttcctgggcagccaccatttgaattttgtcatcatggattaattttgcttgttcttgtatttcatacagatggactcatagattgtgtgtctggcttctttcgctcagcatatcagtttttaggttcatccatgttattgcagataccactggtttccttttcattttccagtgatactcagttgtatgaatatatcaaaatttgtttccagctttgggctattaggaataaaactgctggctgggcgtggtggcacaagcctgtaatcccagcactttgggaggctgaggcgggtggatcacaaggtgaagagatcgagaccatcctggccaacatggtgaaaccccgtctctactaaaaatacaaaaattagctgggcgtagtggcgtgtgcctgtattcccagctacttgggaggctgaggcaagagaatcacttgaatccgggaggtggaggttgcagtgagctgagattgtgccactgcactccagcctggcgacagagtgagactccgtctcaaaaaaaaaaaaaaaaaaaaaaaaacagggataaaactgctatgaccattcttatgcagatctttttttggaactatgttatttttcttgggtaaataaataggtctcttggggagatacctagaagtagaattgctggataataagagtagatgtatgcttaacttcataagaaatgccagtcatttccaaaccccagcatgtggtattgttagtctttttaattttaaccattctcttttgtgtctggtagtagctctttgcggctttaatcacattacctgatgactaaagatgaggagcatcttttcataaacttgtgttcatttgtgtagtgtctgttaaagtctttctttccttatttatttatttttttgacacagagtctcactccgtcacctacgctggaatgcggtggcataatcatggctcatggcagctgcaacctcctgggcttaagcagtcctcccacctcagcctctcaagtagctgggattacaggcgctttttgttcattttaaaaataaacttgtctttttgtaaatggattataggaattctttgtatattctggatagaagttctttgtcagatatacgaatattttttgtgactattttcttgtagtttagggcttacctgttctcttaattgaatcttttgctgaacagaagtttgtgtgtgtgtacacacacgctttttgagacagggtctcactctcacccaggctggagttcagcatgatcatggctaactgcaacctctagctcctgggcttaagcgatctcccacctcagccttccaagtagctgagaccacaggtgtgtgccaccatgcctggctgattttttaatttttgtagagatgaggcctcctcatgttgcccaggctgatcttgaactcctctactcaagggatcctcccgccttggcctcccgaagtgcccgggccagaagttttatattttaatgaagtccaatttattgttttttccttttatggtcattgctttttgtgtcctgcttaagaaatctttgcctatcccaagatttcaaatatatattcttaattttcttctagaagcttaatattatagtttttgctttacatttaaggctctgatcttgttttatggcttagcatatggtttattccatgggctcttgaaaagagtattgttttgctttcatggtacagttctacaaatgtcagtgatgatagtgttgttcagatcttctttggccttgctaactttttatctacttgctttctcaattattgagagacaggtgtggttacctatgactatgtaacagactactccaaaacttactagtgtttgtttatttattataaaggatttatcattaccaaatctgtttttggtgattaacaagccaccctgaaacttgatagcttaagataatttgttattgtcttaataattaccagttctgtggttttattgggctggattgagcagtatcttgcttggggtctttcttgtgattgcagtcagatgaaggctgcggccgaaatcatgtgaggctgcctctggactggtcttctaagctgatatcttgcccctttcctggcgtctcagttggaatggcaggaacagctggggctggccaggcccgctccccgacctgctctgtctgctagcctgggctgtctgactgctttctttgttgccaaaccactttcctgctttacttcccagcattgtcattccagccccacaacactagcagttgctttcagtcctctgtgtctgtaatgatcatttttcctttgcttgctgtgtttctgccttgtatgctctggttgaaatcttgtttttatactttcacatgcaattcagtgaccacatcttctctcggaatctatttttgatcccagtcagaattaattgcttccttctccatgtgcctatgagtaaacctttgttagtgtacttactgtttttcgctattattagagttatgtgcatatttatctcttcctggtgggcaaaggctgttttacctttgtatgccaagtcctgtgccgtgcatctagaggttttgaggacaaagcacaggagcacaaggtctggattccattcctggattatagtaatcaattatttggccgttggcaagtcttttactctatttgaaccttagaatcttcattggtaaaacagaggcagtgatatttggctcactgggatgcactgagaattcgatgaggtgacctctgggaatgcctggcgtcatactttttacacagcaggtgatcagtcagtgtttgagaaattataagtgttttgagttgaatgtttctcttctgtgtttatgaagggacaggagacaatgatcagatgctttttgtgtgagaacgttaggagttaacattggttgaatgtgcaccgtgctccagtaactgttcaaagctcatcgtccatttcttagcttacttgcgtgacttgatgtttgcgaggttctggaacagctgcatcacatagtaactgttcactgaaataaaaaatagcatccttattacagccctacgtagtagatggtgccattactcctattctgtaggtgagtctactgaggcacacaggggttaagcaagctttcaaagagctatttaatagtatgtggcaaggatttgaacccagatagcttttactctcaaccattaccctatagccgcctcacagccatgtttccttggctcttaaaccttgcagctgattctcattcatttttaggaagatgaggcttccattttcattaaagggtcatgaaccatacgtgcataaaatgcgaatttgctggtttgctagaaacatagttgagaacctgggatatagatgaggcaccaattttattacactgatgtttctgaatgttttgggagttcacagtagttgaggttagacattgtaaatgagctgggcaaacgggttggggactctaatggagacctgccactgtcactaagcctcattagaaaattacagcattgatgaagattcttacttggatttgtcactcacgtgtattttatttttctgaccagcagactggccattgtttgtgcattgttttaatttaaataggtccgtaagaattaactttaaatggacagtagtgatagttgtgtgataaattgatgtgatttgagtccctacttttgctgaactcttcttgtgggggaaaaaatatttgcagttattaatgaaaaatcaaaggtgaaaaaacaggtgttcttcctttcataacaggtgttcttcctttttttgcttttcttagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggtaatctctacaccaagcccagcacatccctggcacccttctttttcctctggagcagatgactgagtcgggcagattgttgagggcagagcacactgttgtccttggtcttttgtttatttactcctcgcttttatttatttactcccctttttctcatcctccactcacattcccctacttcctgccttcaaaaggaacccattctaatatgttggatatgcatctttctgtttgttggtgctcttgtgacctgcagtgttttgtgagcatgtatttttgatttacataaatgatgttatgctgtgaaattctttattccgtgttttacttttctttttttcagttagcactatgtttttaagagctatccttgatgctctgtgtacactgaatcctttgcttttaattgctacataggattccatgtgttacgccattcactgcatttgactttttgttctccggtaatgatggacagctagattgttcccagctctctcctaccacaaacagcttcctgatgaacagtcttgtgcataaccacgatggcctagcaaagtgggattgtgggatttatatatgtatatttaacttgtctaagtactgccaagttactctctggaatggctgtcctagtctacacccagcagtgtgagggtcccctgtctttccagccctgccaacgcttggcaatatcttgctgtctgatttttgctatagtgctgcttttggagtgttagtgtataatcttaattaaaaagcaattttgtatcatgtaagtagcatgtaaaataaatatggcttaaagttcttaatgcttaaggaaacataaacttatttttctgtttcctttaattcctggctcttgtatgtgtagctgtccctctgaataagatcatagttgaggaagacgtcattttaatcccctgcctcctccaatacctgtctatggtccctaaattttactaaaataattggtatgggcaaccagttgtgggcttttttttttttttttttcctattggtgtatttatttgtttatttttaaaaaacagctttattgagatattgacataccatacagttgactgatttaacatatacaaatcagtggtttttagtatattcacatggtggtgcaaccattatcacaatctaattttagaacattttggttcccccaaaaagaaatctcacattcattaccccctcttgacttttcataaaaggtaacatgctctccaaatttaagtggcaaatccgtgttttttgtttttggtttcttatctagaaattccatcagatttttaagtaaaaattgaacagcatatgtgaccaagagccatgtttagactggtgttggtaatatatatgtttagttgttgctctgtattaatgaacagaagcattgtttctttttcttcaggcgcttggagagtccttagggaaaggcgatgatcataaggacatggacatcatcaccaaattcctgaaggtgcgtgtcttaggcgaggggatgaggatgccttggatccttatgaactattcttatatttttggattaccaagggttaaaggctggaacgggaaagcctcaatacacatttctcacacatacatgatgtttatgatatcactatgcacttgatgtagcagttagtaagagaaaatgcatatttacttttcttgtggcttttttttttttttggaaacagagtcttgctcttgtctctcaagctggggtgcagtggtgtaatctcagctcactgcaacctccacctcccgggttcaagtgattctcctgcctcagcctcctgagtagctgggattacaggcacccaccaccatgcttggctaatttttgtatttttagtagagatcgggtttcaccatgttggccacgctgatcttgaactcctgacctcaggtgatccacccacctcagcctcccaaagtgctgggattacaggcatgagccactgcgactggtctgcttttcttgtggcatattttttaaagctggctcattaatgtaaacacatagaaaagaatcacaacagcagaattaataagaagttggtagagttgcttatttttttctggaggcagagtcttgctctgtcgcccaggctggaatgcagtggcaccatctcggcttgctgcaaccactgcttcctggattcaagcgattatcctgcctcagcctctcaagtagcatgccaccacacccgactagtttttgtattttttatttatttatttatttatttttttagtaaagagacaggttttcaccctgttggccaggctggtcttgaactcctgaccacaagtgatccacctgcctcggcctcccaaaatcctgggattataggcatgagccacagtgtcccgctgaatttctagacaacccaaggaagaagagggttctagcttttttttttttttttttttttttttaagcaaaagtgtctttctctgttgcctaggctggagtgcagtggtgtcatcctagctcgctgtaaccttgaaatcctgggctcatcaacctcccgagtggtagggcatgtaccaccatgcccagctaattttttagttttttttgtaaccttacagagagtgctcaattcttcagttctacaaatagctgcctatttttgctgacttgctgattccaaccgtcttctcaacatttctctctttagtggtctagatagagtatgaacaaatcccagatattttattgtttattcacaaactgtgttcagaccaagagatttacatgcaaggaatgctttttcttgtgtgtacagtttagatacaacatattattcatcaagattctgaatatattgaggatacagcatggaagtagatagggcataagaattagtatgaactagaatttcctctttgagtgatggcctcttcttttttaggatatgcatagatgatgcccctagaggacaacatcctcctcagccttctctgtttcctacttccaggaagggtgccctttatacagttaaacccaaggggcactgaggtagttatctaggggtgggggtggagtgggaatgctgggtcttggcttctttatttctgtttctctttctccttcctctcctttagtcaggtgctttcatggtttttaaacttaatcatggtctctacagcatatgtagaaagtccagttttcttgtaactcgtaacttgttgaattttatgtatataatacaaatacaaatacaagtttatttcctctcaaatagttaactatgaaacttgatagttgttttctgagggaagcaaattatcctgagctaggaatagatgtagactagggaagttggtgacttgccaaaggtactacttcaaagcattatcatgaccaataagcagaactagcttattctatattatttggtggcattttaatcaagacatttactttaaggatgattgtattctgtttttgtgtgctagagagcatttagatgtactgaaccactgggtggcattgtagtctaagtttacccatcctttcaacagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaagggtgaggtttcttggaaaatactttttttaactgactttaaaaatacagtataaatttagaataaatgcagtctgttttttccctatacatctatacatagtagcttccaaaatttcttatttatttttttcagaatcttcctgctgatattaaagaatcaataacggatattattaaattcatgttgcagagagaatacgtgaaggtacattcccatgctgttctttgaaattgttaagagtatatctaggttatgtacgtaatataatgttcatttgggataggaggattttacatagtagatttaagaataaatgtgagatgagttagtagtaaaaagcgttttattttctattgtatttgccagctttactgttaggcagtgaataacaaacctgactaagaaaatacagacctcatctgtatgctcttggtcatttttaaaataggcctaaaggttcttcagagcatgaactttatataggcagtgttcattttatgaatttcaaagttttgtaaatggctgattatgtcttggaacaaattttcccatagaaacaacgttgtatagatgagtttcccaggatggtcataaaagcccctttaatctgtaatatagctgaactgttgcactgatggtacagtggaatttaaccactctttgtaattgtttctatggggaaatggttcaagcaaggcttccaggactcatctctcccatttcagcgttgcagacccctgcagtggaagtctctcctcccttgccccagtgtctatactcctgaatgggctctgggaggcagcggtgagggaaagggtgctggtgtccagggctccctgagatagagtttagaaagggatgagaggaggactgtcagttggtacaggggaacaagaagggaagggcccaatgcaccagtagtggcaatgaagaaagaacagagtttgagggaggcttcttgtggccgtgcctcccaagacactaggagtagagcatttcagtgcagcaaccccagtgccagtgccagagcggtagggaactcggaatgacattgcttatccagtgctgtatctgtatactgacgtaacaagggactgctggcattcctgagtgactggatgatttacgtgattagagccttaggctaaagaggttcctgcagtgattttactccttttaagagccagccagttttctcaaagaaaatattttttgtcttacagttataaatgtgcttcttagtttctgtcagttgcatgattcttactaaggatggttgcattggcatggatggataaggtcaccatcactgcaggaagaatgcacatcactccctgctagaatggatgcctttcctcttactgctttttctcgtgatcacatatcagaactaagtgcaagtgcaagcttattttgtataaactacagaaagaaccaagaagctttaataacctgtttagacagtttctttgaaatttgggggaaactaaatattgcagtttttatcagttaagatccaatgttaaagtttatacacatgaaaattagtgataaaaatgtacataggccctttttaaattaagctttataaaaccggtgagcagagcaagttcacatttatctttagggtagaaaatgatcttccagctaccctatctgtagtatctgattttaaaaaaattgactctccctatcaatctcataggtgtctgatttttttaaattaaaatctccttgaggcctggctttatgagcttctcttaacccttgaggtcctttagaatttatttgctttatgtttttcttgttcttcctcacagctagccaggcttggttaggaaaaaaagccatttgtcttcattggtttctgtcttcattttttgtggctgttctttaacggttcttggcaggtagggggtggggtggggggcaaagtggagcgatctcatccttcagctattcgactggagggccagtgtttcctctctgtttacacatctgttaaagaccctgtgtggtcgtcggcacatactgagcccccacttccttcagagagccacagtgctgtgtagggagtggatattgtttagggttggacgatgaaaaactacttagcccctgtcttctacatgaccccctgtggagaagactgggtctaaaggagaccaaaactagaattttcatcagtgcattgaagtgcctacctggtaattccagatctgcaacatattaatttccagcatacaaaggctgcaaaggaatgtttgccttttttttactcacaacctagctttggtttctgttttttccatggacattggtggtcctgggcagggcagtctgttaccctgtattttaatctgttttgtttgaataacagtcatggtaatattttccatgtgcccaaaaggtggacgaaaattacatcataaagggctgtgaaatactttcaataagaatttgagccagtacaacattttcgcctttctgatttcttcttacactttcctttcaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcaggtaagcagtttggagagccgggaattgccctggaagtgaatattctctaattcccaaaactctaagtctggaaagcaggcagagaattacagcaaatagaacatagcgtgataggatggaagtcccctctggataagcactgacactgaagccaccttcactgaataaagtaaaaacctttcaactttcatatatgttggaagacaagggtgaagtattgtgctttaattaccttagcactgaaataaaatgattgcagtttgctttttttttttaagacgtgtattaggaagtaaaagttgagctcatcagagaaatgtgggagtttagtgaagagcaacaaacttagagtattttacaataaatcctgctttgttgctttcaaggtaaatctaacatctactgggttcaagatgtatggagagtaaagacttggctttaatgtacgtagcacgtaacaacacttctttagtcatgtgaataggtctaaagtgccgatggtttgttttcttcaagttatacatgcttcacataaacttgttggtactgtttttgggctaaacttttctccctagtgggaagaaaatcgactataatgtagtgtttgccagattgtcataaatcccagattgtgtctgtaaaatgacttgctggatgatagttctaaaacttgacagtgatactccggaagtttacttaaaatttgaagttcacttaaaatgcataaagtgctttcagattttgtgccagagaacagtcattaccatattcatgaaatatctttttgtttttatttcacttccaagtgctgaatgttaattcgtgtcatgctttatgccttagtcacatataatagctttttaaaatatgatttcaatcggactccctcatgtgaactgtatacagagttcaaatatacttctggaaattcaaccacatttccattttttaataaccaccagtgagtgtattaaaggcagaagcttttagctgaaaaaaaaaaaaagttgcttagctttaacaatagaaaacaggttccaaagattaaatttgctaattgtgttcatctatattgtggccaaaggtatagtgtataaaagttcatatgattaaatcaatcgtctgaaagacatttcttataaacagtaatgtgattttcacctccccgaggagtgatttttttttaagtatacctagcatttattcaagaattctggtttattttggaagctatgtaatgacctgtccttactccattgttcttcctttttaactgttctcttcccattaaaaaaaattcttcttttgccccctaggtgattagagaaaattgatgagcatactgtatttgaaatttagctaggtgtttgaggcagacccagtggtattcttgtggatagggcaaatcaggctggactcatagctcattgacagagggaagccatggagcattaaataatggactcgtgtctcttagggtagatgctagagatgtatgtcaggggtcttagggacctcagtgctgtcctgtcgaaccttttaatgactgacttggatggctataccgaaggatgggtttatcaggtttgcagacagcaagaaactagaagggatggagtgtatgttaaggtggaaaagaaactgctattctagaagttcttgacagacgagagagaagggcagagtctaaaaatacaatatttaggaaggaaggattaccataagaaaattggacccatatacccttttgcttaagcttataatttgggcagtggatataaaaaagaattagaggctgagcatggtggctcacacctgtaatcccaacacttcgagtggctgtggcgggaagattgcctgaggccaggagtttaagactagcctgggcaacatagcgagaccccatttctacaaaaaatagaaactagccaggcatggttgtgtgtgcctgtagtcctagctaccggagaggttgaggcagaaggatctcttcagcctgggagttcaaggttgcagtgatttgtgattgcatcactgcacttcagacagagcaagaccctgtcaaaaaaaaaaaaaaaaaaaaaaaaagaaagaatttagtggactaaatttagtgtaataaaatttgtagtatgatatggccacctaataacttagtgtaggttctccagggcaagaacatagttcagtattgtacccctagaatctagaacaatatctgactcatggtgggtgcttaataaatatttgctaattgaatgaattcatgatagagcaagagaggtgataataattgctctttttctagtcctcgagaaaggagactcttggtgagaatctgggcaagagttctagatcagcggtccctgacatctttggcaccagggactggtttcatggaagagcatttttccatggatcggggaggtcagggggatggtttcaggatgaaactgttccacctcagatcatcaggtgttagtaaggagcatgcaacctcgatccctcacatgtgctgttcacaatagggtttgcgctcctgtgagaatctaatgccaggacagaggagagcagagcttaggtgctaattctcttgccctctgctcacctctgctgtgtggcccattgcctgactggccacggactagtgctggcctgtggcccaggggttggggacttcctgctatagaaaatggtagaactttctgatggaagaggattaaacttgttttatacaattggacagatttttagttagtgtaagacaaagctttttcagaaaacgtttttattttgaaataattatagactcacaagaagttgcaaaaaatagtaagaagctttttaataggcagagttgtcccaaggtgggagatggaggaagacacccacctcttgatgtctggaggcataaaacattgccctttttggcccttctggccagagtcctctcattcttttctgccattttccctagaggccattgcttaaacctcaagtttcaactcatgcgcccaagagtcactaagataacgagtgagctgagggttaaacctctggcttctgtcttccactttcctactccttatgtaggtgcaactagaagctgcattttattttcttctcacctgtgctgtaagagaaatgagcaatgcagaagcgatactgagtgtcagtgatgcttggcctctctgttgatgaattcacttgagctcattgttaccttgtaggaatatggttccaatgttgctggatcttccatgattttttttaatgagaaggaaaatcttggtttttgaaaaaaaagtattctcctatttttaaatgttggcatcaaataaaaaaattaacattgtgtaaggctaaacagaatgccagtttgtgatctgtgtcttaaacccatagtgtaactcaagcagaagaatgcggccaccctatgttagagttttgtaaaattcttggttacaatttactgattgatttactaagctgtctaaagaatgttcctcttgttactttggtatctggatgagattaatttgaattctcctaaaaaaaagacaatttattatgtgaagtttaagtcaagggttggcaaaattttccttaaaggatcagatagtaaatatcttgggctttgtacttcttgccatctctaactactcacccatgcagctaaggcacaaaagcagccagtggctgtgttccagtaaaaccatgtagaaaagaggcaagtgggctgagaaccacagtttgctgccccgtagtaaatgtatgaacgaacccaaaaccttttttacactaagatgttggccgaggaggtaattatgaaaatcatttaataattatttctttttaaattgcggtataaaatgcctcaatgcctcaacaaacattgtagtgcttgaagtctgctaccttaatggtatagcccaatgattcttgatacgtgtcatgtatatcaagctgtaaaacaagatctggagttagaacacttccagcaggttccttcatgcctgttcccagcctgaatcctcctcctcctatcagaagtaaccattattctaacatgtaccattattggttagttttgcctgttcttgagcatcatgtaaatggaaacttgtaatgtctgagataattatttttttatttagaaatactggtgaaaaatatgttttatgaaatatgatagacaataattcaaggggcagtttcactggaacatagatttcatcttttggttttatgcaaacctctgtagaacttaaacaatgaaagttatttgaagtgttctatttctcacaaaaattaaatataccacaaggagggttctctccaggcagatcaaaggaaagttctatagcttactggcttgcttcaagtccagggttaggtagaaattggtggtagtagctttaaggtctttgttcattcttccaaatagagatgtaaccactggcccagactttgggtaaagcttcttttacatatattataggaagctctgggttatttagaaactttataattcaatcattcccagatagctcttgaaaaagttcacatcttgggcattctttatttgtcaaaaataagggaaggaaggtagacaggagaaaaagatgaggtgaaatgcatgtcaaagagctgttgccctaccagagctactcttatccttcctcactgtgttccctccaaacgtgactttaccagcaacactgataggcacccttgccctgtggcttctgactggagcaggcgatgagagggactggaaggcattttgtaggttggagaagaatgagtttagggtattgattttcccaacttgctccctggaggggcccctagggtgactgcatccctctgcccgaggctgtcgcttctctcgggtggctgtctccatacagctaccctccctaggttccagtggccactctcctcctttgccttcagaatttgggctagccacagcttcccaggattgccagcgctaggttgctctactgtgtcttgttggtcctaagtccagcccactcctttgtaacatcctcgaaactactaccatcacattatccagttcgactgctggcatcctcctcgctatgtatagatgaattgatctgtgcactgtgttacagattcctttggaggttagaagattaaggaataataatcttctaatgatttccgttaagcttttgctattacaaaaggtaaatatcctataatattattctctggcaagttgttttcagtaagcttaagtttataagtttcctagtaaagacatcatcccaatattttatgtcaattatttcaatccatgtttcaggttttggcatatttcatctatgctagcatttgccaaatttatctgtccatggaacatttgtgagtttgtaatgtgttcacgtgttaccaaaactggtataacagaaacattcatgactgcaataagtgatcacagcttgatctgtatgttgcacacacagtatcatagctgttggtaaatgctcccatgcctcagtgctctaatgtatgtcacacacttgtgggttgagtggcttcatgccacagcctggcattctgggctatggtaagctgtttcctaaaggcaagttgttgcatgatgacagctgtctacccccttaatcttctggcatattaaaagagtacatttttagagaaaaatactgctagtatttatgttttacatagtaataccttttaatgtcatagaacactagcgtgttttggaaacagatttgggggaatgctgatctaaactgggccatgctgctttctagctggcagcttagttgatggtaaagggcattttactgtagagtattacatcttacatttctcaaccacacggttggaaaaaaagccagaccagtctctattgtgaaaacctggtactcacgtaaatgaaatcttccctcaaattagtcatttggggtacctttttacttaatttttgagttgttgtttgtaatttggtgtaactttctgtgaaataaacccttgcactggaaacttgttctcgtatagaaaacaaaaatacagagaagtaaaaagagcagcagagtctgtttcttaccataaactatgcaggcagtttgagttagtctgaagctatctgttttctttagttttttgataagtcctccagatactgaagtttttgtatgtttaatacttacagtgggcttcttattagaaccagcctgcagttgcccttatctgccgtcatcccaactggctgaacccagatcagtaatttaaaagtctagaatgggttgtttcgatgaattcagttttaacaatatatttgtgtgaaaagagttcccacaggccgggcacggtggctcacgcctgtaatcccagcactttgggaggctgaggcgggcagatcatgaggtcaggagatggagaccatcctggctaacacagtgaaaccccgtctctactaaaaaaaatacaaaaaattagccgggcgtggtggcaggcgcctgtagtcccagctactcgggaggctgaggcaggagaatggcatgaaccctggaggcggaggttgcagtgagccgagattgcgccactgcactccagcctgggtgacagcgcgagactccgtctcaaaaaaagaaaaaaaaaaaagttcccatagacagtgtttgaagtattggcgttttaatgcatgactacaaatgttagttgaaatgatagaaatgtacttactaagtacacattttttgaacatcacatttcaggtcaaatgagcattcctatagtatgaagttaggattcgttaacttaagtattgcatattaatgcattattatgttagaacttttgcagtttatgacagaattttaaatagctgggtggaaaacgtcactcatcttgtttttttattcttcacgttcttaggatgtaccactaaatggatttgtgctttcctctttaaggctttgtttcatagtgtagactagcaaaaggtacagaaataattgatttaacaacatgtctttatacttaaatataaagattacttataaacaaaatatcttcctcaagttctaatgatatattaaagaggcaaatcaaggcaaagaattgtgattgtagtttggtttggtttggtttggtttagtttttgttttctgcaataataaaaaaattgctaatctttttagtggatgcaggttggttgttttaatggtttattgatttctccggatataaagaactttcattatccaggatatatcctatatcatgctatgatacaccaaactatatctgtatctgatatttgtatatcatatctggaacattctgtattacttccatttagacttaaaaattgtgacatacataacataaaatttaccatcttaatcatttttatgtgtacagttcaccaattagatatttatttatttatttcagacagggtctcattccgtctcccaggctggaatgcagtggcatgatcttggctcactgcaacttccaccccccaggttcaaacacttgtcatgcctcagcctcctgagtagctgggtgtgtgccaccatgcctggctgattttttttgtattttcgtagtgacatggtatgccatgttggccaggctggtctcgaactcctgacctcaagtgatctgcctgccttggcctcccagagtgctgggattacaggcgtgagccaccgcagctggcctcaccaattagacttttaaatgcagaacattttcctctaaacacattgatatttgaaaaatgaatatagctaaatattgtatgggaggcagtcattacggaaccaaacagttcccactgtagaaactagaaaacctggggacacggaggatattaggcacttctcaaaggccaggccatgggagaaggctgaaaagaaggagtggttgagaattaggataagtagtccagaggttgcctgcccaagtggggctccccgccctcctcccactctagcagaaaatcgggttgcttttggatggatatgtactgctcaggaagggtaagatatcatactgaaaacaggaaaattgagtggaatatacaatattgacaaatgagacctttagttcctggattccactgatgctggcagccaggctttcacccctcagttagtaagttggaggattctgctctgtgaaactgacccaagagaaagcatctgagttactaacacttaagtgttccttcagtgaaaaaaccagcttgctgccctgtcatctgaaaatgctgtcctatgggcaagccccacctattcagggagtttttccattcagctctatagtgcgttactcatcagcatgaatgttcacctaagattcatcagacatttggagaaagtctccaacatgaaaacagagaccaaaacacacagaaaaaaagaccttcatagaaacagaattatagagaacagaaaaaaatttcattgagaatgataattaatatccttagaggccaagcgtggtggctcatgcctgtaatcccaccactttaggaggctgaggtgggaggggtgcttgagaccgggagttctagaccagcctgggcaaaatagatcccttctctacaaaaaataaaaaatttagctggacgtggtggtgcatgcctattcaggaggctgaggtaggaggattgcttgagcccaggagtttgaggctgcagtgagctaggatcgtgccactgcactccagcctgggtgacagacgggtctgaaaacaaaacaaacaaaaaaattcttaggtaacgttgtagccatgaaataagaacattaggctataaaaaagtttgagaatcaaaatgaactcttaaaaattagcaaaaatttaaatcagcaaaaatttagtaattacattagtgggttagaagataaagttgaaatatgaaaagcaggaaaggtaagaaaataagagtcaatctataacgtttatagccattacaacagaaaagggaagataggaaataaagaattaatgtaagaaaacgtcccagacctgaaggacgtgagtttgtagaatgaaaagaattcacttaatacagcgcaaatgaataggaagagttcacatcaaggcacaaaagaatgcatgttggaaggccaaagctaaagagaagatttcaaagacttcagagaaaaggtcgcttacaaaggtgcaggaattaaaatactgtcatacttctcactaatagcactagaaggtagaagacagtagagcagtacctttgcaatagctagggaaatattgtccaactcagaattctcttcctttctgaaccatcaagtgaagggtaaatataggctaatgacatctcccatgcacacattctctgtagtcattatcgtcatagctgacacttaagtagtgcttactgtgcttcccttcagtactttacagccacaatatgagatggacactcacatttccctgttttgtaagtggggaagaggcgtagagaagtgagttctcaaggtcacatggctagtcagtggtagaattgggattggaatgtgggcagtcttgactctacctgaggatgtcctccatccaaagaaaaagatccaagagctgagatccaccacagagcaaggcgagaggaatccccaggctggagctgcagggatgtcatgctccaggatggtagcagtacaagtgggtccaggttagagtagatggttgaaggactccaggaagaaatggaagagcttatattccctggcatgtctgatcagatcctgagtgatgtttgggcatgtgagggtagtctcatgttggagaatggattagaaaaacaaaacaaaaaggggaaaaaaacttatgagaggtcatcatcataatatgttatgtgggtttgctttgaacgatatttgtgtagcctttataaggaaaaccctgaatattgatttcactaaaaatgtggtttggggaggatgtgggagaaagtgcttttgaggcgtgtgcgtgcatatgtggggccagtggacagtggtgtaagagtgagatatcctctgcttcatagtaggaagtcaggagatatcactaatatctggtggaaaaaccaagcactgtcagtatagtatttagaaatgtggcaataaatgccagaggaaacacttaaaacgttggaaaagggttgcctgtggagagctggaattaggatttggaaagagtgaggtagaggactgctattatttgttacaagaatcgtgtgatttttttttttttcccctcaaacagtgtacacagaaaacccggaattatccttggcttttttcttcctgtcacaacccatatcctatccatgtcaaagcttgatggttctatattcaaagtatgtctggagcccgatcccttctcaccaccttccttgctgccactgggtccagccaccacctctcatctgaattattccagtgtcttctctctggtccctgagtttctcttattgctcctctccagtttcttagcagcattccccagactgatccagttcacatacagtcagatcgtgttgctctgttgttcagaaccctgcaggggcttcctagttcacagagtccaagccaaagtccttcaggttgccccacacgtccacttaccccacttgcctgctttattttctccaaagcacttagcatcgttgaaaatttttttttatgaatttattttgtttcttgcctgtcttcccttaccacaattcgatctcaggagggtgggattttttctggcttcttcgctactgtatttccagagcctagaacagtatgtatagtaggcactgaataaacatttgttagataagggtattgcctttatataaataaaaagccaattaaaaataccacaagtttttaagccatttgccataagctaagctaagcagctcattgttttactggcttaagcatccataagcagtttgaaactgaaatcctgaggggtctaattgaaaagatttgtttccatctggaaaataacgatattctgtcctgagattacacacctatctctgccatgcactctcaaatcttttttacaaaaatgtatcataccgctctgtggtaactacttatgactaaaacaattgagtttcacaacccttggcagctaagatttcagggagaacactagtatatgtttttaaatcatagaatctgcttagtgagtataaataggcatcacacacgtcttctgtaaggagcacacacctaagattccaattcttctgacatggggaaaaccacctccaaggcaaaccatcagtttgccttccgcttgcgcataacaattcttgccatgctctgctgctgagtgaagctatttgtatttcatcagggtgttctcttgcctgactttgcccctcttctcacctattccttcaggaaccttaagatgccaaattagtgctatcatctatatttccatggctaccgatcaaagttctgcatacacatgattagaattcacagcaggataagctggactatgtgatggaatggtctttatcccaaagcaaatacctgattacacagggaacaacaacaacaaaaaggagccaagtgaatgacgtgtgcaaaagcccttcttgtgaatcagttgaaagataacctccctccacacccctaattcctaaatctcataatgtgggcaatccttgaatccaccaaggactttaaatacttcacagtcttgtttctctgatgtggaatctgttagattatggctccattcatagaagtatgtcatttgtcccttaatatcctcagggattggttccaggaccctgcagataccaaaatctggatgctcaagtccctgatagaaaatgacatagtatttgcatataatctatgcacatcctcctgtatactttaaatcatctctagattacttacaatacccaacacaatgtaaatgctatttaaatagttattatatgatatttatttgtattatttttaattctttttttgttgccgtttttttctgaatattttttaaccagggttggttgaatccatggacacataacccatggatactgactgtgattaatatttgtgttgtctgcttactatgggaccaatgagattttgcagggatttttgtgttgtttgtttgttttggtgattttattgagcttaacaggtgttaagttacgtagatttcagtaagacctttggcaaagtctttccttgtaaacaaggaaatgtgtgtgttaatgaattgcacagtgaataggattcattgctggttacagactcttcccaagatcgttttggagagagctcaatcgtggtgtgtctcaggtctctgcccttgccctggcctgtttgcgcagggtattgagtatttggataatgacttagaggacatgtttgccgagtggtggatgagaaagctaagaagaataactaaagctaaatgtcgaccaaggattctgaaagatcacagactgaaggatgagttgaaagagacaggatgaaattgaatagtgatagttgttttcatcagcttaaaaaatctaactataaagttatacactggagaactggccaaactgctgtagagacaaaaggcacttgaattttgtgagatcggtgggaattaggtgtgtgtattgtagttgtctaaaaacagctaagggtcttggttacagttgccaagatacagaacaaaagtagtgcagtgactacttctagtgaattctgcaagaatggccaggtcacgcttggaatgttgtactcagtttttactgacatattaaagtggttttattgtgtaatatttggtacatacaaaagaatacatgtaaaacacaagttataaagtaagtaataaaatgaatgtctaaaagccttactcccagtttaagaactagaacattctgaaaaccattgaaacaatattgtccttccatactccagaagtaaccattaccttgcacttaagtttgtcatttcctttctttttgaaaaacagttccaccatgttatatgtgcatttctaagtaatacattttttacttgtttttgaattttatgaaaaggatgtcactgaaggtagtaacacttcatgccacttgctttttactttcgacattgcttctaagattcatatacatcggcctttcccaaccagagcccctcatcttgaccacagaacacagaaaataattggagtgtattttctcagtcctccaaacatgatacataaatagtctcctaaattttagatgcataagggagaagttatctcgttacatacaatggatgccttaggctgggcatttggagcttaattctctattggaacctggttgagactggccgaattgttacatgtagctagagttaattcatttttactgctgtaagatatcccatttgtgagcacactaaagtttttttcatatgtcctcctatggatggaaatttgggttgttaccagttttttggttttgttattgtgaacagttctgtgatgaacattcttgtgtggacctgcaggtgcacaagaaaaatttctctaggcatacatctgagtgaatttgcttgggtctgctgcattttatggggacattgacaaactgataacgagttcagaggaaggcagttaagaataatttaaccatgtcataaccaacctttgttttccttattttcttagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaggatggacttaattatttcagtaaaatattataatttgcctattgtcttttatgtaatatttatataaaatatttttatatatttcaaaaacatgggaccattgaatgaaactttatagtccttaaatgttgctgaacttttgctgtcttgcaatagaatttgaatgtaaatattattactggtataactcaaatgttatttttcttgcatttcaaagcttgcttttatcttccaagaagtgtaaattttagtatttgtcatctctcaggacagatacaattaataggaaatagaagtttgaagaaacagagatggcacatcatagcaaactaagttcaaaacagaataaccccagtgcatcaaggttaaggtgggacagtggtttgtgatgccagggagagtggggaaattgtgatgatgctggtagacctgggcagactgtgttcccagccacacccgccaacagaggaggaaggtgctggtactgatgtccccacccgagagtctgtcctggccttggttttccacagtgagggctcgttctaatgttgcacaatgtcatactcagatatcactgtgacctgttactatgctttagaacccgagaggcctctgttcacatggcagcatgtgtgagtggatgctcccggagcaggtggagtggtggcgctggatagcggtaagagcgggggctccaaaggcagaacttccagcttcacatctcagctctgcacctgctcgctgtatgactttagcaagcaactggatctttctaagcgtcagcttcgttgtcttaaatggtagttggtaataatagtccatgcttcgtagcatcacttttgtgttcaagcagaatgctgagcacactggcaaataataagagctcgtaaatattagttgttgtgtcactgttgtcattagagggaagccagagtccctttcaggagccctgtgtttaggggcagtgtgtcctcacaaaacaataacagtaataatgatggtgttagcagcaacagcagtaatcatggaaacgttgattaagcatttactgtatctgaaccctgcggctgttcctgctttcagccacttctgcattgagaagggccggggatgtggtggaagctagatgtcaccaagtagggggatgtagattcacagcggtctattctggttcctcttgggaggttcaaaccttggggaggttcaaaagccagttttggccacttgtgctcttctgctgtgcctagacaggatcgtttctgatggttatatgcatggtggtggctgaggtccgctgtctggaattgaattggggttccttgcctcccactccctcatttggaaaccttttcttgttattaaatcagttagagggggccaggcgcggtggctcacgcctgtaatcccagcactttgggaggccgaggtgggcagatcacgaggtcaggaggtagagacgattgtggctaacactgtgaaaccctgtctctactaaaaatacaaaaaattagccgggcatggtggcgggtgcctgtagtcccagctactcgggaggctgaggcaggagaatggcgtgaacccaggaggcagagcttgcagtgagccgagatcgtgccactgcactccagcctgggcaacagagtgagactctgtcccctcccccccgcaaaaaaaaatcagttagagcttagtgtaacttaccagcgcaagtgagagacagactttcgtaagatatgacagcaatctagattttttatataggacctatttataaatattgttgaatgagtactctccgagttactttttctgtattcaccatcaggtcacacagtagagtagttcattaatttcttgttgtcttctgttttgcagttagttaatgttccatataaagaaactgtcatgtgacaccagtacctcctaaaattggtcagtgtggtagatggtttagagaaaaaaggaacctgttccacagggctgtgaccattcgagggaag

SEQ ID NO: 16461 - DNA, 40237 bp, Human
tgctctaggggtggtgacagtgatccggaggcgggaacgccgggctggcattgtccctggagccatctacatccagctggctgggctggagtttggtgtggcttccagtgttcactgctatgatgctgctatcaggtcagaatgtcagcagggatttgtctaggctttactgtctccccagcattaaccatagtgcctggcacgtagtaagagctcaacacatattcagcgcatgaatgaggggccggcacttacggagctctcactttgtgccaggcactgtgctaagagctgcctatgcattcccctggaattctcacaaccacgctgcagtaggtccagtgagtatccccattccagagatggcgaaactaagccacaaagaggatacataaccagcccaaggccaccagtcaaggaagtagcagactgggacctgggcatcctggcaggcaccctttaccataatgcctctctgtccccatgtggtccctggggtagagtctgcatccttgggttctgaaactccagagcaagcactctggggcactccctgagtgataccctcctgccatcttaaacggctctctgccatctgcttcctcctcctaagtggttttccttctgtcctccctgtttaatgtttaagttgtgcacatcctgtgacatcctggagacccatgttcctgacctacttacctattcaaccatctcttctcacacatggggtagcaatgagaagcacagggggtctctgcaagggagtagggaggtggagagagcgggggcagccacacatcacactgctgttctcagtggcctcctgctgtcaacaagctaacattaataaaacaaggccactcttctgctaagagactgtgacagggtaacatttattctaggtagcttttcaagaaaacagctcttgctcccacggtcccctcggagggcctgcagagctccagcgatgtcagagggcatctgtttgtttctcctttgcttataaaagggacctggaaatcaaaggcaggctcttagcccttagcagtgaggatgacagctctgcaccagccacacgcaggcccctggctctaggaaccacctctcacccagacgcccaggcacagcatggtggggagagagtacaggacacagggcctaggcctgctgccccgcccacagcccgccccctagccctttctctgaggccaggtgtactcacctagcctccagggtcccctgctcaggtggccccagaggcccaaacccactgctcccactttctgagacctgggaccctcacctccccaactcccaccatagggcgacactgaaaagtgtccccttcccccccccgtttccaagtcaccagcttgaggatgcccaaggctcaaaggctcctccgagtggcaccccgcatcgggctgcagaggtcggagaggggaggggatggtgggtgcaaagggtggcttcttcaggaaagggaagcctgtccctggctcccagcacctgtcacccctggcgatctcaccccgcggccatcattcccgtcctcacggcccatttcagggacactgaggctcaaagagccacgtgatttattcaaagcagctcgagccaccacttggagccacaagaaagccctggtccgtgcctcctcgccttggtccctggcccttcactcttcgtccaggctctctgacctctttccctctgcgcccctgcctcttccccaggcctgggtccccaaggcactcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccggacggggtaaactgagcggcggcggcggggcgctggggcggagactgcgacccggagccgcccggactgacggagcccactgcggtgcgggcgttggcgcgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccccggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcgggtcaaaaactgtgacatccgataagacccagaacttatgtttccccctgataatttcccgcatcctcttgcctgctttcactgcgatgaaaaagatttctgttccaaaagagaaattcctaaagttcaaaattacgtgttagaataattattgggctactcgaaaaggcaggttagtaatttggtgtagtacctaaaagagcaagtttcgatcccttactccaaaaacaagacatttagatatactgtattagtgaatgacttgagatggaaatatttcaggaactattgcaagaacaatttgaacaatcttggttctattatttttcctatagtggaattttgaaaaattaaataatcgaaatccaggtcccttaattaggcccattaacagagaagtatttggcatgcatttccttaaaaaaaaaaatcccagtttttaatgaatgaaaaaaaaatcacgactcatttagactgtaagtggtgggagctgtttcctttctctccatttgcaggttttctcacagcagttttcagagcatctgataggtttcatctcgaggagttatcagagccgtggagctcatccctgttcagtaccaacggcattagttctgcttcggctcgaatgctccattggacacatgtgctcacagcttcgattatatgtttcacaatttaatttgtattttttgttgttgctttttattttggtttttgtttgtttttttgaaatggagtctcactctgttgcccaggctggagggcagtggcacagtcttggctcactgcaacctccacctcccgggttcaagtgattctcctgcattagcctcccgagtagctgggttaccggcatgccccaccaaagctggctaatttttgtatttttattagagacaggattttgccatgttggccaggctggtcttgaactcctgacctcaggtgatctacccgcctcgacctcccaaaatgctgggattacaggcctgagccaccgtgcctggcctgtttcagttttgctttttccttgtgaaagccttaggaattcttaaatcttacaagttgtaggaaaaattacagattcccactcataatagaaggatgaagtgggcctgttgcagaatttccaagttattacttcctgcaggttaatttttttctaagacacataatgaagtgtagttttctgtttccttgattcattcatttgaaagtcttttgagcctctctttcttagaagcactggttgactccaggtcagcactctcttaacgtcaggccacattttgcttttctgaaatattccttgaaggaacaatgtggaagaaacccacaaatgacagaatctctgggaccagtcagttcagcacagcagctgccttttgagaggagacagttctcagggccgttgggggcatggttctttctagtgagctaagtaaagtgaacttgctccaatgtcgttatagacatatggcacagggctcctgttttggggtagacctgtcaccctctggacctcttctggcatttgacacaaccatagttttgttgttgttattgttgttttgtttgtttgagacagagtctcactctgtcacccaggctggagtgcagtggtgcaatctttgctcactgcaacttccacctcccaggttcaagcgatcctcctttctcagcctccaaaggagctgggattacaggtgggtgccaccacgcccagctaatttttgtatttttagtagagagagggtttctccatgttggccagcctggtctcgaactcctgacctcaggtgatccacctgcctcagcttcccaaagtcctggaattacaggtgtgagccactgctccctgccgacacaaccatagttttttgctggcttttttcctggagagggtttcagtgtgatcaccaccttgccattctgctcttatccccagtccccatcatcccaagttatctgtacagcattaagcatgagaagaatgctacagaaatccagacggccaggccagtgcacactgcctccatctcagacagcttccagagcatcttctcctattatgataactcgactatggtcaccgggaatgctaccagagacctgacacttcatcagaccgccacacagcacatggtgaccaacgcgtccgctgttccttccgactgtcccagtgaagacaaagacctcctgaatgaaaacgtgcaagttggtctgttgtttgcctcgaaagccaccgtccagctcatcaccaaccctttcataggactactgaccaacaggtagggcagactactttagtcaaagagtttgatatttgtatcagtcctagcttatgtccttcctggaattctgcttcttactcattggtgagagtctggaaaatccatggtgggtgagctggggaaaacccagtccccttcccctatgtctctgttcccagataaccacaatttcctattctattctcccttctgttgctcaacaagtaagaaaatattaaagaagacagaataaagaggacctcttccaccaagtgggaggactttggcctgtctaaatgccaggtttcgtaagtgcatttgtcagaatcgcccttggcagcaggaactctacagccaccatggctgtcatcctattttatgagccatgtggcctcctcttatctcctacctcaggccatgcacttctctgtagagagccaaggtgtcttcttttggaactggcatgttaaagcctctcacagataccaggtagggagtgtgggaaaaggttggacgcactggtgcgcagatggagctccgagttgatgccgaggtcatgggctgtgttcttcccttctgctggctacgtagccacgtccacgtgcatgaaaggaagagaactgaggctgttgtctggataatccaagctgcccaaactagcttcagatgaatcaggctgttctagatttttttgaacccacattgtttggaataactgtttacttctccattgttggtgaagtgtttgttcttctgtagctgaggtggaccagttctgcctggtccgtgggggctcaaagctcaggacaagggccttgcagctgagaggaggaggcaggcccccaaggtgtcagtgcaaggagtgggagctggtacagttaagtgttggtggtgggctgccaagtgcgcagtgtagctacctaggtgaaagttacaaaacaccagaaatggtggggaggggtgtgcccagagtcctacctgcagaccaggcccagaagcaggaacaaagactagactagagatggaagagatggtggcgaggagagggtggaactaaggaggcaggggaaaccagggctgggctaggctgtaagaggccccaagtgctgggctgagaaaggagtgggattctgtgtggggcagttgggagccattagaaattccaaagccaaaaagaaatgagtgaatcaagcactattttaagcagggtaggtgggcagggagcagggagaacttcacatttcctctgcctttggcgtggggagtggggcgcaggactggctgcataatttgtgggtctcggtgcaaaatgaaaatgtgtgccccacattcaaacattatgaaacacttcaaggtggcagcagagcattaaatcaaccaagctctgagagcagagccctgtgcgactctagggttaggggcaccgagaggtgaggaagcctggggtggtggctggggctcaaggaggggatggcagatctggccttccgccagcacaagctgccttggacacatggagcttgagtcggacaggagcacattctcaacatctgcagttgaattttctggatggaagggtgccattgaattgatttcaacaatctcaagccatgtccagccctctagtctgtgcagagcaatattctaaggctgctacataaaacatgctaagcaaattaacccagcgaagggctgactgtgagcccattaagaaggtgacattcagtgactcctctgttctcaggagaaaaaccaaaccgacctcagtagttgcaggattgttttctttccttttttcaagactaagaatgcttcttaaaatgcatctggtataattacagaaaatagctcagggttttgtattctgagaaagcaaacagctcaaatattgtatgtgaaaattgaggacattatcgtaataataccttgccaatcacttgggtggaacgttactagccgtacagtgtaatacttagaaattcggctgaaatgatgtgagtactccaatcttccaaacgcaaatggcaaatgaaaagcttttttaaaaatcccattcttatttttaatgctttgcttatgccatggggaagaggcttgtttaaaaccagtgagctctttcccctgttaaatactccaacggctttgaggctgtagccacaccaggctcatgtttgggacttcaaaaacattatcttccattttgtgacttgtgaaatttagtctattctcatggtgagtaatccactttagaaattatctagagcaaaattgtaatccccaactgttttgtccagctaccgagcaaatttgaaaatgattttctagtgctgcctggtaatatggaaggacaaacaaatttttttttctttttttttgagatagagtcttgctctgtcacccaggctggagtgcagcagtgtgatcttggctcactgcaacctccacctcctgggttcaagcaattcacatgtctcagtctcctcagtagctgggattacaggcgtgcaccactatgcctggctattttttgtattttttggtagagacgaggtttcaccatgttggccaagctggtgtcgaactcctgacctcaggtgatctgcccacctcggcctcccaaagtgctgggattacaggcgtgagccaccgccctcagcgagcaaataaattttcatattgtgatcctgatttgtaatttgtctcataatttccaagcccagtagatatgaatttggggactgggcagctcttctggacactccaagattctgcttcccaccgcagttcagatggattcagagaagggacaaatgtgcattccatttgcctttaattgtcttcaaggagttaacttgtgagccattgcaaacagtcttttgatgtaaactgtgccaatcacatcctccatgagcaagatgtatgactcaagtcttcagtgttgtaaacaaatgtgtttaaaggctttttaaaattggttaatatgtttctgattaaagagtagttaaaaatatggagcatcagagcttgcagagacttttcctgaaagcttttgggccagtcctagcattttataggcaaaggagtttgcagttcaggaggagaaagcatttaccacaacagtggcaggactgtagccacatgttccgactgtcccatttcaagctttgttcttccccgcttcctgttcttcccacctgcttacaattatacagcttgtacctttagctactagaaataaagaatgcagctcaaaatctgtctttcttgcactgacttgggctcttcctggttgtaccaggcagaactgctgaagacccagtgagttgctgattttgctacttttaatcaatgagcagagagtttagaaaagatcagcctgattcctgtggacatggaacctccctggtccctgaaatattcagtctttttccagtccctgatgtgaactggtccagcctcgtgcatccctaaagatgtgtggggaaagcttcctgtagtcaggctgggcagagctattcttttccaaagctgcttgttttaactgaagtgggacccactctgaatcgagacattctacaccacaccacaccataactggaatcctctattcacagtcgtgatggtgccatgtgtgtggcttttgtgggtaggagtcacaaaatgtaggccgcctgtttatttatttatttatttagacagggtcttgctctattgcccaggctggagtgcagtggggctatctcggctcactgcaacctctacctcccaggttcaagcaattctcctgcctcagcctcctgagtagctgagactacatgccaccatgcctggctaattttttttgtattttagtagagatggggtttcagcatttggccaggctgatctcgaactcctgacctcaagtgatcctcctgcctcagcctctcaaagtgctgggattacaggcgtgagccaccatgcccggccctgtctgttttttttaaatattcgataagttctcacaccaaaccctgaaaatatagagtaacaattcttgggttcatttaactgctaataggatgcacattcttcctgtttcatttgttattcagatcctgtatttctgctgaaaatatatgaccagttaggtggcaaaaacctttgatttgggtgtgtgtagtgatgacctggccaatagcacactttccaagaaagcctgaggttgctggattgacctgatttccatgttggaacctcttgcctcctattttataattttggctgaactattcatttcatgattgcagttgtgtgcaggtggtaccagaaattatactagtgatacttggtcatcatttggtctaagaagcaaattttagatatatatgtccataagaggaaagttccaggcacatgaacaatgggacaacacgtttacatttctctcttccctcagtcaggtaacgatatggcattgtggtcttgcttagcataaggttgaaataatagttgcatcttcagaaccaaaagatattccacaccaaacgactggcttgggaaagagttaacttcattgctggggaccgtttcccttgcttccttcttagcttgtcattgtctcagtgatctgctttttatcaagccagcgtcaatggcttaatttatttccatagttacttagtatatttgaaagcagttctttttgcttgcaaatcttagctaacatctgaacgacaaggaggaagccacagggcatgaaatctctacgaaatctaccatggttttattttatttttttgctagcttcagccagtgggtctgaagtgggctgtgtaggaacaagcagtgaccttttcagcttctctatggacagggaaaccggctgttctgagaagagatctcccatcctgcatgtggttaggatggtagggagggcttgatgagtctttgcttctgaaatcagaggaaactggctgtggaattagaacattcctaggagaagcaaaagctctgttaagctatgtgtcagagaacagggctcacgcccaggaaagtgagaagtccgtgccccctggaattctctggtagctgaaaaagacaagcagaacctaagaattttgacaagcggaatcgaagaattttatttactaaatgattgacaaacctcctactatatccaggcaaattgaaaatatcattccatttactgacattcatttactgcacaccttttaggagtgtgtagggatcactggaagggagctgttgtctctcgttgcatctggtgatagtttgcacccttcggggctctgtagtctgtatgcttcttgtaatttaccacggtagaggaaactgtggttttagcaatcatgagaagagagcttccattagtctctatggcaaggataagctaattattaacactagagaagtattgtcttcattgaccatttagggacagatggggtttctccaatgactaagtatatataattaacataacttttattgttttacatgtttttctagggattcattatgtgatttttagtcttactcaaatggattaactgcttcgtgatgctctgtagaggatgactgtgggccagtatgacatttggctaaaggtttgctgaatcagatctggctctgcttagcaatactttaattgagaaggccctgaattgagacaaggggggcaactcagacacagattgtgactaatgtcagttgagtttctgtctgtttaggagatactgtggggaagcagaaagggtttggtccttctgcccaccactcaatgactagggacgctggacgactctccttctatggtgggtgcccgaggggccagaagagtttgagaacggagacccaggagcttcccagggagtcttctttgccttgaagccgagctctggggaaaaatgatgcccagcgcttaccactgagcagcccatgcagtggcttggcctgtgttgaaagtgcaggcacaggtgtgtccggtactgaggaggcggcaacatgagcctggttgtatctgaagccattggcttgctctgcagccatgggtgagccactctgtctctgaacctcagctttctcatctaaggtgagggtttggactggctagcccttgagtttccttctagctgtgatattcgtttattccatacatgcattgttaaaatcccaaagaaaattaaaaagaaaaacagtagctgcagtgtttctaaagaaaacacagtacctcaaatggtaaaaagaaccctctgtaggcacaaacgctgtggttttcagtgaaactgtgcactctccatcccatgtgctccagcgtccccacccaggtgcacatcagcagggcctagcacatgttaacacactcagggtatgcctgtagccttgaatttggggcaagtaattcacctccccgagcctcagtgttgatcctctgaaaaatggataaaaccagctaccctcccttggaatctcaggccacccagcatgctggttccctgcctacagtcgtgggaatgtctgagtcttcaggtagggagggacctcagtggcttccagcccaccacagctgtgccctgatgggttacctggaatactggctggactgaacagtgggcacagtatggctggtggtttgggggccacagacaagggttgccacattttattgagttttgtcctgaaaccacccagtgtttctgcctacagtctgggaaagggccacagatgtcttatttgccttcagggatgtccctgcagcctgaagggttccatattagagccttataaatagccaaaatgaagaactggtgaaacaagagtgaagcccctaattccaatagctttgatacgtattggtacttcaacaactagattttccaaatatatattgaacagagggagaagcctgtgtttattccaggacagcccggaagattgtcatatgcccgttctttcatgggacaaactgtagttgctgaaaataaattgcctgtgagttctcctctctgagcctcctggacgtttcctgattcagtatcctgcagtgccgtgtgagcccccggtgttgggtttcttttgtccacatgaataaggggtacagagaatcagctctgggtgggctgagacagaagaagctgtcacccgatggccatctgaactgcaggtcagaatcctggcatcttctctggtttacccaatttgcttggggccccactttgtgaattacaagctcatctctgttcacagcaggggaatctttgcatggtttgtgggaggggactgactgtctgggaatctgtcatgcttgtgagttactctctgtatttttggtatttggtttctggatacaggtgaagcagttaaaaaatatttgaatatggtcaagagaacttttggaaagattctatttaaagctatatatgccgtttgggtactggcggaggtggtaaaatttacaaggaaaagccatgtgggaatggcccaggcgaaattagtctgatgacatctgataagtaatgacagatatcatgcctcagtttcctcatctgtaacatagggaggtgaaatagggcccttattaaatcatgactaaatctggtgggtgtaaatgcttggagaactgagtgtaaactttaaatgaaggcgctatgattattttttatttatttatttatttttgagacagaatctcgctctgtcacccaggctggagtgcagtggcatgatctcagcgcactacatcctctgccttctaggtttaagcaattctcgtgcctcagcctcccaagtagttgggattacaggtgtgcactactatgcctgactcattttttgtattttttttttttttttttttttttttttagtacagacagggttttgccatgttgcccaggctggtcttgaactcctgagctcaggtgatccgcccacctcggcctcccaaagtgccaggattacaggcatgagccatcatgctcagccgattacaattttttattaaagcctggaatggaagaacccttccaggctgttgccagagctcaggatgcttggcccttctgccttcctggattcatttcattcctctccaggttcctgagggtccagagctagagacagaagagacttagagatgtttcaggctcttctgggttggagcaaaccttcaattgggcaagagctcagccactgttggcttcctctcaaggcagaggggctgggaagctgcctgtaccctcatgccccacccacagagcagggacccagctgtctacttaatccagcagaaacagaggacaaagaagaaagagaatgagggaggagatgacatttcttaggcaccttctatgctctaggcactggtgttaacagtttaacatccatatctctttctgtactccagtcctgggaggtgggcggtggtctctccgagggactgagaggagacctccctagattaagtggcagggtcatgtgtccagccagacatggcataggggaatgccagggtctttccaccagccctgttgacctggcgccagagtcctaggtgagcagtggtctcacggagcaatttggattttgaaattttgcacagaaaatgagactttgtctttctgggttggcctcatggggtcaacaggaaggcagatcttaacatcttgcttcctaatgcctcttagacatactgcagtctgccagtggaatcacttgatggccttttacccgaatcatttgattgcagtggctcctttgggagagctttagcaaagactataattaaaggaatcattttttaaaaatgacagaaataggggccgtgtattttggatgtgttctgggttacttgccaatattgtgttaacatttattccaaacaaatttctgttcacagtggcagtccataaatgtattcacgttccaagacagtcaaacacaaaaaggtcacataggaagcactgagtatatgaattttcagaaaagtccaccaaacacttatctgtctgatcccaaagggtagccaggcgaaaatcaatataaagccttaaaaaaatagcctgcagtcaccagatttgtctgatgtttgtgttttgcagaattggctatccaattcccatatttgcgggattctgcatcatgtttgtctcaacaattagtaagtgtgtggtgttttccttctgagtgtgggtctcatcagggtgggcattgatgcccatgagccgggaattaacaatacaacctaaggacggcgggggggcgggggggggcgtggttggctcatgcctgtaatccgagcactttgggaggctgaggtgggcggatcatctgaggtcaggagtccgagaccaacctggccaacatggcaaaaccccatctctactaaaaatacaaaaggtagccaggtgtggtggcatgcacctatagtcccagctactggggaggctgaggcaggagaatcacttgaacctggaagacggaggttgcagtaagccgagattgcaccactgcactgcagcctgggcgacagagcaagactccatctcaaaaaaaagtatatggcctgggaggtttgtgtattggcaacaattgcagaaaggaattgatagctttttacggaacaaaagcacagggtggctaacatgcaaatgctccactgggttaaggggggcttctgaaacgttcctgtttgggacggttgtgtcccagcagcactgatgtgcggtcttggaccccctctctcggcagtgtttgccttctccagcagctatgccttcctgctgattgccaggtcgctgcagggcatcggctcgtcctgctcctctgtggctggtaggtgtggaatgcctgagtgagttcgtgaggggccccttgcagagtgagctggactcattcagggaattcaggtattggtggtggttggggtgctggggattcttggagaaggcacccactttcctcttgggttctgcttggtcttacattttagtgaatctgacaggtttgggaagatcacaaggctggctggagagggaaggcgagtcacgcattattcttttgctgttccccggagctggcctgttgactatttctttccctgtgtagggatgggcatgcttgccagtgtctacacagatgatgaagagagaggcaacgtcatgggaatcgccttgggaggcctggccatgggggtcttaggtgggtaaggcccctgtgtaggcaaactggcaagaggggcctgcctggtgctggacagcggcagtcctcgcccagtgaccctggcgcagtttgcactgacacagaggtcccctttttatttttttcctttcctgctttcatggagactttgaaaaatggtaggaagagccctgagctgggggtggaggggatcaggacttcccctgcctctgccccaaacctccctgggcccagatggaaaaccaaaggttgaacaggatggtctgccagaccctttcctcgggaacattcagtgagttgtgatcacggagaaccttgctttctgggtctgcctcccccagctgccctggctgacttcccagaccaggggacaaacatcttccctgagagggattcagagccttttccttcctcttccgatttcccgcctgcttccaggagcctgcagccttgcctgcgctggtgtacaaggagcgaagtctctgtttacacattttcctgtgcagtggaagcagcccagccctgggcctggatcttgtttctctcgggcctttgctttcagggtgacctttatagactcctgcccatttcttaggaaaaggcacttggaggaagttgccaagacaactgaactctaaccgaacagaacaatagggcagccaccccaaagccttattggaacaaagtagagagagaaacacaagagtcaaatagatggttctagtacagggagagggcatgtgtcccaggggtggtgtccccactttctctccctgcagtgggcccccccttcgggagtgtgctctatgagtttgtggggaagacggctccgttcctggtgctggccgccctggtactcttggatggaggtgagtgagtccacgtgggcgccatgccatgaccttggcatcgtgctggcacgcgcttgggccacacctgctttctgaagaggggcttgtcttttttatttttattttttagctattcagctctttgtgctccagccgtcccgggtgcagccagaggtaagcggctgggaatgagggccctgggggagggggcatggtgctgcttctgacccgtgtttttttcttgacagagtcagaaggggacacccctaaccacgctgctgaaggacccgtacatcctcattgctgcaggtggggctctgtgggtcttctgagtcaggggaatgcgaggtgatggccgcgtgctggaggcaggggtggatggccagggctgattttcgttttgctgctagaaatgttgggctatataaaaaaacagaaaaggcaaagaggctacaagtcaaaggaaatggttttcttccgccattgctttctgacactcagccaaggccctttttgtctcatttggggaaaatcaaaatggcgtatgctgggctctgcagagctgcctgggtcctggggatgcccggctgggtttgtttggagctaagcttgcccactgtgtttgtatggaaggccatcattgtttggccttgaactttccggaaggagtccttggcctcaaggcaagggtccccggtgggcagtctgactcaccttggcatatatgaatagaaactgacagcagagccccacagggaccagaggggctcccttcttgcagagagcatccctgccgagcagcagggaggccgttcaaacaccctttggctaaaggacatgctttggcctagaggggctaaaagaaagcactggggttttgtgactcttgggaaggataatggtctgcatctatccaagggactgttccccaagactgtcccagtggtaggaggctgcctgctttgccaggccccgggctgcctaaccagggaccagccttgtgtaggtgttgctgggcctcagtaccaaggtaagcagacccttggggtcaggccaggagaaggtctggctgcgcgctgatgtgttggtctctggggcagcctgcactgtagcactagacccagttagggttagacttgtctaagcacggctccctaacacaggtaggctggagggcgcctgggagaactgggcaccagtagttaagttcagcctttgtcaaccctcaggctggttttgtttaacccttctgctgctggatttgattagggcagcaggtatgtaaccctggccaagaccctgtctatcatgcttgctggccaaagggatatggaggtggcatggtgacttattcatgcagtgacgtctgcaagatgcagggggcatcccagagctcagatgcttctggaaccctggcatctgaggtggggacgaggaggtatggtgagggacgggggctccagaaatgtgatttcctgaacctcgggcacgtctgagcagggctgtgcagcctgggcctgtcctgtcttgggcttccctggaacctcactgcctagtacctgctcacaggagacacaaagatgctacccagcactcctggactgtcatcgacacttccagacagcccgactggggaagggagttgagagccaagtggctgtccacttgaggggagtcctgccattgatatgctctgcctttaagtgtcatgtcgaatgaacagacctttcttcaccatatgtgcaccttcatcacgattgcacaatattctttgaatttgttgtagcaaattagaggttccaagaggcacaacacgggaagttcccagaatgatggagaacagttccgtgggtctttttccagatagttctatatttacaaagggttctggttaagagatcatgaatatttgcataggtgcccttatgtaccgctgaaccccgccccctccacctaacggcatgcctgtactgaatgcacctgatcctgcttggattttctggcatttctaggtatcattagaaatgcccacgtatattgcacagtaaaacacagatgcgagagcctcaggctgccccgagactgtgtgtggtctggaagtggcctgattgctgggtggccccaagcaagctactgcattaataaactgggcttcctttcttcattgataaaaccataattgggtaggttaaaccaaaggaactctagggctgcctccagtccaaactttgtctctgggattctagttgtttaaaatgaggacgacgacgaccatgatgatgatgattatgataaacagcctttgctgtccccttgatatgcgatttatcctttacttaatgaaagtagaagttgcggttatctgagctgtaggcgcatggagtctaactgtgcctggaaatgagagaggaggcagaagccactacaaagccctttcctcccttacaggctccatctgctttgcaaacatgggcatcgccatgctggagccagccctgcccatctggatgatggagaccatgtgttcccgaaagtggcagctgggtaaggactggggtgggctcttctgattcaagagcatttgtccccagggcagcctttgtccccagggcatccctgctgagttgcccttatggggatgataaagtgattgcttctgtttgactcttaatggggtcattgcttagggcagccttggggtctgtttgttctctggtttatccatcatccctgaggggtgcagaactcacacagacacatcagatctgggcagaaatgagagtaaaaatacagtcagcatcttcccctgtttctgaactggactaactggacagccataaaatttatgtgaaagagactaataacaaactaattgttaaaaggattaattcttaaaaagtatttttaattttgaaaagtaatacatgcttattataacaaaatcaaagtgtgctgattgaggacgtaaaacatttttaaatttcatgctcatctttctccctcccccagcccatctcctgtgatattcattgttaacagttctatgtctttttctagatggttctgtgtttaccaccctattgcatgaaatgcctaaaaatccagtcaagtgaattttgccatttacatcactgtgtgacctcttgtttttccttcatgcaattttgtggccatgtttccgtgtcagaacaagtagatttactttttaaaactaattaaattttatttttttatcaaagttacacatgtacataattgtaagtcaaagataaaagaattataaggaaaaacagctgtctttttcccacgcctcttgatccccaaagcccttcagattccatcaccttcaacgtttttagatctttcttctgctgatacccttatgtctctaaataatatgtgtacacccccgactctttttttttttttttttgagacaaagtctcactctgtcacccaggctggagtgcggtggcacgatctccactcactgcaacctctgcctcccgggttcaagcgattctcctgcctcagcctcccgagtagctgggattacaggcacgtgccaccacacctggctaatgacaccccctttttaaaaattttccaatttctgacattgtccaccagcttcctaatacagtagatggggattatttaatgccgttgcagcgccacatagaagtatcaaacaaccagctcacacattttcccatcttctgtcctccctgaataattgcattacagcttcttgttagactggcattcagcactgacattattgtgactgggtaattattgttcacagctgactgaactatgtagggtactgtgattaatttcctttctttttgcaaatttaattttcctggagttagtcgttgccttgtcctttcattttcttaatgttttatgtagtgtttatgaatatatccaccaaagtttctggcaaagatgaaaaattctccaattgcagtcaagtgttggcaaacctgatctttctgtgtatttgctcgtttgtggatgtctgtcctaggtcttcagtctagacttccttccccatcaccccagcatcttctgtgcctctcttctgtttcctgtattccttgcccttgactgacttcctccttattgcagagcatagcctcccacagcatagcctcccacagcttcctgagagtgtgcgtggcaggtaaaggtctctgagaccctgcatagttgcaaatattttacccttatcctacactttgttgactttgtctgtatgtataattcttggttggaaatcatttcccttgggagttttcgggccaccgttctgttgtcttctagcatccagggttgctgtgggggaggccagtgttgccctcattcctgagcctctgtaggagcccgagggacctttacttcttctctaggttataaaagtccatgttgatgatttgcagtgggctctgttttcctcctctgggctgaacacttgcttaatcagccctttcacttggggaaccccatgttacaattctggggagactctttgtattattacttgaatgaatccccctattttctctcctgttttactgcagttggctgagcgttagactccctacttttattcttctaatttcttgtctttccccttttccattgagttattcctgttcatcttttaaactgcttattgagtttttaaaattgatgctatcatatcttaaatctgaagagccttttgtgtataccctgagtgtttggggttttggtgaggttgttgttattgcaaaaacaccctcccaccatgttcctgtttcagcctcttgtgttgccccggttgccattctggttaatttctgtggagaaactgtctcctgccagggtgaaggctggagtgctaggggccccactgctcttaacacagcctctctgcctgctttcatgttgacagcctctgctttcagccccaccttcacagtacccgaagcttcagttcctttctggctgtgaggcacaatggctcttgcctcttgctggcctcaccatttgcaggtggaagattccagcattctctgcggtgtcctctgctcacttcttcctcgtattgtcccttctcctctcccactctgtttgtcctcaggaaggtatgggggcggaagggggcataggctgtgtgtctagaattttcttctattcctttgctagcatttaaatggactttgaggtgggagtggagaaaaactatagattcagtctgccctgtttaactggaaaccttttattctttttaatggttgcatattgttttattgttaaaataaaacaacatataactgttgaaatcctcagtcagtccctattattgggcatttgggctcattttgttgccagaaaagggatctcaatccagaccccaagataaagattttggaaatcactcaggaaggaattcatggcatgtcacagaacacagtagaagaggcaagtttattagaaacaactctgttagagcagggcgtcctcagaaagcacatctggactttctgctgttgtaggagagtgtccttgtacgtatctttaggctgtttccttaactctaaacatctcatgactatgggtcgtgactggcaaggaatgtgctttgctagttttaaggtggagctgagcttaaaatggtgtaacttctgcttccttaacagttccagtttttgccattagaaaccatatggcaggctgggccggtggcttatgcctgtaatcccagcactttgggaggccgaggcaggtggatttcttgagaccaggagtttgagaccaggagttcaagaccagcgagatcctgtctctacaaaaacaaaacaaaacaaaacaaaacaaaacaaaaaacccaaaaacagcaacaaaaaaattagccaggagtagtagcgcacacctgaagtcccagctactcgggagattgaggtgggagtattacctgagcccaggagacagagttttgctcttgttgcccaggctggagtgcaatggcgcgatcttggctgaccgcaatctctgcctcctgggttcgagcaattctccctttttctttaagaatttattgacagtccttcctagagatttatattctttttatagttctttcaaggtacgtgtggatagcttcagatggagactctcagctctgaatcaagcagacattttcaatgtccccaacccttcttcaggtgaccttattctctcacaggcatccagccctggggaaggggggtgtcttgccagaagctgccccctggcttagactttccctgttctgcctgcctccctgcagttgggctggcctgagtaccagtgtctttggaatctgcagagttgctatgctctctcatcgaacaatacctaaaaagtcccaaatggccgggggagagggggtaaggatggagagaaactgctaatggggtgtgaggtttctttgtgggatggtgacaatgttctgtaatcagatggtgatgatggttgctcaactctgtgaatacactaaacatcactgagcgatgcactgtcaaagggtgaattttgtttttttttgagacggagtctcagtctgttgcccaggctggagtgcagtggcacgatctcagctcactgcaacctctgccactcgggttcaagcaattctcctgcctcagcctcctgagtagctgggattacaggtgcctaccactgtacccggctaattttgtatttttagtagagacagggtttcactatcttggccaggctagtcttgaactcctgacttcgtgatccccctgcctcagcctcccgaagtgctgggattacaggcgtgagccaccgcatcctgcccaaagggtgaattttaaaccatgtgaattgtgtcataaaacaaaacccaaaccaagcctgacatcagaagaggtattcagtgaaggaggaaggattcttggaattaaacaagaatgtttcttaggcagaaaatttagctctgaactccctagcagccaagatgaaagtggaagcccaaagaccttcagagctcctaaagaggcgtgccgcttggcaggaggggtggacttggatctgacaccgagtcagcaaacagcagatgagaagacaccctccagccttgttgctcatacccgctgctgacactggagaggctgtttcccagcttttcttccctctggcccttgaggtgatgtggatctctcggtgttttcaggaggcgcccgctgtccaagtggggtgtgcactgctgagtccagctgctgtgttgactttgcatgcaactcttgagctgagaagctcttatttgtttatttatttttagagacagggtctcgtcctgttgcccaggctggagtgctctggtgtaatcatggctcactgtagcctcaacctcctgggctcaagctgtcctcctgcctcagcctctcaaagtattgggattacaggcgtgaactgggtctcccggccacctagctgaactctcatcctctttgaatgtgtcctggccatgtgcaggacacttaagatgttttgtgctcatcctcttcagacaaagcctgaggctttctttataaaatctttaaagtcagccagaagccatgggccatcaggggcagatagcagagtgcaggctgcctggatctcatcagattgctgtgtggggcctatcaccggcgccagacattcactcaaccagcttgctgcacatttccaccaccgaggttcctcctttcatttgccccagagatagacatgtctgtctttaagagaatcaggtttctctacctgcctcctgtgtcagcaccagcaggaggggaaataccccaccttccctagttctctgtagctttcagcccatggctccctgaccctggggatggggtactgtgagtgaagcagtgcggaggacccagtgctgagggcggggagctgcccctgcagcccagactctggtgttcaggaatcttctctgagctcgctccagtccagggtgaaagggaggctgttctgcctttatgcttcccttcactgtttctggagaaagactatgatatttgaagtcagggcaaacaatcttattagctgcatgggtgacacaggattgctcttgctgaaggcattgtttttggccacattttttaggggtagtaaagatggcagcctacccatcttccacgtcgctcccttgccagcctgccccccaaattcctcatctgccacttgaggggaagccctgggcttgagtgggtggagaaagaatgatttcatggtgttttctctatatctgagttctaggtcagatggcctctccggaccccttgagacttagggacttacagtttggggtgaggcctacaagcccccaaagggaaactgaagccctggacaacaggccccagacaaggatggaggcacactcttgtcttctggttcttctagcccctttgtatttaatgagctgtggggatgcaaagtgggatggagggtaggacacgggcctgtaccagaagacaagagggactgccagccttctgtggctctggggtgcgaggacttaggatcctcctaagcctgccataggacagggcagaccattgcccctattctggttctaggccgagcccttggccttcagggaggggtcatcttgagcttggaggaaacccaaggtctcatttccacctttgcttccggggctggatggccagctcatctccccgcaggcttcgtgatgaccggagcccctctctcactggctggccaaggccgtggctgaagccagattgtaccaaaatgtagaagatctccctttggtgaactttctggtgtgagcagagatatgtgaagagtgttgccccgcagaagggagggttcctgccatggcccagggcactgttgcaggccagtcccagccaacacttttctcagagtcgggagaagccctagaaagaattcttgctgaggctgggtgcgtggctcatgcctgtaatcctagcactttgggaggctgaggcaggtggatcacttgagcccaagaggcagaggttgcactaagccgagatcgtgccattgcactccagcctgggcaacagagccactgacattctgcctctattgagactccacctcaaaaaacaaacaggatcttccaatactggaactgcagtccctcaggggagtgaatggccacagagagtggcgtctgccttctagatggagtctgggccctctgggtcaccacagatctctctttgctccatttttcattttatttctctgacactgaggctgaatgtcagtggttctttatcatggtatctgcactgttatttctgcttgcaatttgcttgttttattcatttatacctacctggcctttggggattcttatcatgagacaaatgttgtcatgatatcttactatccggactaacagtccctagagctggtaggaagtcctacgacacagcttttgaggccaggtttatataccatctgctctgtggagcttggccagacgcagttccaggtccccagagcatgacacctgtgtttttgttatgttccttacttggccaggtcacagtttaaacgtcatctgctcctttccttcaaaacacttgcgtcaggacaagaatcacgttgtcattgtctttgctgcaggccactgctgtgctgggcacgtggctgtcagtaaatgtttgctcaatcagattacactgaacaattatttgaccaccacatattgctaagcatgacagaaataattctctggaaaatgaaatgagattgctctttattagtgtttcccagaactcccatgtctagaatgatctggttttggatttagctcacggagccatttatttggaagtccctgctgtgttggaagactcagcctgtttctgggtttgatggtagacgttcgtgctttatcctaaagagacaagatcacacttgcccgtgagtgtgtggccagctgctgggatgagaaggacctccaggccccatgcattttgagtgtagcaggcactcggtcatctgatatctacctgcatgtctcacttatgcagtcctctgattgagaacaaagtaacttttactatgtgtgggcaaggcttggaatcaagtctggtatatctgatttcaaggaaaaaatactaaaatcactaggagtttgaaaagcagtcactcataaagagattgtcctgtggttctgaggaccacacacagcttggatggatgaggaccagacacagctgatgtggacaattcccctgtagccaagctgggtctgataatggttaggcctttctgttcaatgcggaggacacgttcaaggccactgctgccaccaccagcagggaatcaccctgggcacatcagaacctgggggatgcaggtgtcctctgtggggacagcaataaaacttggataggaggccggacgtggtggctcacgcctgtaatcccagcactttgggaggctgaggcaggcggatcacctgaggtcaggagtttgagcccagcctggccaacatgttgaaactcagtctctactaaaaatacaaaaattaactaggcatggtggcgcatgcctgtcgtctcagctacttgggaggctgaggcaagagaatcacttgaacctgggaggcagaggttgcagtgagccaagatcgtgccactgcactccagcctgggtgacagagcgagactccatctcaaaaaaaaaaaaaaaaaaaaaaatctgacttgacaacaaaaaatgaccaggcagacatttatgtttctgacatagaaaaatgttcataaagctaactgaaacaagcaggatagagtataatcccttttttttgtaaatcaaaacacacataaatatatttatatatgtaaataaacttacaggagaaaataactgtggtgattatctgagtaatggatggggtttggggtaattttaacatttttctttttgtttatctcacggttccctaattctttcaatgactgcgtcttacttctgtcggatgaaatcacacataagattgcaggtgctgagctcccaggcaggagctgtttgtattggcccacgtgtgaagcccaccaccagccagagatggaggcaagatgaagcagttgatagagaaaggactttcatttctggagtgtctcagcagctttgtgtggaggataagccacgtgggtccagaccggatccggcaggcgccggatattagctgctggggtgtgggccccggggcttcgttttatctgctctcatcaacattgtggtgtctacagttattactttttctaacatatgactgatatcagcactgataaggtctccttttcataaatttacaggcgttgccttcttgccagctagtatctcttatctcattggaaccaatatttttgggatacttgcacacaaaatggggaggtaagatgatatgaaaacaacactcattctgttacaataatgtagttctttcaaaaaattctaagttgtttctgccttcgctgttacaagtaattgttttgattttcattgaaaatttggactagaaaaaaatcaaatgatcatttcttgatggtgctttttcttttggtaggtggctttgtgctcttctgggaatgataattgttggagtcagcattttatgtgtgagtaaaagatggcattcgacaagtgggaacaatctgtgaataaaacttgcgctttgggcaagaatcaccaagaaacattttacgtttgagtttgttgatgttttattacagctttcattttattctaattttttatcatcttaaaaatgtttggacaagactttccaaggagtgtattttcattttatgtcagaaattatttaaaatgttttatttcacagtttaacttttcccctgcatcatcttaagcttgacagtgtcttaaacacttcaggacaaccaacctgaaacaatagcaagatgtttttctagaataaaatctcttctaccaatggccaatatccatccctcatgaggcctacttgttcttgtcaaaacttgagggtggactaggctgatctttcacatatgccggtgacaagtttttcatggtggtcataaaactcgtttcaagctttgacttttaaagatttggagggtccggttcttcacaaaccccacccttcttcctcctgttttcttcagaagggaacaggcataccacgctcagagaaaacacaagttcaagactttacgagatgatttagagttggatctcttgttattttagcataatgtttatttcctcttacagattccatttgcaaaaaacatttatggactcatagctccgaactttggagttggttttgcaattggtaagtcacacgaaccttgtgcctacatttaaaaccgcttttccactaggaagggttcttcttcctctggtagactgtagttcctcaacctaaatttccagaatcttagaaggaggctgcaggcagcttagctaaattacagcctgtcgattctccgtgtaaatacacctgcttctatgcactagtcatttatttcctgaaaaccagtattttttaaaagctgatatttacagaaggaaactgatgctccactgctggggctgggcaaacaaaggaatcccttgcacagagctcatttttgtggactcctccctatgagcaggtcttctcatgaggctgggggcaaaggcttcacatatgtattttgaagaggttttagtacagacaaagcagactaatgtgttgatgaccgcctgtgctgcaggaattcccatgggcaaggagatgggcttttgtaatgttaagaatgataatatgttaggaaaaatctgtcactattttgagtgaatggtatacttttgtctcttatttataatataccaattgatcatgataaaaataagtgctcagtccacccctgtagaagcaggaacgcaacctttgagtggtacagtggcacagcacggctttcactgaggacagatggtagaaggctgctgaggctggggtagaactcagtatggtactctaggtccttctcaggtgaccgtttgcctgtcctctgccttgcctccccttgtcctccactgtctggttggcccatctttttagggagggtgctagtcctctggcggctccccttgccattctgcaggtctggcagagttgcaggttactaactgtacggccccctggcctgcatccttttggtgctttcctgctttgctgttttctggttcacttgtccctcaccactcagcacacctgcatgcctgacccacctcctgccagtcacacctgggccacacgcttagactatgggtgtttccaaggtggagaataataggggggaccagaacgccccagaactccaaggagtctgagagatcatctggccctgctcagaaattatgtgtgtgtatgtatgtttatgtgtgtgtgtgtgtgtatgcatgtgtatccatagtatgtgtgtgttgtgtgtatgagtgtgtatgtgtgtgttgtgtgtatgtgtgtgaactaaaagaagctaaaacacacatgcacacacatacatacacatacacattcatacacaaacacacacactcatacacacatacacacactgacacacgcatacacacacacatacacacatacacccccccacataaacacatacacatacacaaatatacatacacacatatgcatacatacatacacgtagatacacatacacatacaaacacccacccacatacatatgcacacatacacacacacatacatatacacacatacacacacacctacacacatacacatacacacacacacaaatacaagtacatacacaaacacatatacacagacacatacacatgcaaacacatgtacacacatatatacacatacatacacagatacatatatacatatacataatacacataaatacacacatgcatacacacatatacatagacatacacagatacatatatacatatacatacatactcataaatacacacatatacatacagacatacaccccagcaacaaccacgaccagcattagaatctcgtctcttgaatagtggggagcaggtagcataaagatggtgtgtgttcagagttcctggctcagactccctggctcagtgagtgtggtcaagcctcgcctctctgagtattggtttcctcatctataaaatggggatgctcatgattggctgctgtgagccagtgtctgtgaacacactggcagggactcagaggttggtgccctcccctccacatgtgtcagtggcaggcacatgaggaaagtttctttcattgaaatggtgcttgctgcttcctaatatgtacaagtgctggggatatgggtgaacaaaaccaacagaagagttgggcatttagcaaagaattgaagaatgaatgacaattgagatgatgctgtgagagaacatctgtatacgaggggaacctgacctcctctgggggtcagaaaaggcttccttcattctttctactcaaagattagtatcaccccaagacttgcaggtggtgatgacagaaggggaagagctggcagggtggtgagtttaagacacactctctgatattcggcccattttgggtttacatccgttttctatacactgtgttccctgactgtcttcaggaatggtggattcgtcaatgatgcctatcatgggctacctcgtagacctgcggcacgtgtccgtctatgggagtgtgtacgccattgcggatgtggcattttgtatggggtatgctataggtaaggacattggcttttcataagaaccttttacctcaatacataatggataacgtctactaaaattgtttaaatctttgcatctttcagtctacaagacatttggaagagctttatctaattctctgtttcctgaaaggtccttctgctggtggtgctattgcaaaggcaattggatttccatggctcatgacaattattgggataattgatattctttttgcccctctctgcttttttcttcgaagtccacctgccaaagaagaaaaaatggtaagaaaaatttaggatgcagtgagcatttcttgataattttagcatggccttcctgatagcttcctcatggtttcattctaaagccttcaaacataaatggtgagaattcctttttagtttgtaccacatagagcagttacttcttttatttttttattactgtgaaagttatttctttcaagcttatgtttataaactgggagaatgaaattatttttgtacatagattagcatcagtgttgctcttttgtcgaccaagtataaacctggaatcattcaatttgattttctatggttcttgaaaatcttggacacaatctttctgcctcctgtacttatgcccaaggttagccatttgtggtgctgttgcttttctcataacccttacagcattcagtaatagttgctgtcttgtctttactgtatgtaggattttagagatgattttacgatttttatggaaaaatcattgtatatggactttggggtatatgtgaacacacagaacgatttaattcataactttatgaccaaaattatagccataggcaagatacagagtataaagcatccctcttttgaaaaagtccaaattaattgattcaaaatttgaattttgaaatgcatgagtcattttaacctttctaaggtatttaccttacccagcaaggagacgctcagtgtttctgatcatctttcttatctggtgttgccagtttttaaaacagcaaatgctgataggtacttgtccaggtgaaaggagagtgtcttggattaaggatgaatgaggtgaacaagaggacatgcatttttgtgtttgaatagatgtgaggtttgtttgtaatgttctcttggaagtacatcagaaggtctttctgacagtggaactgaatgcatcttaatgctttggcatttcctgaactgccctttgatgcttttccccaaaaggagatttaaagacaaaccttaaaataaggttatgtgcagcctgtgtttgtcttgggtgttttttacattcattaattcattccacatattttaaaatatatcaagcactgggcactggccttgtgccctttattttaaataggatttaactagatacttttgagtaatgcatggcccgtctgactcatggaaaaggtatggaaggtgctgtggaaataactcagacagaagccatccccttgtccttccctccgcttgcttagatgcttccccagctctgaaaaccacatcaccttctcagacctctcttaggagacatctgctttccagcttgggtgtgtaaatttcagatgcatctttgcttggctgaccctagcataataccttgccgaaatggagtcagaaaattctcagcacaaatgcaaactgccattctgttgccatgataacagcttaaggctgaatggaggttactcaatgtttttgaccaaaaaaagtatatatgtgtgtatatgtgtttgtgtgtgtctgtgtgtgtgtgtataaaatcacctacaaatgctcctgtagcccaggaaactgtttgaagactcctgggagatagttagggctagcatgggcctgggagccacactggccccaccatgtagaggcttatgagtcttggtttcctcctctgttgcatggagaaatgataacgtctacctcataggattgttgtgaggattaaatgaaagaatcccaacagagtgactggccctgtggctcaaaaagtgtgttcctatttccaatatcaccccactctttcctgcttatctaactctctggcttcccccgtcagtccagcaatacctgaattttctccctttttcctcctctgtgatgtgagagtttccttttgctatacagaccccagaactcctgaatgggctccccttgccaagccggcaaacatcagtggctgttgtgatgtccgtttgtgaacggcagcctgatggcttatctgtggccttggggaaatgaatgaggtcagaggatgagcagagaatgtgcttgcccagccaactaccactgtgttccgcagaaggactggcagaaggcaggcctcagtacccctcctctttccccatttaaacgaatacttcagttcatgttttaaaaaaatgctgaaggaagtggaagagacgatcctgaaaggccaaacagtaagaattataggtttccaggaagccactttcactgcaagatgttacaatccttaataagcacctagcaagataaatcattaaaaacttgagaaggtgtgcatctcgctgcccatcaatgatgcccataattgaaggcatcacgttggatgccatttgactggcctaatggtgacatttgagagtggtggccagcagttgctgcctactcattgtgcaagcagagcaggaagccagcggtggcggccgacagcacctaatgataagggggcatgcaggcaggacagcagtgtgtgagggaggaggaagaatcaatgaccatgcagttgagaaaccccagagcagacaagtgctggcgttcaggatgagcagttgccaaatgctgggggatgtgagggccagaaggcatacgacccttagcaaatcattcttccattagacagcatcctgataacaaggtgtttggacttaagctgttttatattgtaagatataatgctgttttcatggatcacaagtgacagaatcatgaactagtttataagcatgtgagtttgtcttccatttggtttactggatttctgttttttataatcagcattatcagtataggtggaggaaaaaaactgttactcaagtccctctgcacatacaggaaatatcaacattaccatttgaggaaaagtgtcttataagacagttacacggtagcgcttcactctcaaaattcccagttgagaagagctgtgttgcggatttttttttccaggttgaagaattatttttaaagacaaggcacgcttcttaattttactcttgaagtttctaattgttgccaagacaagaaattaggtggtttgaggattgcagctttcttttcctggatggctctgatagttgttccataaagcccttccagcaatagctctgttttctggatgccatgcgtggggcaaggatggggtggcccgaggctgctgagatagaccacattctgcatattctaagttgtttatagaatttgtccctttgcaggtatttaaatagtgggtgcaaaaccatcattgcttttctagttatgttaaagagaataaaactttcctactcagaaggcccaggacctatcatcaaaatctcaaagactggcactcttatcttttaatgcttttatgggttcactaccccagctttgtattacttatacttttcatttggtccaccatgttggtttgtttgtaccacttaggagatcctaactcatgaaaggggcatttggaggggctggggctcacctctcagtaagagggctttgctctgaattcaaaagccaatcctctcctattgattttctctttggttgagagtcaaacacaccttcctcaccacagcagtgtgtggagagcagatttaatttacctgcctgcactgcggccgccctacttgttccccgggcacctgactgacctgcttgatgctgttcatgcctttcttcatggcacttttgaaacattacatgccacctggcttatttgtgtataacttttttttaaaaagtacaattattgcacaatagatctttcaagagaggttgggaagccagtgagctaggttttaaaggctacagaacatttaaaggaggaaaacttcacctgaaacaggctgctaataaatatgttttcggtgaattgacaaatgctggtcagttaagtatgcatgatgccaaatagtctgactgaactgcttttcctgcagtgcagttttttgttgcgttcctatcatgtgcccagtcctaggttctggggtccttaagatgacatattcctacattcaggtctaatgtggatgagccaagagatggaaggcaattaggaataaggtagtgatgaccgttctttataaggtgacctgcctgcctgggagccgtgcaaggatcgaggccccatgccctgcattccagttgggtgtcccaactggtatctcactgtgcctcctcagcagacctctgtggtggccaggctggcttacttagtgtcctgcttggtaaataactcatgttttactcattgccacctcccttgctgtccaaaccttttccatctttcaaagtttacctcaactcccgcctctataggatagcgttccctgggcactgaaccagcagtgagcactccacctgggaccctggagtccctgtccttgcctgtgcagggaggtaactaagatgctgggataggaccttaaaggcactgagatgcaacacctagtaggtgtcccgtcagctgttgtcagccagatgacagtgctgtagtcttagataatgccatgtaactagggcagtgtttctcaaagttgacactgttgtcacatgaggacagggccctcaaatttcattttttaacctgctccatctctccacccctacatttccttgcgaatcattaatctgggggagatgagacatttattgttaggggggttaaacctttgtgttacatggggagaacggtcctggtgtacaaagtctagtgccgccattattttaaaaattgagctctttattgaatacaagtatcaattcacttggcaagcagcataaaaaacagttaagttagaagctgacaggttgagctggcagcctaacttagagggtcaaggaagtccttatcttcacatgttacacagatcactggataatgtcttgggaaatgataaatgggttaagcactgagtcgagtcttatctggggacaagagctgggagtaatagctaacagacaagatgggttacaataggccaacatcagatacattttaatctatttagatttgcaaactgcaaaaaaaatattggggagtagttcacatggagaaaaactcaagacatacctgataattcattttagttgcacatgacgcccccttgccatcctctgtgctcgtctaactaccacggagtgctgcaggcggctcctgtctgccccatcctagctgtacacccctcggtcaaattctttaactgctccgtgcctgttttctcacctcccacagagggttattgtgatgtattgccactaaaatgcttagcatggtcttggcatgataaatgccagctatcaaatataagcaaatactattggacaatctggtttgaaagcagagcagcacgtttttgtcacagtttttaaattttcagtaacaataaaggagggcatgagagtttcatgctcatcagaagaggatttttaaaaaatcatatattttagctagaggacagccaggattggggacaggcggtcaggaaatcacatgtgtgaaaaaataatagctctagcatgttttgcctaagaagaaatctaaggggccatgacaatatggtcttaaaagattgggggccaagcatggtcacttgcacctgtaatcctaccactttgggaggttgaggcaggaagatcacttgagcccaggagtttgagcaacctgggcaatgtagtgagatgtcatctctacaaaaaaaaaaaaaaattaaaaattagccagtcttgatggcatatgcatgtagtcacagctactcgggagtctgaggtgggaagatggcttgagcctgggaagcagcagtgagctgagatcgcaccactgcactatggcatgagtgacattctgtctcaaaacaacaacaaaagattgtaagggcagcctgtgaagatatcagaactggctgggtgcagtggctcgtgtctatagtcacagcactttgggaggctgaggaggggggatcacttgaagtcaggagtttgagaccagcctggccaacatggtgaaaccccatctctactagaaatacaaaaaaagtagctgcgagtggtggtgcacacctgtaatatcagctacttgggaggctgaggtgggagggttgcttgaacccaggaggtagaggttgcagtgagtcaagatcacaacaccgcactccaacctgggtgacgaagcaagacttcatctcaaaaaaaaaaaaaaaaaaaaaaagaaagaaagaaagaaagacagaaagaaaaagataccagaaccagattcatgaatgcaaacaatggaaacgggttgtagtccagacttaggtacatttctcacatgtgagggcttctctcattaaggagagagcacatcctttcaaggtgtgttgctacaatgacgtctgtaaacagaagttggactgggtgacctccaggatccccataccccaattccaagattctaagtataacaaacctaacctgcctgtcccttgcttcatagagtataagttcccagagtggacttatggcccctgacaggtataatgaaaatactgcagagaccacttctgtctccaattgcctggaatttttagagtgtagaactacaggtcttttaggtcaggcgtctggcgattgctccaaatgactggttaatagcaagtaatactacatagttttcaaactaataatccttaaaaacagtaggttaaaaccatcttatctttatgaaacaagaagttaatatacttgcactttgctctcttttaggctattctcatggatcacaactgccctattaaaacaaaaatgtacactcagaataatatccagtcatatccgataggtgaagatgaagaatctgaaagtgactgagatgagatcctcaaaaatcatcaaagtgtttaattgtataaaacagtgtttccagtgacacaactcatccagaactgtcttagtcataccatccatccctggtgaaagagtaaaaccaaaggttattatttcctttccatggttatggtcgattgccaacagccttataaagaaaaagaagcttttctaggggtttgtataaatagtgttgaaactttattttatgtatttcattttattaaatatcatacaatatattttgatgaaataggtattgtgtaaatctataaatacttgaatccaaaccaaatataattttttaacttacattaacaaacatttgggcaaaaatcatattggtaatgagtgtttaaaattaaagcacacattatctctgagactcttccaacaaagagaaactagaatgaagtctgaaaaacagaatcaagtaagacagcatgttatatagtgacactgaatgttatttaacttgtagttactatcaatatatttatgcgttaaacagctagttctctcaagtgtagaggacaagaacttgtgtcagttatcttttgaatccataaatcttagctggcattagttttctatgtaatcacctacctagagagagttgtaaattatatgttaacatgttatctggttggcagcaaacactaaagccaataaaggaaaaacagtaaatgttccgaaagcagagaaaagcaaccaaacatattgttatgaactaaaagctttccctttaagatgcatacttgtcttactggatgaagaaaattgagggtacatgtaccttatactgtcaaggttgtttaaacatgataaggttaatcgccatctacttcaagttttagaaaaggaaacaagaagctaaaaacagctgctctgactttaatatctgactatatctttgatctgtttgcaggtcatccaagtgttttctaggaatatatttattttaggttgtctgaaactactattttttagactcctgaaagttgttcacatcaatgtgaagacaaattttaaatgaaaatgaagaatgaaattatgtcttgaatcatatattaagaagtaaaaataatagtgatcaggcagaaaagaaaaatggaacatctaaaaatgtatgtgctaactatatcatccagtgtgcagtgttgtgtatttttctaagcatgacaacattgatgtgccttttcagtgtaacagcaaatactgttagtgaacattgtcaatttatgtcattttgttaagagatatgactggagtgtgcagtgtggaatgtctctaatactacttgagaatcctgcagttctataatcataaacaaaaattacttagtttcgttaagctaagattgtgtttgtgttaacttcgacatcaaggagcaaagaactttagaacagactcctcaatcttgtgactttcttattctctaggaaagtaacacttcgtttcatgaagcttttctgtggggcttcgattatttcaagtctggtttctaagtgcagtgtgtttgaagcaaacgaacttccaactcacttatttggcattgggcaacttggccaagtctgctactttggaagatggctctggaggaaactctcatatggctaaaaaggcaggctagtttcttacttctacaggggtagagccttaaaaaagaacgtgctacaaattggttctctttgagggtttctggttctccctgcccccaataccatatactttactgcaattttatttttgcctttacggctctgtgtctttctgcaagaaggcctggcaaaggtatgcctgctgttggtccctcgggataagataaaatataaataaaaccttcagaactgttttggagcaaaagatagcttgtacttggggaaaaaaattctaagttcttttatatgactaatattcttggttagcaagactggaaagaggtgtttttttaaaatgtacataccagaacaaagaacatacagctctctgaacatttattttttgaacagaggtggtttttatgtttggacctggtaatacagatacaaaaactttaatgaggtagcaatgaatattcaactgtttgactgctaagtgtatctgtcc

SEQ ID NO: 16462 - DNA, 39039 bp, Human
gcatctagggtctaaaatgtaaaaagactctcacgcttgggctcctgggtttacaggactctgatggtgaacttaaattttgcattgctcactgggcaagtgtcttaacctctctgtgcatgggatcctagacagcacctgcttataaggctaatatgagacctaaaagcattaaaatgcaggaagtgcttcaaacattgccgaacacacagactgtatggcttttaaggtttttttttttttgatacagggtcttgctctgtgacccaggctggagtacagtggcgccatcacagctcactgcagcctcaacctcccacgcttaggtgatcctcccatctcagtctcccaattagctgggactacaggtgtgcatcagcacgccgggctactttttttattttgtattttttgtagagatgaggtctcactatgtttcccagactggtcttgaactcctgggctcaaggcatcctctgcctccctaagtgctaggattacaagtgtgagccaccgtacccgacctacacagactatatgtgtttgccactattgtcattcactaaaaggccaagaggggttgatgatacctgcccagggcattctgaaggctgtgctggccaggaggtggggggtgagggtccccagggagggaggaaccaatctttctggagcactcactctgtgcaagtgctgggcacagctggcaccctctcctgtagccccacatcgatctcaagaggcagagactttcacatgcccatttcacagatgagagaactgaggaccatgagcaagaggctttccagcatctcgcagaggctgaactgggatcaggcaggtgcgtcaagcctagtgcttgggtcccttctgcttcgcctaggggggtgccacagggtctgacctacctgggttccagcctcctctctgctgctgttgcatgacctcaggcagccccctctgtttcctcatctgtaaagcgggcatcaaaacagtgtctgttttggggccgggtgtggtggctcacacacctgtaataccagcactttgggaggctgaggcgggcagatcacttaaggtcaggagtttgagaccagcctggccagcatggtgaaacccagtctccactaaaaatacaaaaattagccaggcatggtggcacatgcctgttatcccagctacttggaaggccgagacaggagaatcgcttgaacccgggaggcagaggttgtagtgatctgtgatcacaccactgcactccagcgtgggtgacagagcaagacccgtctcgaaaaacaaaacaaaacaaaaaaccagtatctgtcttggaagtgctgagaacagacaagggaatatgaagtttgtgaaatgttgagcccgctgtgctacattcctgtaaaacacacacgtgcacatgcacacccacgtgcacacacgcatacacataaatgcacatgtgcagatacaccggctgacagtgacagcacacttatgtgtgtgaaatgctttatgtgctcaatttcttttaaatctcacaggaaacacacgctatgaggaactacccacatgcccacatcaggcaggaggaccccggcgggtgcaagggtggaagtcgtctcttcatggctgcacccttggccagtgccagtccagcagcctctttcaaagaagcttttataggcagatagtttgtcagcccagctcgaaatctgaacaaggtagcagccgagcccccacccatccggctgcactcccctgcatgtccagccccgagccctgtgtcaagcacacctccttgggaggagaccgccccagcctgcaaggaagtgctcattatggagagtggagagtgacaggccactcccggccacgtctccaagcaagccggtgccccctcctcctgctgccaccgcccactgagctgcctgggctgcagacgccctggtcggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcatcctctgtgggtgggagtcagccttgaggagaggcgatccctagacactgccttctcctgtaagtgctcccccagaacgtggcaaggcaggcgtcttcctatccgtgtgtgtctgagttgtgtggtgggcagatggggctcacccccaaaaaaggacccttatctgtgaatcaagaggcaaaagacacatcacaaatgtgccaaagaatcgtgcctcacttttgccttgttacaaaagtatgcttgctcctgaaagacagcatctcatttcggaaccccaggatttaaacggagcattccgtctccatgatcagtaccaaatgtttgtgaaatacacttatgcattcatgtggttgtttattcattcagcaaacagaatgaatacactctgttaaacagaatttagcagaaaccgctctggggaaggcactctgtggggtcctgtggatacaagataaaggaggtaccagcccccatcctcaagggtggcgtggccgaggtgcagaggcagttgggtgacaaacgatggcagtacaaagagaaggcatgaggcagtgagtggcaagaaacacatgccctggggccagatgtctgggtgtgaatcgggctctgctgctcattagctgcgtggcttctctcaggcaagctgcttgacgtctctgaaccccagcaatctcatctgcaaaagacagagggatgcatttcttcacacaactatgtctgggtcgccactgtttaccaggtactgtcctaggctgtggggatacagacctcacatctctgcctggggaactcaatggggggctgggggcagcaaagaataaatgagagagatctcatttattagtatgtgcagattgcaagtgctgaggaagcaataaagcaggaagggaactaggagagagaatggggtggaggaggctatcatttttggttcctcccaccccccagagatcacagatccgcagggacggagtgagccaggacgatatcagcacacagagggctcaagaaggtaatgctggcacccacagcacctgtgtgaggattgaatgtctcagtatgtagaacgtctttgcaacatagcaagctggcagtgcatcttggcagctttcaatcaaataattgtgactttgtttggtgttgcctaacagggtagcatgtaggttccttggggtagggcagggttctgtttcactaatgtgtgcccctggtgcctgccattaagttgacgcctggtacattcttgtgggtgaattatgagcggctgcagtggtagcacgggatgcgtgtgcagctcttccccaggagagtcagacagggtttttagggttggggacagtggacctgtggctttaaaggataaataggagtttgccagctggagaagagggaagggagaatgattaatgaccccaggcatagtggggtgcctgaaactgtattgagacaaatctgggcctccagggctcatattctccatgttcggcacatgctcgtggcgggagacaggaggacttcgagaagtggaaagagtagtagagtgacatgatgaggcgcttggagaagggaaagctcatgtgagatggtgtagtcacctaaggcttcctggaggaggtggagaccttgactggatcttggggaaggattaggaattaggaggaggaaggaaattcctggaagaaggctcagcatgagccgaggctcacaggcagaagtggtgcatctaagagctgcttgggagaccagacctggccagaggggaggcattgaggaggggtgagagactcttctcagattttattgactcctccatgctcttctctggtgcaacaggatgatttaaccctcaactgtagttagtagcactttggttctacaaccatagagagattgccaatatgtcatctgattttatctccaccatgtcccaagatgtcataggagccagcactgtgacatccacataggagggtcagggttgatatgcgcgggggatttgggggagtctctaaaacacaggcctgggtgggctgcaggagctgattcacttgtagccaccactggtcaggatgcaagtgctttgaattggctcctcgctgaattgaaactttccctggttatcaacagatattggcctccttcctcagcgcctagacataggtgaggtttatgcagaacaactgtgccagccaggcacggtggctcatgcctgtaatcccagcactttgggaggccgaggcgggtggatcacctgaggtcaggagttcaagaccagcctgaccaacatggtgaaaccccatctctactaaaaatacaaaattagctgggtgtggcggcaaatgcctgtaatcccagctactcagaaggctgaggtggaagaattgcttgaacccgggaggtggaggttatagtgagccgagattgtgccattgcactccagcctgggcaacaagagtgaaactctgtttcaaaaaaaaaaaaaaaaaaaaaaaaaaaaaactgtgcctcagagaaagccctgggcgaagacaggctgttcgcctgtggctcagaggacagggagggctgggaagagcacctggcctggaacttatcacagtgaaatctctaatgtgctgtgcaatcttggaccactcgctgcccttctctggtcctcagtcctcacctgggaaatgaagatggagaacctatgactttcatggccctttcgttcgacagggacttacggatgataggaagcagcccccacatgcacaaagtcgagacttccccgtgaggcaccactccctcaccctacgctgagtgagaccttcagccttggccctgaccctcaagggctatgggctcgtcagagtgaggagatgctggctgtgtgctgaactggcttgcaccccctctggagagccagttttgttccacacagccatgatcacaaactaagttatataaacttacagttaaatcatttgtattaaaaagaaaggaaagaattttttttttttaagacagagtcccgtggtgtgatcttggttcactacaacctccacctccccggctcaagtgattcttgtgcctaggcctcctgagtagttgggattacaggcatgtaccaccacgcctggctaattttttgtatttttagtagagatggggttttgctggtctcaaactcctgagctcaggtgatccgcccgcctcggcctcccaaagtgctgggattataggtgtgagccaccgcacccagccaggaaatacttcttgttagaaatgcatcactttccaattgtattgctccgttttgctattctcttggctcctggggttttatgtcttttgcatccgtgtggtatgaccaggagagaagctactccacatctcttcccactcccattcagtggcctcacgtgggttgcctgaaatcaaccatgctgggagtatttacaccttggaaattggccagggctacatgaggagagctggtggttcagtcctgaccaagcgcagggctgcctgtagcctgctctagtctctcaaagcctcgtcccccggcagagtgagttttgtgtagcggactggtctcttagagtggggccggttaatgtcctgagtgctgtttatgcttcttggtctaagcatgcagagacagtgccagagatgagcacgcttgccttccattcccgtgggaggcccttaggagaagcttctaatgagaagtgccgggtctcccgccttctatctctaagaccttcaggagtttccttctcctatctgagcctcggtttcctcatctgcagcacgggacacagtagtgcctgctttgcagggctcagtaaaaagaccatagagcccacagttccctgactggcacagaactgcattccctacatgtgcactacggacagatttaaaaacccattccaggccgggcacagtggctcacagtggctcatgcctgtaatcccagcactttgggaggccaaggcgggcagatctcctgaggtcgggagttcaaaaccagcctgaccaacatggagaaaccccgtctgtactaaaaatacaaaaaaaattagccgggcgtggtggcgcatgcctgtaatcccagctactcgggaggctgaggtaggagaattgcttgaaccctgggaggcggaggttgcggtgagccgagatcgtgccattggattccagcctgggcaagaagagcgcaactccatctcaaaaaacaaaaaacaaaaagcaaaaaaaaaaaaccaaaaaccccattccagaaccaaatatttatgagaatgaataaaacagaagcagaacgtttgtaaatagtccaataacctttccatggagctcagtcggttctgtggacttggtgtttttggtttttctttcctggcattagatgaaactcctgagaacaatgatttactgagcgcttacactgtgtcagggcaagagtttgccacgtattcgctcttgggagcctctcgacaaatccaccgggtggggcccatggcagccaccatgcgggcctcggtgctatgcagcccctggcctgggcaggctggcccctactgtcagtgtgactgtgggtctgttttcccctctaagcacccctccagggcagctggaaatggtggttcagtttgcaccctgcccagagatgcctgtcctgctgaggggggctgggaggggctagagcagccaggagctggtgccactttctctttcaaatgcatcctgccagacggggggagggaggggagcattgcattgtctatctggaggcaccccctgtgctaatagcagtaggggactgtaggagccagcagtggcccacaacttgcattcctcagttccccatctcctttcccccattatttctgtgagctcttgagagccttccaaacatccttttattttttgctgagatagcaagagtgggagaagcagatggcctggagctgtgctttcaccattccatgagttctgaccttcaccttcatctttgtaccgtaagcatctgtgtctgctggcctgaaggctttctctggctgcaggagcctgctcagcccacacacagtcaggccaaggtgccggggaggtaacacctgtaggagcaaatggagctggagcccgatggcccagctggcttctcaactttggtgggacacgagtgaggagtgttccacacggtttctccaaggtccactgggtttgagctctagtgcccaggcagccacctgctcattaacactccctgaagggcgccttccctttcctgcccagcttcccactccccagctggggcttcctgggatcccctcccaaatgtactccctgcactcgaatcctgtcggatccatgctgtgggttgaactgtgtccccccaaagatatatccaacccctaacttctgatccttgtgaatgtgaccttttttggaaacaggttcattacaggtgtaattagtcaaaataagatgaagtcatgctggaggtgggtggttccttaatatgaaccccgttccttataagaaaaggagaaggggccaggcatggtggcccacgcctgtaattccagcactttgggaggccgaggtgggcggatcacccgaggtcaggagttcgagaccagcctggccaacatgctgaaaccctgtctctactaaaaatacaaacattagttgggcatggtggtgcatgcctgtaatcacagctactcaggaggctgaggcagtagaatcacttgaacctgggaggcgaggtggacgttgcagtgagccaagatcatgccattgcactccagcctgggcgacagagtgagacttcatctcaaaaaaaaaaaggaaaaggagaagagacatagaatcagagacacatggagagaaggccatgcaaagacagagggttgcagaggtcagagtgatgtatctacaagagacacatgagggaccagagaacatgagggactgccagccaccactggaagctgggagagacattgaaaggttttctccttagagcctccacaaaggaaccaaccctgccaaacacctggatctcagccttctggcttccagaactgtgaaagaatccacttgtgttgttttaagcccccagtgtgtggcattttgttgcagcaccctcggacacgaatacagtctgctctgggcatcaagggagtcagcttctgttggttgcaaccggcaacgagacatttcacagataaggaaactgaggccattgcagagaatgacttatctgtgctgttttggctggggacaagtggggctatcactatatccccagagtctgggagctttgtctgctccttgaaccaggtgagctcacaccctgcgggacttcatcatcaagactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggaggggggactggaaggaatgaaaagtccatgaatagctgacttttgagggggaccttaggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaaggccacgggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggcacctctcgggaattctgcgatggcacatagagtccttgtgagtcctctgtgtccccagcaccgagaggcagcctctcagcaagtgtccgctcacggtgcccactccggctcgtgggtcatcgtagcttcacgcccatctcctccgaggcctctccctgaatgccccattatgatttcccttaaatgtttacataagagcccagctcttccttcttagcatttagctctgttgttgttattggcatgatttgtttaggtttctctctaactgcttttgcagatgaccacaaaaagcaattcgttcgccttatctgtgtgctgttgtgtgtggtgtctctgacttgtcctgaaacagccacgtgaagtcagggccaacgtcttctggttcaactcggaactccccatttccagcccagcgcccgaaacccagtgggcctgggaattatgaatttactgttgaatgaatgaataaattatgttaaaaccttccggaacagaatagaagggatggaaagttctagaggactctcgggtgcactgactgacaatgacattgttgggaagacttggtcgactttgccgtctcgtgaatttctttctttcttttttttttttttttggcctccctctgaggaagtcccattaaccttgtgccaaattctgtccccagagcccagtgttaagggccccgggcaccaggaaatggcattcatctacgcacgctgaactctaagcccactgttccggggagcgacatatttttagatgtttgacgtccaaattccagaggaagagcaagtaatgcttagaggaaaactggctttcttcctccaccacgcaaaccagtgctggggtgcatttttattggtctggccgctaagctgctggaactttccaaagaagggtaaaagctcctgcatgtggaaggaagggggtggtgagcactgagggaggcatgtgggtagctttggtggcagctctggagattggattctttttccctaaatggaagtggtttataaattcttctactgattattaaaagaatgatgtttactgtaaaaaaaaaaaaaagtcaggcaacacagaaagttataaattagtagaaatgatctgaattcttcctccaagatgtaaactctggtgacattctggggtgtctgtctagattgtttcatgaagcagttacacacagcacacgtgttttctcttagtggtattttattcgtactgattcagatttcttttattgaaatgaaattcacatgacagacaattcaccctttcaaaggtacaattcagtggtgtttagtatactcagagtcatgcaaccgtcctaactgcctagttttggaacgttcccatcaaccctacaggaaaccctgcagccattagccgtcagtcctccttccctcttcccgcagcctctggcaactaccaatccactttctgtctttatggatctgcctgttgtagacgtttcatggaaatggaatcatccagtatgtgctatttggtgtctggcttattcacactgttttatatgttgcattttcacttaataatctgtgggaagtatgttaacatggtggatcgacatcttcctttctaaggcctgcctggtgttctctgtgccttcacttatgtatccagcctcttttggttgcacatccagcttgtttgctttaattgaatctggacttggacttgctgaattggggttcccactgctgcagcccaaaatgggcatttccccacctgcttcctagggatatcagtggcagaatggctttgcaaatctatttttgttcatctatatgaacaaaaggtcatatagtttcactcttgtcacccaggctggattgcagtggtgccgtctggctcactgcaacttctgcctgcgtggttcaaatgattctcctgcctcagcctcctgaatagctgggattataggcacccgccaccacgcctggctagtttttgtatttttagtagagacgggtttcaccatattggccaggctggtctcgaactcctgacctcaggtgatccacctgccttggcctcccaaagtgctgggattataggtgtgagccaccgcgcccggccaggaatcatttttatccaggtaaggcatacagaaccggagggttcttgtctaagttgtaccatgaatgtgtgctcagtggctactttgaaatagacttactgtacaatccctgagcaggaatgaaaataaaagctggaaatcacgggttgctctggggttttcaggaaggtgtcgtccgtctggggtgagtgtcctcctttctcagggatttcatgtggcattattttgttttcatctgagaggcaacataagctgggagggaagggctgcaaagagggggccaggacaaatgtgtacctgggggcccccattttgactccaccctgagctggggctgggccacaggagggcagagggaacactttgggacggggagggagcccctggactgaaagaatgggaagaaattgacaggcaccattgggaagcaactcccagttccaggctcctgggtcaggaacgcccatggagtaggacagacccaggttcgagtcctgcctctgactcttctcagctgcttgctcttgggcaaatgcttttagtttttttgtgcctcagtttcctcatcagtaaagtgggtttagaatagcagcagccccagagggtgatactgaagattcagtatgtgaggacccagcacagcattggcacacagtaagagcttactaaatgctgcctcccttgccataagcatgaatcacacagcccaggctctaagcctggtgtctgtgtatggtgactgtgtgcctccgtttcctcacctatgcaatggggacagcagtggtacctactggggagggctggaggcgacttcaggtggtcctccgagggcagtgctcttgcacatgctgggtggctgtttccgcatggccccttctcttaggaactctgcgagttgtttgccctggtcttatccagaaatgatgaggttatatccaatcccacttttcactgttgctggtgggtttctcgtacgtgtatctgcagcctcagctggactggagctccttaggtttcttctgcatctgctgagcatctaacctaacgctgtggagatggtgggcgttcactaaatcatctgggagtgaattgagggaggatacagcggaaatgaagaaagactggaagatatgaagaatgaagttactatgggacgagaggcttctgagtccattgattaaaaataaaaggagccaggcgtggtggctgacgcttgtaatcccagcactttgggaggctgaagcaggcagatcacctgagctcaggagttcaagaccatcctgggcaacaaggcaaaaccccatctctactaaaaatacaaaatattagccaggcgtggtggcgggcacctgtagtcccagctacttgggaggctgaagcatgagaactggttgagtctgggaggcggaggttgcagtgagctgagatcgtgcccttgcactccagcctgggtgacagagtgagaccttttctcaaaataataataataataataataataataataataataataataaaaggaataaaaatcaggtgaactatggattagcattgcccgtgctgagccgagcacacgcaggtgtggtctcttttgatcttcaccacagacatcggcagcaggtattacttttgtgtccattttgcagatgacgctcagatacgttagtgattttcctgtatgatcgcacagccatggggttcaaacccagacgcgtcagactcctacacctgagcccttaatccctgtgcaaagcagcctttgatgtataagagatcatgagcttcggtcccttccatcttgggatatggctcctaagttcttgccccaaaggatgtggaggttcagctgtgaaaaagagttaggaagcgttccgagtagaaggaacagtgtgcggaagcctccaaggccaggaggagcagcgaatcctcagaaactgaggatggccgagtccagctttacattttgaaagcatccttcctcatctctggagtgtgggatatcaagacccactcccctaattcacatccgcattaagtgagcataggagtgtgatgatgcttgcccatagcacagccttacacaaacaaaagggctgcccccacacctgtgcaggacccctgctctgcagaacccactgcacagggcccatgtgcagatcagcgagttaatgcatgttaagcacttagaagggtgcccagcaaactgccagggtgtgttgaccaccatcatcctcatcttcatcatcatcatcatcatcacagcttttgttccacccgaagaatatttactgagtacttgctatgtgccatgcactgttctacgagccagggacacaggtaagaacaaaaccaagttcctgtccctaggagggagaaaaacagcaaacaaatgagttcataatacacagtccacccaagggtgatgaggtgtgtgaagctccacaaagcagggagagggggaagggaaggctgtatgagcagatcccgggtaggtgagagccgggcagatatggtgggtgggcggggaaagagccagtgcaaaggcccagaggtgggactgggtggctggagagaatgagtaaggaggggagtgctggaagagaggtcagagacgtggagggggtcaggggagtcaattccagtccgacctctaggccaagaaccttggctgttaactcctttaacccatggggccagggataaattggagggtaagctgttcatgtctctgagtaaaagctatttcccagaactccagaaaacgccctgtgtttagaaccctctttgagtgtcaccttgcgtgacatgaaatatttttcaaaacatgtaatcctttaatctgggcctctcagtgaaatcagtgctttatcactcacgtccatctgttgtttcagtcacgcagtaaataactcgggagatgtggcttctaaggcgcttatctctttgttctctccaaattctgagaatcgacatttgaattttcctctgagacggcggcacagctcaaattgatctctgcgtaccctcccatctgggactgccattaaggaagtcccaggactgggaggcatttgtggtgggtgaaaagtgttttgcttctgatcaccaggttccattaaatttcataaatgaggcttcatcgaaaaataagctgggcggaaaaataagccgccccctcccgacgacgtacggtgtattcttaaccaccctccgaaggaggctggggcgcctgtcatgttagattaggattaaaaattgcggaccccaacatgggtccaatgtagttaattctgcagcaagtgaactgagagctaatggcgtgggattatgcacctgctgcggctggaaagttattggtggtggttacaggggtgagggagattgggcggagaaaggggtgataaaaggtgataaaaggtccacgctctggtctcccctctgtctttggggaaaaccattcacctccttaaggcctcgtctccatatccaccaaatgccagcttagtggtcattttcacttttcgtgaatttaacagccaatgtttacaagagtaaaaagaagggttctctgggtgaagcagggatgggggccaggggcccccctcccaggctttcctgccgcaccaccccccgctcctgcttggccattcctgctctctgccccgcatgccctcagtctcaggccctgaggctccctgggggcagctgaaaacctctggccttggtgattccaccaattcccaggggcacccggcccggacctgttcccagggacctggtgccccctgcagggcactggtgacaccgtgtgcaatttgcagctacccagataggcacgcaggaaggactgcgctcggtcccagccaggcagggacagacacagcctctgctctcagtgtggggtggcgagggcctaaaaatgaagaatcatactagaaacatcccgacgagtctggggaaagctgccctcagaaggctgtttaagctgaggactaaagggtgatttggccaattgaagctgatgggaggccttccaggcagaggaccagcacgtgccaatgatgatcggtggcactgtgctagatgccagcctgagtgtagatgcccgcctgggtgtacactccatcctgagtgtagacaccagcctgggtgtagacgccatccttggtgtagatgccatcctgagtgtagatgccagcctgggtgtagacgccatcctgagtgtagatgccagcctgggtgtagacgccatgctgagtgtagacgccagcctgggtgtagatgccatcctcagtgtagatgccagcctgggtgtagatgccagcctgggtgtagacgccagcctgggcatagatgccatcctgggtgtagacaccagcctgggcatagatgccatcctgggtgtagacaccatcctgggtgcagactcaggataccccaggagggaagttctgtagggagaaactgatgcttgcccaaggtcacacagcaagtgagtggcagagaggatttaagccctagagccgggatttgaaccaaggccgttagctgtggagcccgctctggttgcccgtctgctctgccggatgagacaagctcagctggaggaaacggtttgaagagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgaccaaatccacaggtgcctttcataaagcctctttgggctgcagtttggagaatggatggatttggaggcagcgaggccagggacgaggccactgtggaggcactgatggggacttgggcctggggtggggttcatttatagaatgtgcctggcagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctcttccggtggctgctggcaatcatggtcactccttggtctgtagacgccatctctgcctccctcttcacatgactttcttgtgtgcatgtgtgtgtgcgtgcgtgtgtacatgtgtgtgtggggggggcgtgcttgtgtgtgtgtgtgtgatctccctctgctcccctcttctcagacacttgtgactggatttagggcccactggaaaatgcagaatcatctccccatgtcaagatccttaacctaattgcgtctgcaaagaccctttttcctttgcatttaggattccagggagtagggcctggtgtctttggggacctttattcagccaactgtatgtgcaggaggagacacaggaggctcgaggccctcccttgaaggggtcgctcactggttaaatgcgatggcggatttctattaagacaccgagaaagagtgacaagggagggtgggtgtgggacatagaagcgggggtggtgtggccctaaccctggcctgggagggctggtgtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacgtggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagaggctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatctttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgcttttttttttttttttttttttagtggagaaggggtttcgctatgttggccagcctggtctcaaaacttctgagctcaagtgattcacccaccttgacttctggaaatgctgggattatacgcttgtgtgccacagcacctggcccctatatcttatttttgaactttttattaaaacataatactttgggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaacaaacaaacaaaaaatacttcaaagcgtataaatcctacgtgttcagctccatgaattcccccaaaataaacacaccatgtaaccagcccccagaccaagaaacagaacagagccagtcccaagaccacgtgttcccagccagtcactgcccaccagattcctgacttctcatgccagacatcagcttggcctgtttttgagctgcaaatataagtggaatcccactgtggtgttctcttttgatctggcttttttcctttctttattttctgagatgtagcgatgttgttgcatggatttaatgattctgtgtataatttgtaaattctcaaagctctatataaacatggattctaagaaatccacacatatgtacatatacatatgtacatatagacatatgtgtgtacgtatatgtatacatgcagacatatatgtatatacacatatataccacatatattatgtattatgtatcatctctctctcacaccgggtagatacttaagtaattgtccttcagcaaacacaccaagatttgcttatccttttgctctgggctttcagttatttcgtgccgactgttataaaaagatacatggtatcttctgaccttctgagccgccctccgaggctggctctgcctgcttgctgtttctcacaagaggaaacgcaggctcagagaggcccggcgcactgcccacccccttgcaagctccgggtggcgccgggactcgaacgcgcgccccagagctgctgacaccgccctctccccgcaggccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccaggtaggtcctgggcccgagggagggggctgagggaggaggacaggtgaacagagctgtcccgggggaggggaagaaaggagctgggcttaaagctgggccacctgggcgggtctcgggcgcctccactgcgcacctgtgaactgggacgggcgctccttgagcaggcgtggcgctgctgtgcagctgctgtgtgtcccactgcccctggggacttgcgttgtaggagatgcccttccagagaaaatgccacttcctatgaaaatgggatgggggcagggaccctagatgcctccagggagccacagtccagcagacacccattcccgggaaaatgcccgctgataggatgcgggtgcagtgggatttctcatttaaaagatcacgattcgaggcttttctttaaaataccggaccatgttccctgggctgccaccagctggaacctcaggtgcccctggatgaggaggtgtcctctagcttcccactcaccccatcaacccaccaggcccgccacacttctcatgcctggccctggggtatttgaggtggagaccaggagcttagcaatccagatggggcgtgccccagagaggagcgggtgcgtggcttcagatccaccggccagctgtcactttcttgagtctcctctcctgtgaaatgggtggatcacctgaggtcaggagttcaagaccagtctgggcaacatgctgaaaccccgtctctactaaaaatacaaaaattagccaggcgtggtggcaggagcctcaaatcccagctacttgggagactgaggcaggagaatcacttgaacccaggaggtggagcttgcagtgagccaaggttgtgccattgcactccagcctgggtgacaaagtgagactctgtctcaaaaaaaaaaagaaagaaaaagaaaagaaaagacaacgtgcagctcacggtggacctgccactccaaagtgctcagcactgcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccgtcggggacagtaagtgcggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagcgatgacaggggactcagcacacttaatcatgctcataattacagtcttataatgctcatcaagacagacagggactatttcagtactgcctctgggcaggaactggccgctgctccaggccaggcagcctcctactcagccttcataagaaaacctaaatgttgcccctcatggtggacaagcacataaaggcactcccctctgggtggacttatcaaaaatggtgccccttcctctggaatgtgacctgacatagggattctagccttgcctcctgcctatagcaggtgcttttgagcagtgcacagatgatacaactgtacatggcattcccaatagccttttcatacatcatctcgtttcacgctcacacagcttgatgagatgactgttatcagccctgtgtcacaactgaagctcagagaagctgaatcatttgcccaaggtcacacagcaggcagacctgcagtttccatccagttgtctgactgtagagaagtgttcattgccttaggccgtgagtgtgggaatgtggagcccctgccctggcacctgtacccacgtgtggggtccttcattgccaggaatatcctcccccagacatcccatggctcacttccttgcctcctttagacctatttccaaaggccacttttcaggaaagatttccctctctcaatgacagcccctccttggccatttttaaaccctccatccctgtttaatttttctctgtagcgtaatctggaagactgtgttttacttgtttgttcattgactgttctctccccacttgaaggtcagccccacagggcagggagtttgtctttcattcactgctgtaaccccagcatctaaaacggtctctgggcatataatactcaataaatattcactcattcattcattcactagccagcaggaagagcaatcatactactagtgagtaataacaacaatgctgtctaacaccagatttcacaatcttggcatattgacatttgggattggttgattctacttgctgggcaggggggcgctctcccgtgcactgtaggatggtcagcggcttccttggcccttccccaccagatgccagtagcaacctctaccccaagttgtgacaaccaaaaatgtctctaatctttcctaaatgctctctggggaacaaaatcgctctgcattgagaaacactggtctaactcaggccctgttccaggcaccttacttcttcattgccatgtggatttgggtctgtccaaagcagacccagagacaaggacttgggcccaggttgtttatttgggaggtgatcccaggtagttccagtgaggtcatgaagagctgagaccccagggccaccaggcctttaagggtcttcaactagagtaatggggagcccggaccaagtttcactactccaaacatttgcttatttccctgctgctcagaagcctttgatcaaggcaaaagagaatacaaacagcacatattactacgtttcccacctgaaaatgtttcctaacacgtggtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttattttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattagtaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactagcttgaacccggaaggcagaggttgcaatgagccaagattgcgccattgcgctccagcctgggcgacaagagtgaaactttgtctcaaaaaaaaaaaagaaaaaaatacagacttacagtccgggtgcagtggctcactcctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataagaagtaaataaataaatagaataagaacttacagtaagaaaaaaaataaaacagtctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtacccccgaacctaaaaattaaaaaaataaagtattagttagagaacaggctatgctgctgcaacaaaaagacccataaatacagggacccaacctgtgaggcattttcttctctctcagctattagtgcagagacagacatttgtggtaggcaggtagctctgctcgcaaagccatctagggacccagcttccttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccagcccacagtgaaaggttctatcactaaaagcaaagggtgaaggtgtgccaggaaccatagttatttctcccatggggagcctctgtgctgtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgcagaagggctgatggctgggggcttggccagaatcaaagcccagtacagaataagggcttcgactctccccaagaatggagcctcctcctggatggagaattgaaggggagggggcttagggttggttttcaaattcctagaattctagggggttcaccgctctctaatgatgaagcctccccgggggtgggggaggtaccaggaggcagagggcagtttctggaaggaacagcatgcaggtcgggggcctggaggcctaggaggtgcgagcgggcacccttgcacacctgtggctgtgcttctgactccacgtccatctgtgtgttgtgtgactgtgtccgctagagtgtgcggccgtatatgcaactgtgtggctgtccttgtgcctgtggctgaatatttgtgtgtgtgtgtgtgtgtgtgtgtgcatgcaaaagtgtgtgactgtattgtgagtgtacatgtgtgggtaagcgtgtgtgtatgtgggtgtggatatgtgtgtgcaggatttgtgtgtggggatgcgtgcgtatatgtctgtgtatatttgtgcgtctgacttgcttgtgtaaatgtctgtgtccccatgcgactgtagggctgagtgtgtgtttcagggtgtatccgtgaacatgtctatatggatgttgctgagcctgtgagagtatgtttgggatcaggtgagcttggactgcctgtgtttgtgtgcgtgtttgtgggtgtgcacgtgtgccacatgccgctgagtgagacccagggcctagcctggaacctggggtacagaggcgaggccgcctctctgggtgaggtgcgttccctgcacccgtcccgggagtctgccttctagaccctagcatgtgcacctgtcctgggagtcggccttctagaccccagcgtgtgtccctcctgcagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcaggtgagtgtggcaccccagccctgatcctggctcctgccccagtccccttctccctgtaagcgcctctcacccgcatggacgacctgccccaggaagcagccccagcacctgggcctgactgagagctcctcacatcttccccctgcccggctccttctttcatggcccctaccctttccctgtcacactagcatgtgaccgaagctcttgagccagcagactggctgcaaaccccagctctgcacctcccagctgggcgacactggggttaatttcttcctatctctgagcctcagtttcctcatctgtaaaatggggctactacatgctgttgtggggcgtgactgaaatcataagtgcagagcagtcggagcagccctaaggaatagtaggtggtcagtaagcactggatgttttatatccacgtatgtgtagatggaccccgacttacgatggtcaacttaagattgttagactttacgctggtgcagaagcaacatgcattctgtagaaactgtacttcaagttcccatccaaccattctgtttttcactttcagtatggtaatcaaattacacgacacattcaatattttattataaaataggctttgtgttagatgactttgcccaactctaggctaatgtaagtgttctgagcacagttaaggtaggctcggctaaggtatggtgttcagtaggttaactgtgttcagtgcattttgacttaagatattctcagcttgtagggggtatatcagtacataactccattgtaagtcaagaagcatctgtatctgttttcaaaatgcattgaattagaattgtctgagaatccttaacttccagaacttctgccaggactgttcagtttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatgaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccctgtccccgcttcggcatctcatagccctaatagctaaggacaggaccctcagacaagattggtgataattacagtgaccctatttgccgaaagtatactggggagtgcatgatctgccaaaacctctttttttttctgatttgagaatgtttttctctgaagtgtttcaagaaaggcatagacgtaaaatcagtcatgcatttaatgtcattatcattgcagataaagtgatgcaaatcccggaatcctgaactttgaagaaattatctacaaaaggctttgaaacaaagagatgcctttttggtttcctctacattccacttgctatttgcagggctttgtttggggttatagggtggcttctccagccagatagcctgggctgccacagctactcagccccttactgctgtgggcagcaaataacataaccttttcaggcctcatttgccttttctgtaaaatgggttcataatacttgaggtacttcacagggctctttgaggagtgagttaatctgtgtagagtgtccatcaattcacaagcacagtaaacaaccttcactgttttatcactgcttgtctctagacactcaatcctgccgtgggtgggtggggtgtatggtcctttggaggtaaaaccgcaagggcctgccagccactgtgaggctgctggagtgtggaagggatagccttttccaaaagagagctgtggggcgagttgcgagttcgttgggctatgccaccatttataataatgacggcataataggaatgccttgggcacttgtctttttcatcccctgatcttttcattcagccctatgatgtctaagaccaaggtcaaaccaagtcaaactagttcttaagggttcaaaccagttaaaaaaattcccatttcaagacagagctaaggaaagagggtcagtcattcagtggtgaccacaccagtgatgcctactgttaacatgcacctttggagtgctctctttaaattaagctttgctgcaagcctgcaaaaggagaagtagaaccaggaggcagtgctgcataggtttcagagtgcaggctcagaaccacagaaagaagtccaaagcctgtaactttcttcctccgtggccttgagcaggtcacccaacctctcttagcctcagttccttgatctgtaaaatagagatggcgatggtaaccatagtgactacttcatggggtagttatggggcttgagtgagagaaacacgtatgaagtgcttagaatagcacctggcccactgtaggtcctcagtgaatgtgtgccaccatcatccctgtcttcgtaaagggaggatatgagttcaggaatttacccaaaagatgcagagctggaagagctggaattccaagactgtccaccagcctcagagcctgtgtgtgtgtgtgcgtgtgtgtgtgtgtgtgtgtgtgtgtgtgtgtgagcttcccctcccaaatgaacgatttgaggcttccaaatggaactgtaagtggaattccccctagccttgttctcagggggctgacacttagcaataattactggtaatttactggtaattatatataggtttgaaaacattttgaattccagcaacttcccttggagcaaaaatctcaggggaagggtggcccccttgtcccagccttaccaaggaagaagctttttatttaagtttttaaaaactgcatatttgaaataatttcagacttataaaaatgttgcaaaagtagtaccttgaatcccccacccagattcaccagttgttaaaaaactaccgttacattttcctttatgctctctccccacttataaatctacgtgtgtatttttctggaccatttgagagtaagcgacaggccctgtgccgacacctaagatgccatcctcccgtaagagaggcttctagcgggtaccaatagtccttcaagtttgaccatccagcacctggaaccaggcatttgaggggttcacattttatgcaagaggaaaatgaacactgacatgtatagtaaatctggtttttcagagagtgggttcagggaaaatcggtgcatttttctgagtaggtttgaggtcacacagaagctgagctgcgggggctggcccctccttgtcctgcccaagacactgcttgagaagaatgaagtggggcttgtctagccttgagtgggaggcaatttgagaaaagtgacgagtaatcatttttggtaataaattataagtgattatatttggcctgaggagggggtccggggtccacatttacctctgtctccttgtggtgttatgggccagaattcacccccaggtaaagggggagcaggaaagttttggggagctcccccagcctacaaaaaccttagccatttgctttggaaaatagttattgctgcagttgctgatcagcaggcgctgacccaccggagggcctggagcggttccatggagcgttagcaccttgaccgataaatgtccgtgctggtcccaaacagcctgatgatttttagtatggccacaaaacaaaagaaaaagaaaatgtctggctaccgcgcatatgtgcttgattaaccttatagcagaaaaggcagcgctgatcaccaggatggagaagtgagctaaatttgagagagattgccacattcaagcatccacatgtcctggtcacattcctgtcagcaaatgctttcctgctaccatggggtgggtagcacggctagtcatgggacatgcatgaaattgccagcagttgaccactttttacacacaaagatagaattttcatacggctcatcctaatactgcatagatatgttttaaatgaaattgtttcttttaatcctcacaataactttaagaggtactaattttatgcctatttttaggagaggaaactgaggctcaaagaggacgagtgaggattcatactcaagttactttgtcatttgcagtaatgacatcagagtgtctcttgggcagactcaaaagagtgtcatctcttccccctgtgaacatattttgtaatgacatttactcaacagtgtgttgaaatttggcttccagttcatctgttaagacaatggttttggccgggcatggcggctcacgcctgtaatcccagcactttggcaggctgaggtgggtgaatcacctgaggtcaggagttcgaggccagcctgaccaacatggcgataccccatctctactcaaaatacaaaattgactgggtgtggtggcgcatgcctgtaatcccagctactcgggaggctgaggcaggagaatcacttgaacccaggaggcagaggttacagtgagctgagatcatgccactgcactccagcctgggcaacagagtgagacttcgtctaaaagaaaaaaaaaaaagacagtggttctgaaactttttgctctcaagaccgctgtaccctgaaagatgttaaggagatctcacagggctttcctttatgggttgatggctctggatattatcatattagaaactagagctgagacattacaaatgctcatgtagcctctgaacaattccattgtacactagtgagatggtgagactgaaaaacacaagtaattcctcagtgttattatgacaacagttttggccttctaaactcctaaaagaagttttttcctctcacttgttttccagatgggcgaatcctacgacacaaactttacaaagaatatccaggtaaaagaagaaactgttctttctttccagagggcacaaaaaaaaggcagtgaacgtttcttatgtgaagaaaaaaataaaagcccagggctgagatatagggaacaaaatgggacctgggattaagaaacaaaatagaagacctgtggtctgatggtgggcagggagttgtgagtcacagaggagctcatggtaaacatgacctcatgctgaagagcagagcctggaactgctcatatttaagcctctgctactttcattcagagaattggaaaacatgcctgataccactcttccattcatccatctaatcatccatcgatccatccatctctccatctattatttcatccatccattcatccctccatccatctacccacccatccatctacccaccatccatccatccatccaccgattcatccatccatcctctcattcatccattcatatatccatctattctttcatccatcttcctgttttttcatccattcattcctctatcaatctattcatccatctattcattcttccatccatccacccattcatccatccatccacatattcatctatcttttcacccacccatctatccttttatccacccctttattccttcatccctccatccatccgtcctttcattcacttacctattcaccaatcatccattcatctatccatccatccattcatacatacatcctttcacttatccatctatccacccatctacctttttttttttttgagatggagtctcactctgttgcctaggctggggtgcactggagtaatcttggctcactgcaaactctgcctcctgggttcaagcagttctcctgcgtcagcctcccaaatagctgggattacaggtgtccgccatcatacctggataatttttgtatttttagtagagacgaggtttcaccttgttggccaggctggtcttaaactcctgacctcaggtgatctgcccgcctcggcctcccaaagtgctagatttacaggcatgagccactgtgcctggccccatccacccatctgtctatccatttatccatccatccactcatccatccacccacccatctatgcatccacccaccatccatccacccacccattcatctatccattcactcattcatccattcatatattcatctaatctttcatccatccattttttcaagcatgcatccatccatccattcctccatcgatctattcatccatctgttcattcttccatctatccatctatatattcatctatcttttcatctacccatctattattttatccacccttctattcctttatccctccatccaaccatccttatatccactcatctatttgcccgtacatccattcacccaaccatccatccatctgcccattcatccattcatgcacatatccttgcattcattcatctatctcttctttcatccattcatacatccatccatccacccatccacccatctacccatccatccattcacctatgtatccattcatccatccacccatatatccatctatctattcagccatccagccagccatctatccatccatccatccatccatatatccatccgtccatccacccacccatctatccatccatccatccatccattcatctacccatctatccatctatccacccacccatatatccatgcatccatccatccatcatttatccattcacccattcacccatccatccatccatcatttatccattcacccatccatccatccattctcccatccatccgatatgtctttatcaataatttacagcacatattttctaagtattactcatcagtctgtgctgggggttggagctacatttgtgaacatgacagacccagtcgctgctgtcatgcagctaatatcaagcagaaaattcagacatgaatatagcccaagtggttattttatgagaatagtgacaagccttcctgacatcacatgctggatactatgaggacaccttagtccaggttgtgagaaaaggcttcctaaggaggagacatgaaagctcagcctaaagaataagaaatagtgggcagcagaatggcatgtgtgaagctcttgaggtcggaagcaatttggccatccccaaagctggagtgtgtggtgagctgtggaggtggtgggaggtaagaccagaaacatagacagagctggtgacaccagctggggggcctggggagggagaggaggcactgcaggtggggactgagtgaactcagctgggggagggaggagagggccaggtcaccaggcttcatttggcagttcctggtgagccacgggggggcattagagcaggaatagatacatctaccctaacagagctgtgttcttttcacagaaggtgactcaaagaatgtggcagaacctggaaggggacaacagaggcactttcagtaaagcaacggcaagcaggtgagtgggcagagagcaagagtcatggccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctaggctcaagccatcctcctgcctcagctttagtctcagtagctgggactacagacatacaccacctcacctggctaattttttttttgtattttttgtagagatgagttctcactatgttactcaggctggtcttgaactcctggcctcaagcagtcctcccactttggcctcccaaagtgctgggattgcaggcatgagtcactgtgcctggccttaactcttgtttatatccattagcctatggtaaaattgtttttgttatatagtaggtcattttgcttaaagttgcagtttccaataagctatccatgatgttaaatgaggacctactgcaatttcaaggcaggaacgtaggagaactttgtgtgtgatcagaagcagaagcaattctgtatccctctgaatcaaaaatccaagaccagactaggtcgcaactttccttttcattcctttgccttgatgtctccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttcgtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcataggtgcatgcaaagggctgtggagttgcagccctaaacctgaaaatctacccagcccctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatttcaacattttgggagaccgaagcaggcatatggtataatcccaggagttcaagcccagcctggcctggccaacatggtgaaaccctatctctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaaaaagtacagcctttggagcaagctaggtctgggtttaaattcttgttccagcactgtggatttagtaaataatttcggctctccaagcctcagcctcctcatctataaaatggaactgatggtaggggaggagttaggaactaaataagatgatgccgtgaagacgtcacagtgagttcagaattgggtcttctcagaaaggggcatcttcctggtgtttctgatggtggcggtggcggcggggagacgaaagatttgtgactctgtggtctgccctgcagtggttcaccctgacccttctttgtctctggtctgccctgcagcggttcaccctgatccttctttgcttgctttccagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccgcccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgagtctctggtgttttgtgatactttgtcactgtttaattcaggggtgggaagcagcgtgggtattgctgggatgaggtgtcagctaggctctgctcctggaaccctgtgttagcatagagcccctgaagcagaccttgggagggggatttgttgaaagtgattcattagggcggttcctgggaaaaactggcatgagagtggggaagcggaacaggaggagacagtcagacgagggagaggtgacgagggcccatggagggcacctttgctgcaatccctctgggggtcttggaggaagcctgagtcccaccagggctggctccagggctgtgcatccagaaggaccctatgcttggtttaatgatctgctgtcaccatttaaaaactcttagtcattgttgaacaaggggcctgcttgttcattttgcaaatgatgtcggtagccctgagccacactgtggagtcggtcccactggggctggacagcggaacccgagtatgcgtaacgcttccagcacccatcagtgggtggcgaggctgcccctccccctaagagaggaggcagcccacctgctgccagggagggagaggcacaaaggcacccaaggggacatcggcagagcccctggggcaccccggggctctcccattaaatcatgggtgccccacctgtgctagacggcttgctcgcactggcctggggttggctgaagtccccagggctcatcagagctgaggacagaggccctaagggactgtgcacccccagctagccacatacagtggaagcaaataattacaagcagcagagactccagggggcctggcaacgtctgtgcatctctcagatgaggaaactgtggatcttggagatctgaaaggacccacccaaagctgtgaagtcagtaagagccaaaaccaggattccgagcaggcagtcccaccccacactcaggctccagacagcctgctcttctgctagcctggcctgtcggagctgactccctcccgccactgaggtgtagaagggacgcctgacagtgtgccatcctgcggaggactctggagtggaagggactgggctgagctcatccctactccctggagggctgctcactagatggggtggagacactagagcctgttcagcctgagttccaatcctgggcaaggcacttgccctctcagagcctcagtctcctcttctctgaactgggtgtaataaaagtagctggctttcagagttcctgtaggtattgcgtgagatgctacatagtaagtgctgagcacacagggatggttataattattatcattagccgggcacaatgcacactaattctcttaatacaaaacctcgtgaaaagagtatgaacatccgcattttccagctgtagaaattcagcctcagagaagttaagcaagttgcctaggctcaaaaagaaagcaaatgacagagatgggctttgagcccagagcttctgatgcccaagactagacaggctggtcctaccttgtgttgagtcccaaccaccagctgggcggccctcacaggttactgaacatgcctcagcctcagggtccacatttctaaagtgtcaacgagaactccaacctcattatgattattactgtgaactcagtcacgatcatatgaatgggactggactgtcaagatgcaaataccaaggcaggaaggtggtcgtatactgccaagtggtcaaaaataagacctgctttctgctttcaaggagcccaagtccttgagggagtgagagaaatgagagagttatgatccagggtggggaaggcacagatgggagcaggggccggaggtgccaagagagcccagtgagggatgctaagccaaggcagaaggcagggaaggcagtaatcagggaagacatcctggaggtggtgatgtgctagttggtcataatatctgaacacttctgggaacgtgtgcatttcaaggggaactgctgtccctgtttggctta

SEQ ID NO: 16463 - DNA, 56448 bp, Human
  misc_feature (1)...(56448): n = A,T,C or G
gtattcatcttttcaatggcttttggatttggatttgggtaacatggtttatggttagaaggaagctccccatattttcttctggcacttttgtgatttccttcttttgagacagagtctcgctttatcgctcaagctcgagtgcaatggtgcgatctcagctcattgcaacctctgccccccgccccgggttcaagcgattctcctgcctcagcctcccaagtagctgggattacagtcgtctgccaccacgcctggctaatttttgtatttttagtagagatgggctttccccctgttatccaggctggtctcgaactcctgagcttatgagatcctcccacttcagcctcccaaaatgctgggattacaggagtgatccactgcgactggtctgatttcctttatttgtgtttaaatttttgatccttttggaattttccctgatcaaaggatccacctttgttcttctttctaatggccaattgtcccattacccttgtcaaggagtaaggtaggaatggctttgtggggtatgaaatgtgaatttctttttgtcttatttataacagcatctgcctctactcttctgaaactgtgttcctgtccacccacccattcaactacccattgattgactgattgattgattcattcaatttctcgtttttgtttttttgcttgttgagaattctaacattaattggacattgtccctgaccttttgggtttctatttaggatttgtttttatcacttaataaccaacaatgatgacattttatcgaatgtctagtatatttgttccaagtatcatttcaattacacttaaaacaaagcagtgatgtcagttatactatttttcccatttgaggagtcatttaaaagaggttttgaggctttccaatggcccccagttggaaagtggcagtactggatgcaattcaagagcccagtcttcaggatcctgcctttttacctacctggacgctgtaactggtctctgtggaatggctggatgagggaatgaatgaatgagtcagtgaaggaatgaggaagacagaatgagtcagctcgtgctttcagaggagcccaaagggagaggttaagataggaatgcaaatgaccagaatccagagtaaacgcgagcccaccagcgttttggaagcagtccactttctaccccctcctatttaaaatgcttcattctttccagttcctccccacctagaatccatggaaccaaacgctggggtagggacagtggccagcctgtctccttgggtttgacgcattacatcatccacgtggaggtcccctgtggagctctgcagccctgcagcctcaggggcaggggggtggggagaatgaggaagggggagagggggaataggaggagggagtaggggacagggagggaggagatgccaggagggtaagtggagaagagggaggcgaagccgggggcagcaggggagggggtcaaggaggaggaaagaggagagcttggggagaaggaaatagggaggatggagaagttttgggctgggataggcaagaagagggaggaggagagaggaagaagaataaagggggaaggcagaaagagggggaggggagggagggggaagaggtcagggaagtgggggacgcaagcagtgggggaagaagaggaaggaggagggagaggaggaaggcggggtgggaaagggggagggggtagtgggagtttccagggagggggggggaggggaggaggggaagtgagaaggagaaggagagagaagagggatgttgggggggannnnnnnnnnnnnnnnnnnngggagagtgagagggaggaggcaaagcccctactgcggcccccaccgcggagttgcgcaagccttccggtctgggattggccgccagagaatcaagacgctccgcccccgcagcccgacggccaatgaagaggcgggccgcggcctgggcggccaatgggcgcggtggggcggtgcgggccacggcctggggtccccgcgcgctctccgtccgcagtggaagccgacgccgcgctcgcatgctcgcaggcgccgcgtagccgtcgccaccgccgccagcccgtgcgccctcggcgcgtacccgccgcgctcccatccccgccgccggccaggggcgcgctcggccgccccggacagtgtcccgctgcggctccgcggcgatggccaccaagatcgacaaagaggcttgccgggcggcgtacaacctggtgcgcgacgacggctcggccgtcatctggtaggaacttttcattcgtctccacgccccgctccccgggctcgcgcggggcctcgtgcaccgagccggcctccaggcgggacggattcgggcctcccgcgctgtcttcctcgccttattccgggacggcgtgccaggcccccgcgggcttctccgtggccagcgcgtctgttagattgtcctctgcaagcgccgcgtcgcgcggccaccagcgctgatgtgtgtgtgtgtttttttcttctcccaacccaaagggtgacttttaaatatgacggctccaccatcgtccccggcgagcagggagcggagtaccagcacttcatccagcagtgcacaggtagggaggcgcgcctgccgggcggatgcgcggtcgttgggaggttgtctgcacccggggagccccggccagagcgaacccgggaggaaccggtggccacatggggtgcccctggcgcatggcgtgggaggaacccggtgtgagcgttttaaggcctcataaaaccttctcccctctggacatccgaagcaacagaagtgacccacctgcctccgccatcctacaatgccttctccaggcggggcagctcttttgccccctgcggtccactggttttctaaggtcaactcctgtgtttccaaactccagtgtccagctcttcccactgtcccctttgatcagtcactgagcccaaatacgaacaggctagggggctgcttggaagggaaagaaactcagccgcgccctcctttctcccgctatcattgtctgcccgtgtgctgattttatgtgatttttaatttgacgagtagaatcagatgcaaaagagtacacaccatatgattccatttagaaatcctagacaaggcgaaactaatctatggtgtgaatgtcagaatcgagattagcttttgaggctagatagccactgatggggaggggcacaccacccggactgctgggagctgaaaatgtctctgtagacatttgttgatctgggagggggttatgcaggtgtgtacccgcgtgaaaaatcatcagactgtatacttaagatttgtgtgccttaggcacttccctgtggcttgtgaaccatgaaaagaaagaccacgtggcaggcatcgccataaacccttcggtagtggcagaggctctgtgatgttggtaatgggaccttttaaagagattggagaatgcgactccctcccatctctggtctttagttggaagcaagctttcggacaacggcagcacagcccggaggttagggcgtggaccctgagccagacggtgtgggttacttatttatttatttatttatttatttatttttgagacagaatcttcctcttttgcccaggctggagtgcagtggtacaatctcagctaactgcaacctccgtctcccgggttcaagagattctcctgcctcagcctcctgagtagctgggattacaggcgcccacgaccacgcctggctaattttttgtaattttagtagagatgggggtttcaccattttggccaggctggtctctaacttctgaccttaggtgatctgcccaccttggcctctcaaagtgctgggattacaggcgtgagccactgcgcccggccgacggtgtgggttcgaatccctgaacggctgcttcctggctgtgtggtttggaacgagttccttaatctctgggggtcttggtttcctcacctgcactctcacagtgctgttgcgaggataagtgagtcagtatgtataaaatgctcagaacagtgcctgtacaagctacatgattgtttgcgaaataaataaaaagtacaaaattgtgccagggatcatgtgggtgtttctttccttaactgcttccataatcaaattatattttgcatttagttcaattcaaagggtatttgtggtgtgactactagaggatgggtgatactgagaacccgcgtgcacacacacacacacacacacacacacaaaactaaaattactccttgagcgctgcctgtagacattcattcattgcttttgtaaacagttggcctaaaatcgcagcataaagcactgcaacgatgtggagagttggcagggcaggatttgaacccaggcctccgtccctccgcctctgtagttgaatgcttttgcaagtggagtaagtgcaaactcttaactttctcccctccggtccgtgaacagccaggagagtcagcagtatttctgctttgccggctctgaggctatgctttacagaccagcttccctccctaaattcagcttctttcctcccgctggtcacccatccctcccttcccccatcaaaccatgttctgcctctgaagctactgttctctccagcaagtagaaggggatgaggaaaagagcatccatcccatcaggaggctcctggcaggtgctcccaggcctcagcccactctggtgtagtgggagaacacttccctcctcccacaggcttgtggttttctgctcagacccacctcctgccccccagggatgggagtggggagtggcgcgtgtctggcgaggaagctaaaaatgcttccctgctgtgtgtggatcctcatgaatgggccatgggagcttcagctgcagtgctttctttccccagccatctgttggacaaatgcataggagaattatggttgccgtgtctgctcttgttcctctcggaaacgcttgttccttcctgtcgtcgtgtcctcataacccagggacaatggactcaacactggcactggctggatagcagtcaccacgctcgacgtgccttatcttggtcatacctcagaacagcctggtgtggcaggtactaaggttactcctattctacagatgaggaaacggaggcccagagaggttaataggcttcctgcattcacccagctagaaagtggcagagttgggacttgaacccaggcaggctggctcggggcaggtgctcttggcttctgaggaggttgtttagattctcacctctcgtgggattgcttgcaggttgcaaatgacatggttgcccacttgtgactcagagagggctcttttgtggccccagttccctgccaggtatcctgacaggcctgagaagaaaggttccactctggttcgggcttcctgcttccaaacatctcacaaggtggccagcagacttggaaggccagaaacagcacccagtttcttccttataacctcagggtgtgggccttcctggggtcctgctcttctcccaaccctccccactctggcactcaggcattctctctgaaacacccccttccctggccctcccacctcaggctactgtcccttctccccttcctcccccacggctttccagaatgggatctctccacccagcctcccctcctcatttcttcccagcctcctggcctggcctttcctccctcagagctgttttccagagggccacgaggtgtctgtgctgccaggccagttccctcccacccccgcactcatcctcccaatctttctgcctgctctgggtctgcgctgcttcttcccgagcttgcctggctcccggccttcctcgctgcctgcccctccgctacctccgctcttgcttcttgctccatagctcagttcgcctgggatggtcagagaccttgcgagggcggtgagaaatgcccagtgcagattaatgtaagcagaaaatccactgtggcctctagcctggaaactccaggggaagtcctagcagcagcaaagactgcccgaactccaaacagcctctcctcctcctcctagctctgtcttcatccttcacctccattcttgcggggaggggggaggtttagcccctgggcagagccatcttggtggaaagacggagcaagcctctttgccagtgattttgggggtccctggactgtctttggccctgaggtcatgtgcccatccctagaccaatcatggagactctgcgtggccaggcctggatcacatgcccacctctggagtgggtggggggcggggcagccccactcaaaccaggagactgacttgaggaggtggcttcctagggaagaatggcatgccactttcacaaaagtgtccatttgccccttaacatctctgctttcctcttcatagcaacagtctatttgcccttaatcttccttgtctggtatccactctgtcctcccttgctggggtaattctttctacagtacatttctaatcaagtcactcctctgctcattaaccttctatggctcccttctgccccattggattacactcatgctgtctgcttggctttctagtcggtttgtccccacccatatctcctctctagtagctccacacaccctccctcacacacctgcagcccaacactgtaacatttcccgtcttggtgcttttgattttggaggtttctaccatgcggtattcctcttccccatctcaactcatttaggactcagccacccacctagcttagtgtgattccttcttcatttcaactctgagtacactttggaatcagaaacactctagtccaggcgccgtggctcatgcctgtaatcccggcactttgggaggccaaggcaggtggatcacttgaggccaggagttcgagaccagcctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattgtgtgtgtggccttgggcaagtgcctccctccctctgtgcctcagtttttaggtctgtaaaatgggaatcctgacatgcctactctctgagggtgactgggagggttcactgaagtaatgcacctaaaatgagagcacaggccacggtgtgtgttggctacccctaccactgcttttcttttttttgagacaaagtttttctctgtcgcccaggctggagtgcagcctctgcctcccggggtcaagagattctcctgcctcagcctcccaagtagctgggactacaggcatgtgccaccacacacggcaagtttttgtatttttagtagagacggggtttcaccatgttggccaggctggtctcaaactcctgacctcaggtgatccacctgcctcagcctcccaaaatgctgggattacaggcgtgagccaccgcgcccggcctcaaataattatttttactctgatagcactcgtagaggcattatgctttccactcggaagctttcagtacacgtccccactcagcacaaagtaggcacctggcccaggctggtatgcaataggcatttggccccatgtggacacgcattagacccttggcccgggtctgcatgaaggagcatgatgagaggtgcttagctcagtagttcaaggtttgggttttgtccgattgcctgggttcaaatacctgccattcatgtgctctggagcaggtgagttacccatctggtaacctgctacagtgtggtcattaggaggattaaggaagcaagtccttatgctgcgtgggacatagtgagcactccataaatgtcaattactgcgattgccatttttgtttttggaattcaagtgatgtggaagtagcgttcaagagcaccaagaagatggaagggggagagatgatgggaaggaaatgggtgctgagctgggctggagggtcacaggttcacctgacagagccactgggagcctggagcaatcagggctcagctggcagaggtggagggaaaggggccatttgccagaccggttgtatgatctacctggccacagcagaaagggcttacagatcacgtatgtgtggcgaggcagtggctggggctgtctgtgaaatcacattttgtttctgcaccattcagataatacatattctctgtggcatactcataaagcaagactaaaccaaaagaagagaataccaagtagatatagttcagatatagttttgcaaacactcaggaacttgttccttcctgtgtttattccttcattctcctgtttattcatttaattcattcgacatatgggactgctactctgtggggcacgactgtaggcactgaggataaatatagaagcagaaaaggcgcctgtcctcgtggagctgacattttattgtcatctcccaggacagaccgctggtctcatttttatctatattcttgaaatagttttctgtatgtaattctactacaaaaggggatcatagatattttagagccacctcccacaacaactgtaatgccaaagtttcttccctatcttcccctcttcttctgcaataccagtttaaaaatggctacgtagtttctctcatacaaatgtgacattgttaaagcaatcctctatccatggacctcaaattatgtgttgcaagcagttttattttagaaggaatccaggcatctgggaatgagtccagttttctgttggtgcagattttagagctgattggttaagagcatcagtggtgaggctggggcgtcttgctttgaacgatagccttgctgtgctgtgtgaccttgggcagatctcccagggtctgtgttttctcgtctgtaaaggtggggataatgattgcatgtaggttgctgtaaggataaactggcttgttccatataatgcttgtagagtactgcctgacacagagtaaagctcaataaatgtggttattgttaaagtagcaccttcagaaggtgttacatatcaatggataggttgaaataaatttgagatgtggggtggttaccagaaaaggcttcttcatgaagggcagcatcatgaagatgcttggttggaggcaggtgccctgtgacatttgttggatgatggtctgggtggagatgatattcccatgaggctctggtcagccagtagtgtttaacccaaaacaccacagagagagatgtagggattgatgtttttttttctgtccagcattccctcctttgggggaacctctcccttccatttcataataatcctggtcaaccaatgtagttcctgtgagagtgcacataacccagacctgtccaatcagagcaagccactcttctgctaaccgattggttcaagggcccttgtgactcaaatctagccaatcagattcatccctgagactttggacagagttgttggtaaagagtctttttatctttctctgggattaaaacaaataagaataatgagggcttggagctcacagggcatgtctaccatttatagagagtacctgtctgagaactcaggaacagagcctggtggtgggagtggagacaggtgacgtgccagaaaactctgggatccagccatgcctgaagctttctctttagacggttcactttcatgagccaagtaatattttttctcaggccagtgtgagtgggttctggatttagtttccatctaaaagagtcctggccatagtctccaggttaggcagctggacacagtctcagaggagaggagaatccaggctggacaaggaatttaaagcctctcatgtgagaactgactgaggaaattgggcatatttaaccttgtgagaccaagaggagagatccttgggagataccagtgttgtcttcagatgtttgaggggctgtcatgtggtaagtgtggacttcttgtgttcctacccccacaccaaccctatgtggtaaatgggaccacgcagtaggaattcagggatagtgtgttagtctcttctcacgctgctatgaagaaatacccgtgactgggtaatttgtaaagaaaagaggtttaattggctcacagttttgcatggctggggaggcctcaggaaacttacaatcatggcaaaaggggaagcaaacacatccttctttacgtggcagcaggagacagactgagagccaagtgaagggggaagccccttataaaaccatcagttttgtgagaactatcaccaaaacagtatgggggaaactgcccccctgagtcaattatctccaccccgtcctgcccttgacacttattacaattcaaggtgagatttgggtggggacccagagccaaaccatatcagatagattttgggttgacctggagaggaagaggcccttaaggtagaacgggctaccagaggagaaagtgaggcccccatcacaggaggtatgtcaggagagtccgactaaccacttggcatagatgttgaagaaaggattgaaggaggccttccttgcctctgcactctcctgtctcacagccccattttctggcctgctatgcctccaggaagactgactggccttagtgcaggcctaggggatgcctcttggaggtggcatcagccctacctggatgacagagactgagagtggcagagaggtggttcctacggaaaactggagtatagcgaccaaaagaagggagctggaatgcgaaggagtcaaattcacttgctgtccatgacctctgcgtatatggcaatacaacacacagagagccggcagtctatttatcgtgctgttttgcacctgaatattttttccctagctgaacatacacacccgggtttcagaaatttgggcgagaagggaaggagagaaattgctttctttcctaaggtctaagggaatgtgacatcaaaaagaagctccaaatctgtgacagggctttgggcagttataaagtgctgaacagtctgtccgttaatgcacgcgacaaacattttattgggttcctactttgctccagaaacaatgttgggtttttaatttaatttaatttttgagacaaggtcgtgccctgtcacccagtctggagtgcagtggcacgatcttggctcactgcaacctctgcctcccagctcaggcgattctcctacctcagcgtctccagtagcagggactacaggcgcctgctaccacgcctggctcatttttgtatcttttgtagagacagggtttcactatgttgtccaggcaggtctcgaactcctgggctcaagcgatccacttgccttggcctctcaaagtgttggaattacaggcgtgagccaccccgcccggctgggtttttgtttttaagtggtaccctgaagggctgcgaaaacattacctttgtaattttctgcactatccagtctcccattgccttctttgcccacagatctgttgctgggaggccctgagccacgctgcatagcttttttgtgtgtccacaggggcgtgggctttgtggtagctctttcagtctactgcatggtgatgtttgtgctttcttttctgtttgtggctgtgtcaccacaaacagaaaatgatgaaggatgatagatgtgtatcttcctggtaagtacagtgtctcaagttcaaaaaaagcattccctaaacactagttgaattgggtttttgtcccttgaaaatattcagaagttaatgcaaactttttgaaagcatcccttacagattttataggtgttataaatacctccttgtctcccatcctttctttaccccatttcattctggtgcccacccacacccagagcatggagctctatgtctaggtctttggtaaatattccagttgccagatttagtggtcatttctttgtctctgatccactttacctccctccagcatttgccagtggccagcacctcctgaaaagatagtccccctcgcttgtgcttctgcttctgcgtggctagacttgcctagttctccttttatgtctctctcctgtcattctcacttccttctgctgctgcttctgcttcctgcccgataagtctaggcgtttcttagggctccacccttgatcatgaccttgtcttctccgggacatttctcgagcatctactatgccccaagccctttgccaagtactgagttgagtcctttccctgaccccagtgagcttgcagtccaggctaggggtggctttctaaccttcaggtcaggttgctcccccgcctcccacttccaacaccttttctccataaggtccaaacgctcagacatgacatggggtgccctttatgacaggtgctggccagccgacccctccagtgtgtgtccccaacacacacgatgctgaccttagggatgcccaagtcccaggccctacgtaggagctctgcgtgtgttagtttatctaatttatcttctctctgagggagtaatgagcagagtgacacccacaagtagaaattatccccacttcactgaggaggaacctgacattttccttggagagccagagtcgcttgctggagatgctgcagttgggaagaactgcactttgaatccagatctgtgtccgaggctctcagctcttcccctgtgccgcgctggcctgccttcccgcttccctaggcctgtggactctcttccctctgcctgcactgtcttcatctgtttcgccttcctggaggactcctacacacccgtcaaggcccggtgtgaatgttccctctgctcggatgccctccttgtctttgtggtgttggtgtcccgtgtggtggtcgtgtgcatgtctgtttcttcaactccttggcgaagtcctcctggagagagggactttgtccctttggtggtggtatccttggcggggaatccccatccttcatggttagatggctgccaatctctttcccccatgggtgtgttgctcccttgagtgggcccaagtcatgggctgaatcctgggtcataggcttttcccagcacgtgctggctgtccactcctttgtctcttgcttatagaagagaacccgtaatgcctgggttcaaatttcagctctacttcttatgggctgtaggcgcctgggacagaatcctacagttactgctgtgggcacctgggacagaatccctcagggaccctaagaggaacatggagggtgcagccctgggaggcgggggcacgtagccaccgactcttatcccccattggttgaggggtcctttaggggctttagggtttctgcactccaggctgtgcctctgtgaggttgagcagctagacgtggcaggatgtcatggtgtacccaagtggctacgcccactaccactgaaaccagacatggccttggagaaggtgacaaggagtcaaaaagcatctccttgcagcatttagcagtgcctaagatcatagccacatgtgcagttatgcacctgtttatcttgtgactttcctgggagcatccaagccccgtggggcaaccaggtcagctttgttctctgcagtattggcagcgctgggaacagtacctggcagcctgcacagatgttgttgagtaggcaaatgagtgacagtccatgtagatgtctgagagctaagctcacacaggagggcccgccgtcccctcctccaaagtaacagcccagtggcccacaaggctcccggccgctaccactggccatgtgactgctctggccccaggcctcttactccagagcccaggcatcgccaccttcctctcccacttaagcaagtgcctgtgacttttctgattcagctcagtggcctcagcagtggcaggtccccagaggctggtttttgaaggcaggcatggcacgtcagcatttaatattttatttcatgagtgcattttgaaattaacctgccatagatcttgtttttagttctgtacttagtttatggtcatcacgcttttcttcatgcacttattcttactttgtcttctaggtacttaggtaagcttcctagcgagcaataaataaataagttgataacaacaatggttaacagtggacctttattaggccaggcattagccagggtcattgtgttactttcctatggccactgtaacaaatgaccacaaacttggtgaattaaaacaacataaatgcatcatcttatagttctgcaagtcaaaagtctgacatgagcctcacaggactaaaatccaggtgtggacagggctgctttctcctggaggctccaggggagaatccattttcttgccttcttgtgcttccagagactgcctgcattctttggcttgtggccacttcctctgtcttcaaagccagtactggcaggtcgagtcctcatgatgccagctctctggttctggccctcttccccacccttccccatttaaggactgcagtgatcacgtgggtgtcacccagataacccaggagaatctcccatctcaggatccttaccttaaccacaccctcaaagcccttttgccatgtgagggacatattcacagttttggggtttaggacatagatgtcttaggggccgttgttttgcctgccgcagtcacttgtgatttcatttaatatgcccagtgacccagcatcgcgggccctgttgttatcccatttcacagccgaggcagtacgcaggccaggctgcaattcttacctggcgtgtgtgcttctcgcccccactcctgacaccccctgcaccccagcttgcaatgtaaaatctttgtgaaacaagaagggaagaccacgggaggctcttctgtggaacaccgtggggcagacctaaggcccaggcccaggccatggggggccgtgggaagtgtttagaggccactgttgtttagaggccatttctgccattgttgttgacacagaaagcctgtgcgtgtgtctggggagcaatgctccttaattcctgaacccgagtgttccctcctgccctggagagactttcccaggaaatcccgatttccctacttttgcctgcagggctcgcctttggaggtctgctctgacccggaagcacttttctccccgtttctggctagaattctacgctgcttataaaatggagtgtattgttcatggcttgcaaataaaagctgctgctgcttcaggcgggccaggggtcagctggagctgggggaggggtgaaaagaacctggcttgagatgcaaagagccaggctcctggcggcccctgtgtgacccctacagccacagccccctctgggcccctgcctaacagagggacagagagagggctgtgtccaccctgcagctctctggatttggccaaacctggctgctgtgtggcccattcttgggaacaccacactctcttcctgggtgactttgatcactcatccccccaacacatataaactgagcactcacggtctgctgggcactcgtgctgggagagctcagtggggtgcatcaccatgcacaaccttgtgaatggaccgaaacccactgaaatgtccactttcacagggtgcagttcatgctgtgtaaatcatatcttaggatgaaaaagcataaagaaaaaaggaggatgaggctcctgggtgggcaggaggacaggaacctagtagggccatggggtgggggccgtgggaggggagcgtgggtggggagtgagggtggagagcagggggtgagggctgtggagggtgagtgtggggtggggagcagggggtggggaccgtggcatgagggctatggccggtgagtgtggatggggagcgcaggggttggggagtagggggtagtgtaggtgggggccatggggtgagggctgtggagcagggagcatgggtggggagtgggaggggagcatgggtgagaaggcggttggggagtatggggttgggccgtggtggggcagcgggagggagaggggagttgcgggggtagtagggagtggggagcatggggtgggggccatcagggagggaggtgggtggggagtggcgggtagaaagtggggggaggtgggtagctggcagggcccagggtgcagtggccccgggagccatgtgaggcctctgggttttcctggagcagtgcgcattttattctgatcacttttgtttcatgtcctcctagaactttgccttggccctttctgtggctcattcccagctgggcagggtcttattctgccacttcttctgggtccccaggcatgatgcgccaaccccacaggccctgagcagcccttttccctgagcacagccctgcctctcccctctgaactcccggctcccccactgcctccattcgcttcatagtctgttgccattgtcaccgttggtcccaaggccgccttgtccttatcatcctcacctagcgcttcccaacacttcctgtgtgccaggcccgattcccagggcatcaccccctcagctggctgatgaggatcaacgtgctgtgtcaccgatgaggagacctccagggggaggcttgctggtcccctgggctctcagtgggtccccctgtgtttacggcagagctgtgacgccgtgttgtacccacggccgggtttcagtgtgttcactcagagcctggcgcagagccctggctgagtcacacttcgttgcctcagtcctttgggaagaggggaggttctgcctcggatgttgcatggggtaatgaataagtgaatccgtagaagagtaaagtgagtcagctgtccccgtgggggctggtgtgcgcaggcttgcgggctggagtgttgttaaagtccacggggaaggaaaactggctgcgagtctgcccccaccaaccaggggctcccaggcagagatggagaggcctccggggaactggggggcagagaggggaagtcgctgggccattgttacatgggaggaaaggggcagagccaggacctgaaccctggtctccaggctctcatgccgctgaggtttcaagccagctgcgtccctctgggctaccgttcttggtgcatgtgaaaggtggagaagcagcttccttgttacgcaggcatcactgactctggcatcgctgactccagcaacactgcctttttgtccttccctttccatgcacttttttttttttttgagatgaagtctctgtcgcccaggctggagtgcagtggcatgatctcagcttactgcaacctctgcctcctggactcaagcaattctcctacgtcagcctcccgagtagctgggattacaggtgtgcaccaccatgaatggctaatttttgtatttttagtagagacagggttttgccgggttggccaggctggtctcgaattcctgagctcaagtgatctgctcgccttggcctcccaaagtgctgggattacaggcatgagccactgcgtctggccacatgtgcttttattaaaccacaaatttgtcaaaacaaatcagttgttatgtctgtccatatccattcgttcctgcctgtctattcattcctgctctctgggggtggaagtcacactttaaaaatcctgacaaagaattggttttattcttttttttttttaattaaaagaaaaaaagttttttgagacagagtctcactgtggcccaggctggagtgcagtggtgcgatcatagttcactgcagcctcaacctcctgggctcaagcaatcctcctgcctcggcctcccaaagtgttgggattacaggtgtgagctgctgtgcccatctgcttggttttactcttataaaatggcacccccccacccccattgaactgaaacgcagctgcaagtttggaactgaaaagcctctgagaagtcaaagatgccatgtagatgcccttcatttattcaggaagtatgtattgagtacatgtggggcatcgtctgggtgctttggatgtgctagggaacgagattccttccctcctggagtagggctgagcaagctgaaggaggcctgtagctcattctgagactttaagctcttagtttgcacacagttatcatcagctgcatcatatgcccttctggcttgtggtgagtcggaaaaagagagaagggctggtggaggaaggcgttttgaacttgccagcagaggctgttgctttgtctggagttctgtcacaatctccctctcaaattgtcaacaagaaccctctttgtccttaccctgttctctggaggaactctgagtcatccttcaagaccctgatcaggatgggtgcggtggcttatgcctgtagtcccagcactttgggaggccaggatggggggatcacgaggtcaagagttcgagaccagcctggccaacatggtgaaacctggtctatattaaaatacaaaaattagctgggtgtggtggagcgtgccagtaatcccagctactcgggaggctgaggcaggagaactgcttgaacccgggaggcggaggttgcatgagccgagattgtgcccctgcactccagcctgggtgacagagcaagactccgtctcggggggataaaagaaaaagaccctaatcaaacatcacctcctctgcaaagccagtcctggtcacagctgcccaggcagagcggatttccttctttccttgatgctcctgtaactgccagtcacaactctttgccatagcagtaatttcatggtattcacacactacatttttgtttgctatggtagactgtatattttttgaaggtagggattgcattttcagcaaaatccctgtatcacagattgtcagtaagtgtttgtcaaataaccaacccacagcgatggaagaggcagcacaacagtgaaaagcagacacaagagtataaagcagtgtgtgccagggctgttcagtgattgggagccagacgctgaacccctcagtggcgcagcgtctccttatagatgctatagatactgtaataaggtcctcagagcctccagggactgcttacagccactcttctctaagtcagagggtggagtcaggtctaacacactaactcccatttaaggaagtagagaattatcatgaaagaaagtgctagtgctttgtcatagggggaaaacctttagctctcggtttaatttcggtatccagatcagcttataccccggaggttctgccgaagtaatcatctttcttttcctctggccatcctgtacttcattttcttatgttctctgtcaagctaggaaagctgggtcattcacacctagtgaaaatgcaatgaatcggggatcatttgaggagtctcctgcgtgggatatcaaaccgcatttacagtgtgagctccaatgcagaaacaatgtgcctacacgcagatacccacacaatgcggatcacataaagaaacagagccttggccgggcgcagtggctcgcgcctgtaatcctggctctttgggagactgaggcgggcagttcacctgaggtcaggggttcgagatcagcctggccaacacggtgaaagcccgtctgtactaaaactacaaaaattagccgagcatggtggcaggcgcctgtaatccctgctattcaggaggctgaggcaggagaatcgcttgaacccaggaggcggaggttgcagtaagctgagatcgtgccacggcactgcaggctggacaacagagcgagatttcgtctcaaaaaaaaaaaaaaaaaaagagcctttattcatgccctataaggaataaaccaaaaggagtttagaaataaacagagtaatgggtttcagtttttacactttttaatacttttgcaaagttttttgagcaggacaggagggtgtttttggtttggttttgtttttgtcaactgcagggagttaggaaagtcactctgaaaaaagacagcaagtggtatagtgatatcaggcctcttagtaatgagagctctcccttcaacttcagcaacgaacctggccccttccagccccagcctcaggccccctccctcttacagacgtgggcggccactgagccctccttcctctttggtggcaagaagacatttctccttccccagccttgccctctctccccttagcagcctgctagaagccagccgctgccatggcgactgcccagctgtccccttgctctgggcagcaggatgtaagaattctttcccatttcctttcatcctcgctccagggagctccctcggtggaagctgacagctcagctttttggtgtgtgggttgttttttcccttcctgagccgtgtttgcataacctctccggagtctctgtaaagttagggcagctttagagtgagctgcaatcttgccgctctctggggcaacttcctcctgtcctccccttccccctttctttggccttgctctaaagttcagtgttgggtggaaattctgaaatgattcttttttctttccattggcccacagataacgtataaggtgcctatgacatgcctggcatggtgatcagtgctggggccataacaagacccagacagatgtgaaagtagctgaaaagatccaaaggacttacgctaaaaagtttctagggtggtgggggatccttaatttcttcattttgcttttttgtgtttctcattattctacacctagtatgtgtttttgtaatgaaaaaaggttgttcaaaacatttgcaaaagtgttaagaaagttacacagtgctcgacccatagcagatcctccttcctcgggggtttggtcctccagccaggactggctttggcgatacgcagaggagactagaatctctttggggaaaaggcagaggcccccagtcaatgtggatcctgggtgggggccgccctggtgagaacactgggtgcctggccagaatctcttcctcagtgctgacctgagcctgagatttcaagtttgggtgggagggggaagggggggaggggcaagccttcagagcttagtgtgggcggtatgccgtttgtaacttttggggagttattagagcggctcatcctggtggctttggtgattacagataattcttgcctttacccccctccctagcccctttgtggtcatcctctgtttctgttgtcactgggttttctcccacatccccatccctttgactgcccagcagctccagcctgatcacccccgaccccgcttggaccccccctgcttgctcccccccacccctgccgcttggtccccgccgcccccacttggttctcccgcttggtctcctgcttggtctccttgtgtggtccttcccacccccactgtctctcctttaccccctctggcctttccctgccccatccctctctcttccagagaggtcggggttggtgggggggggttgggggggagaaggggaggaggaggcacagatggggaggaggtgggagaggcgtaaaggcacctccaggacccaggggaaaggtcagaggagagccaggagagggaaaggccagagaaaagagcatgtaacagccaccagggccggctgctgagttcacagctctgcgccaggcggtatcctgagaacgttaggatgctgatttgttgacacagatgaacttacttagtaaatgaaggcagagaaccttgaagagatgacctgggcattggactgaggctccctttacctaccttcagggccctgcctggggcttctaggtccccacgggtcctttgcaggagccaaagctccatcattggcttctgatgaggcttcatagaccagtggaaggaagggtccggctcttttgagagtgaagttttattaacgttaaacataacagctgtgtcttttcatgaacaagactctctctgggtgggaaggggagggcatccatagtcttcaaatcagggacatccagcgtgcaattggcctgggctctgagtgcatgacaccgaccagaaggaaaccaccgtcctcaggatggggctcctgaccttgctgtatcctcagtgacggcagccctgagatggggctcagtgtgatgctatgatatgcatctgaatcctcgtggcttatgggcaagcagaggagctagaggcagcacaggcagaaaggcctcctggtacccagggctgatagtcagtagctctcttgctaatgatggctgttccctctcttggggtgtgggattttggggagggagcactggagggactgtcctggtggtctttgatgggcgtgctcaggaaccacggactctgcaggaagctgcttcatgcagtcatttgcttaaaataaaaggcagacaggcagcaaggagggcgtgggggctgaactctgagcacttcagcttttctgtccttgagacctttgtctcgtcccctctcccagcagtgagttctcaccatttcctcttctccacctcttcctctaagtcagtgggtctcaaggtttggcagcctcagaatcaccctggggctcattcgagcacagtttcagagctccactcccagcgtctggatcagtagggctgagtggagcctgagtacccacatttctaataagttcccgggtgctgtggtgctgctggtccgaggaccacactttgagaactgctgctgtggacttcagcagctctgcagcgggcagggaggattgtgtggctcattctcacttcacctctccaagcctcagtttcttcatctgtgaaatgggactgcgatctgtgctgccctcacagaggagaagaatctgcagtgtgcagattcttagagtggggactggcccctcataagtgcttagtagacttggggctcagttacctctcagaccttcactgtcttccatctctcctcaagaaagactcacagaaggagtgactccgtgactgtgtgcctcggagtgcctcactctgaaacccagagctggatgcagaaagtggtccccattctacagctggaacagctgaggctcagagcatgaagcaccctcatctgatgttccatagctagaaggaagccggctgggatgcggcccctgctaggatgcggccctggctgggatgcggccctggctggctgatctctctggagtttgtgctcttctaagtgctccagattgccttagcgaacagttgtgtgtaaggggtgcgaggtgccaggaaatggcgagaaacagagggcagactctgtccaccttgttaaggacagagcagtggagagttgtgagggcaggggctggtgcgtcagtgttctgtggtggtagctgagatctcccagggagagagtgtcaggggaaaggagaggatgaggtggaaccctggggagtgtgtgtgtggagacagagggggtggaagagccggggagaaagtagaaggcgggatcagtgctctgagaaccaagatggcaccatgccctgggtgccgtgggaagggagaggttcaaggagggcagaattgataatggcgtgaaacgccaccagtgggcatggagaagatgctgttggctttggcaattaggaggcccctgtggacccctgagggcagtttcactggagaggtgttgggggtcaaaaatcagcaatgattcccatcagccaacccttcagacctcatttctttttcatgtaatcctcccaaccactttatgaggtaagtatttgacccattttgtggatgaggaaactgaggcttagagacattcaggactctgggctgggtcacaaggctagtacatgtgggggtaagtttctaaaggattctggaatttgaacttgcaccctggacattgcagagaaggttaagggtatagaccactcccctgtgctgagggctccagcagaaggagctcatggcatctgtctctggtacctgtgtttgggtgaagtcctgggtcccccgtcccccactggggttgcccagtctccctgtctcctctgcctagacctggactctcagcttcagtttgaagagatggaccattggccctgttggggaccaagtggcacagtgagggtgatggaaagcccaggtaccaaccttcttctgggcagttttgccgtcttagtgcatacacacacacatatacacatacatgtatatataacacacatacacatacacatacatgtatatatataacacacacatacacatacatgtatatataacacacatacacaaatacatgaatatatatacacacatatatacacctgtactcacaaatgtatgtatatacacacatatacaaacacacctgtacacatatagacacatattatacacataaatatatgtatatatacacatacacaaatatatacgcacacacatgtcacactaatatatacatgacagcgtttctctgtgccctttagtagatatgccagtgttcccgcgtacaggagtgacaatagcccgacatagacgagggagcctagggctccccactgctgatgtggggctgtgactgccactggggtttgtggacccaatttgttcagaagagggaaagtaactgaaccagggatgaagaactagcgattccccttccactgcccagtgtgaggtcaaaagggaccgagaacctccttcagggtgagcagggttggggagaggcctccagtctgccgggcagctgcaaaaacggtgcgcagaccaacaggttttccgtctccgactcagctgacccgtcactgtcgtgccagatctctagcagcaaacatttgtaagcataacgtgactcggattttcaaaaacaggcctgtcagcaatcttgttgaccaaaccattgtcggataagcacgcagcagtcacctagcaaaccacgtccctctttaccccgctcccccacgatcatttaaatgacatcaggctgtggttctggaaggttcccagtgtccttggggttgtgggtgtgacttacttattgtacatctatcttgtgccaggccctgggctggtacttgggacacagggacaatgcctgtggttcttcaacaagaatctgtgaccctccgggggcaaagggtgttgcccaaggtagacctggggaggtctgaaagaggggaagggtggatgtggagggttggaggtgcgcagagcatggccggcatgtggaggcacttggcagccagcagagagggcagacgctggaaaagccatggagctccgcagaggagccagccagagccgtgggagggggcgacactgagaagagagagaggctgggagagctggctcagcccgaagccttggccctgggctgaacacatggttgaggtccccaaaaactgcgttggcccaaagcagggctggtaacttacctccatggaggcttgggccagggatgggtagtttggatccaagtccgggctgaccaatgtggaaatgggaacccgagagcggttaccatggaaacacactcaccgtgttcttttgcttgtgaaatgcagtcggaggcggatgttcagcccctcctccccctcaggtcaaggctgccatttaattaagcactttggtgttgatgctctgacgacactcctcaaaacagagccctggcttcccagacaccacggggactgctgagaaatgctctcgagctaaagcgctgctcccccacactccaagtctgcaccagccgcctgtggctgcgcactttgcaccttacaagtgaggaactgccatctcttgcaccagtctcgtttcctgtgcgctgtggccacctggcagccccgccctgtgtcaggagctttaggttggaggttccaccctgatgggctaggtgggttttgtagctttcactttcagtcatcatggtcaactgataagggaggcgtgaaatcaccccattttggaaggatcccaaatgtctatcaactgatgcactgataagcaaaatgtgctctctccatgcaatggagtgctgttcagccataaaaggaatgaagtggtgacccgcacatgcggcagcagggatgatccttggagatgtgacgctgagtgaaagccagaccgcagaggccacatagcatatgagtccatttcaatgaaatgtccagcacaggccaatccatagagacagaaagtggaagagtggctgccagggcctgggggagtggggtggagaatggggagtgactgttcttgaggacgggagttctcgttggagtggtgaaattagatagtagcgatgatggcacaacattgtgagtgtccttaaagccactgaattggatgctttaaagtggttaaaatggccgggcgcggtggctcacgcttgtaatcccagcactttgggaggccgaggtgggcggatcacgaggtcaggagatcaagaccacggtgaaaccccgtctctactaaaaatacaaaaaattagccgggcgtggtggcgggcgcctgtagtcccagctactcggggggctgaggcaggagaatggtgtgaacccggaaggcggagcttgcagtgagcggagatcgcgccactgcactccagcctgggcgacggagcgagactcccttctcaaaaaaaaaaaaagtggttaaaatggtgaattttatgttatgtgacttttatctcaataaagaaaagaacgtgttttacaggtgaggcagcccaggctgatgtttgggaattcaggcacagtccccggggcatgggaggtggggccctcacccctcggggtctcctgtgccctggactcctctgtcctcaccttctcacatccagttggtcaccaggccctgtggattcacctgcgcagtgtccctgagaccatccttccttctatccctgctgcgttgttacctactgacccccagatagccatggcctggtggggcatttccctggagaaagggggctgagcacacacacccaaggtgtccaggcccttggctctggcctcgtgttgagagtctggccacatcacgtggcctctgagcctccagcccttatcaatgaaggtgatttggatgttgatgatgaaagtggccatgacgtctctacctcatctgcctcccagcgttgttacaaagaccaaatgagatgaaatagaagcatgttttgtaaactgaaaagtgctgtgccaatgtgagtggtgatgacgatcagtttcctttaagaagtaagtgttgtggagtccctgaccctggactgcagctaggatcacgcattcatggtctgctgagagctgcgtgttccttagctcccggggacaaatggatgacccgttagaccacccggcttcttgttgaaggcgaacgtgctggttaccccctccggttttgagataatcaccaggaagtgagcttgtcagctgcaggccagtatctcctgtagacaggtggtttgtgtccttgggtcttggtgctaacctacatgcttcgtgcgggactctgcagggacgtacttagattctaggaagaaacgcagattgattttttttttttttttttaactcagtgtgatcctttgaccagtagcatcagcatcactgggaagcttcttagaagcgtagaccccagagctgtttaatcagaagctgcgtttaagatttccccagtgattcaaatccacacaatgtttgagaagcaaacatatcgctctacgatatcattaggtgcctgagaaaccctcacaccagcaactaaacgccctgagagagcatcagtttatgcaagtggctaatacaaggtgaatgactccaaaccagtggcatccctatgtgccagcaaccaccacttaggaattgtaatgagatcttggtgataatggcagttaaaatatgaactgtttgtgaagtaagctgaataaggatatgtgatcccctcaagaggcacagaactttgttggaaaacacaaaaggggtcccaattaaatggggacaccaacggtttacagcagaggttctcaactgggggtgttctgccccctttggaggacatctgcaatgtatggaggcatttttgtttgtcataactggtggggccaggtgaggggtgctgctcagcaccctgcaatttacgggatggttcctaccagagagaatgatctggccccagatgccagttgagctgatgttgaacaattttggtttatcctagtggggtacacatgcacccgcatgcacacgcacacacatgcaatgcacacatacacatgcacgcacatatttttattttattttattttattttattttattttattttattttattttattttattttatttgagacagggtctcagttggccacccaggctggagtacagtggcgtaatctctactcaactgcagtctcaacctcctgggctcaagtgatcctcccaccttagcctccctggtagctgggactacaggtgcctgccaccgtgcccagctaattttttgggtttttttttttttttttttttttttttttagagaggtgatttctccatgttgcccaggttggtctcaagctcttgggctgaagtgatcctcccacctttgcctcccaaagtgctgggattacaggggtgagccaccatacctggccaatacacacatcactttaaaaattcaaaaaatcaggctgggcgcggtggctcacgcctgtaatcccagcactttgggaggctgaggcgggtggaatacaaggtcaggagatcaagattcatcctggctaacacagtgaaaccccatctctactaaaaatacaaaaaattagccaggtgtggtggtgggcgcctgtagtcccagctactcgggaggctgaggcaggagaatggtgtgaaccctagaggccaagcttgcagtgagtcgagatcgcgccactgcacttcagcctgggcgacagagcgagactctgtctcaaaaaaaaaaaaaaaaattccagaatatcaaatgatattttgataatacagagcagtggagggtgggggaacttagcatagtggattgtgaaacaaattttaaagtcatgataataaaaacagtgtggcattgaaataaaacttaatgtggatcaatggaacaaaatagccctcaaagccattttaataaaaatgactatataagatagaacaagcataacacagccaatggaaatgtgttcagaattcattgttgacctaattgccctagtcataagtgaaatatcctcggagccatatcccgggccaaattaagagccattttctttgtttcctcttcatacccagcaccccccttgcccctcctgtctctctacagtgtagagtctcattccaaactgcaaagattgaggcaaaaagagttgatgaatttctggtctacaaagaggatgaatttctggtccctaaataagatccataatttgagcctttttaaatttttatttttaaattttttttggctgggccctggcactgctggcggcacccacatctgtgcaatgggcccacccagactttgagccttgattgtaggaaggctgtaggcgttgcagccagaaaggcctgggtttaaatcccagcatgaccttgaattccctcacaaccttgaaagtgccatgtgacttctctgaatctccatttcccatctgtgaaatgggcatgaagcctgcagcactgttgccaggattcaggggagtgtgacaagggcagcggatgagtgcttccctcctgtcctctgcacatggtgctcccagggaactgcaccggtctcctgctgtgctgctccaggcgcactcgtggctcacagcctctccccagggacatgacatgggggtgttttaacgcagcaccatgttctcttttcgcttttggccacagatgacgtccggttgtttgccttcgtgcgcttcaccaccggggatgccatgagcaagaggtccaagtttgccctcatcacgtggatcggtgagaacgtcagcgggctgcagcgcgccaaaaccgggacggacaagaccctggtgaaggaggtcgtacaggtactgagttcctccagagtctggaggtcaaagctcgccaagggtcaccatcctgcaaggagggagagggctgggttcgactcctgggtctgtagcttagctgtgacttgggacaagccatgctatgtctctgcaccagtaaagccattggtgaaatgtcaccagaattgtttcaggatgctggctaggaggaggtaactgtgtttacgatcccacctatcccataacagaagcttggcagctgggtgcctgcctccgtgggtggggcaggttgcttgcttctagagacgggaactggtggggggacccgaatagcggccactaccctgtggtgtcctggctgactgtcggcggtggtcgcaaggatcccgtgggagaattcatttgtaccctctctgaacagtgcctactttaagtcttttccattctggccattaaagaaaatggacatttgcaatgtcagaaacttccaaggttgttcacttggggtacgggtaacacggtcatgttgagaaaagaaaatctgaactccaaaaggtaaccccggggtagggtagatgagggagagaggtctttccctactaaagggatctccatttcgcaaaaggatttctcacaacccatgaagtagggaatctctccctcttactgcgcctttaaactgttgttcaggtgaccagaaacagtgtgttacacgtcccttcagcagcttgtctgttacagagggcggggggtaccactgcccatcctccaccatgcacattattttaaagattcaaagcaatgtaattggtccatgataaaacaaacgtttaaaaacaatagactcagctgggtgcggtggctcacgcctgtaaatcacagcactttggaaggctgaggtgggaggattgcttggctaaggagtctgagaccaacctgggcaacatagtgagaccccatctctacaaaacataacaaaataaaatgagccaggcatggtggcacatggctgtagtcccagctacttgggaggctgaggcgggaggttcgctggaaaccaggaggtcaagggtgcagtgagccatgatcgcaccactgcactccagcctgggcaacagagcgaattcctgtctcaaaataaataaaaaacaaataaaaaataatagtctaatgatggaagtgggtgatagctaaagacacagggtttctttttgaggtcatgaaaatgctttaaaattgactatcatggtggttgcacatatctgtgaatataccagaaatcaccaaattgtcaaaaacaaaaacgggctgagcacagtgactcacacctgtcatctcagcactttgggaggctaaggtgggaggattgcttgtgtccaagagttcaagaccagcctgggcaacatagtattaataatactccatctgtacaaaagaataaaaaattagccctgtgtggtggtgcataccggtagtcccagctacttgggaggctgaggtgggaggatggcttgagcctaggagggcgaggctgcagtgagccaagatctcgccactgcactcagactgagtgagtgtagtcagactgagtgagaccctgttgcaaaaagaaaaacaaacaaaaaaataggctatctgcaatgtgctatcttgaattggaccttagaacagaaaagctgttgaaatataaataaagtcgggagtttaattaattgtaatgtaccaatgttgacgttttcactgtgacaaatgtaccacagtaatgtaagatgttaacagtagtgaaatatgtatgtgtgtgttaagaggaaggtaatatggaaactcggtgctacctcttgcaacttttctgtaactccaaagctcttctaaaataaattattattattattattattattattatttttaagagagacaggatctcactatattgcccaggctggcctcgaattcctggactcaagcattcctacacctcagcctccgaaagtgcttggattataggccaccacgcccagcccctaataaaacttttatttaaaaaataacaatatggccaggtgtcatggctccctcctgtaatcctagcactttgggaggccaaggcaggcggatcacgtaaggtcaggagtttgagaccagcctggccaacatggcaaaactctgtctctgctaaaaatacagaaattagccgggtgtggtggtgggcacctgtaatcccacctactcaggaggctgagacaggagaatctcttgaaaccaggaggcggaagttgcagtgagccaagatctagccttttttggagcgagtctccaaaaaaataaataaaataaataaataaataaataaataatgataggacataatagagtcctgtggtccccctgtcagttcccgcttttggacgtccctcctggccactctctggacgggctcgcctcctgcctttcggctttgctgtggtcccagcctataggtcacactctcatctgcagctgctttttttaaggttaatgtaatttcataaatgatatggatgcaccacctttgtaattcatggttttctggtagcagagtgtcctggttcacaagtgtaccgtcatgtactaaatgttcccctgttcttggcctcttaagttgcttccaatttttatttttataaagaatgttccaaccaacattttaatacatgcagctcctttctgtcttctgttgagttattcttttagaaaacaatctcgggaggtggggttccggagttaagaggcgagataatcatttttaaaaggtatgggcatcagattggctttgagcagtgctagcactgtgcctgggaccgaggaaatgctgacaaaggccatttgtttcacatgtagtcagcgttcctggttgacactgctgtctgcaccctgtctggcctgggagcccttgttttggaaaaccacttattcaaccctacaggctgtttttctccaggccagttgggttttaatggttaaccagcttccaggggtcttccgagtggcagcaggatggaaaatgaaaaagaagtcctgttctgtggccaaaggtctcctgctgaattccgcccgccgtgcttggcccactcctggacgtcgccgggaggaaagggagcagagggagggggctcgccaggatgtgtacacagggcaccacattgcagatcttgcaattctcttttgtcttcccatttaaaaaactgtggtaaaatacaggccaggcgtggtggctcatgcctgtaatcctagcaccttgggagaccaaggcagccggtcacctgaggtcaggagttcgagaccagcctggcgaacatgccaacacaaaccccgtctctactaaaaataccaaaaaagtagccaggcatggtggcacgtggcctgtagtcccagctactcgggaggctgaggcaggagaattgcttgaacccaggagatcaactcaggagactgagccgagattgcagcaagactctgtctaaaataaattaaataaataataaaaaattgtaaaatacaataacataaagtttaccattgtagccattttaaagtacaattcagctacattaaacagagttccaatgttgtgtagccatcactgctgtctagttccagaactttctcatcacccccaaaggaaacctcatacccactaaggcagtctgcagagtttctttcctctctagaactcttttcagtttgggtaggtgcgccggtgactgagggggattggaggaaattaattccctgctgggaacctttaggtgggagtagtggtgataattcttacgtttgcaagctcaagtaagttgaagcacaaagaggaattgcttggctcttggtagtgggaagtgcaggggtttcggctttaggtgtggctagatcgagggctcatgcagtattttcatctcatctctcagttctgtttttctctggggttggcgtcaggcagcctctgcacagccaaagaaacggtccatgctatggtggtccctctgggtcaggatcccagaagagagaggcctctttcctcagtgtccgtcaatctcttaagaggaccctgattggcccagcttgggtcacgtgcacacgcctttgggcagggaggcggggtttcatgattggcagctccagcgtgatcccagttgttagagaaagggatgctggtgaatgaagaagcgcagatgtgcattgcagtgggggagctggaatactggcctgaactacaggtgcaggctcatattttgaccattatcatttgcattttccacctctccacttacgaatgttaattatctgaagctgctacaagaccttacatttatactgcagttgcaaatatagccatttaggtgacaaagggtccattctgctggtataatgctgtctttccacggccgctaaaaccatgcagagactggcatgcctatcaacttcccctctgcttcacggggattcagagcggatgttctctaagggaccttccagatgggcccattccgggtgccatgtcttggggaccaggtcacttccccagctgcactttttgccatcatttccatatgaagaagaagtagattggcttttagtttaagattactgtattaataaacccttgactttttgactgtaataaagtaatgcacatgcattcttgtgctttgtgtgaaacgtggagggtgtaaattaattgcacggtcattgatgtggaggaacttgaatccaggggggcgattttttttttttttttttggagacaatctcactctgtcacccagtctggagtacagtggcacaatctcagctcactgcagcctctgcctcccatgcttaagcaattctggtgcttcagcctctcgagaagctggggattacaggtgtgtgtcaccacacccagctaattttagtggagggatctgtatgtcactaaccacctgcctgaccatgggcaagtctctccctccctgggcctcagtgtcctcatttgtaaaatgaagaatgggatgagttgacttgctgtgtcatattctattttggcgtattctggaaatttttcttttcttttgttttaatggagtaatttgtttatgaaggcattttacctttaaatgaaccttattttactttgccaagggggaaggtgtagtacggtggactttggagccagatggcgtgggttcaaatttcagctccatcacttactgtgtggccttgggcacatggcttaccctctctgggctcagtcacctgatgtataaagtaagggcaatatagtgcctgccttgtagggttgtggtggggattaaatgagcaaatatagggaaagtgcttagaacaatgtcttaatttctgggacccggaagtagtagctgttatttccagttttctgtttagacaacaccgtgatgcacagttcacgcaagaaatgtttctacactgtagattatttccttaggagatgctagatacagatgctcagctccaggacacagggcgtgaatcttgttgttcacggatattgccagccgtcggccacacaggaagggtctggcctcacccacacttgccagcgctgacctcaaaaagctcatacttcacctgtggccggcacacaggtgcatcagcatatggggaaactgaggcccacagcagtgctaggacctgccctaaactcacagttaatgagtgatagagctggggctagagcctggaagaattaagagtgaagttcaactctgatcctctttagtctgtattcagagcctgagaaactgagaggcgtctgtggctgggggaaaacaagacaaaacaagacaaatgccagcaaggccacggggcagcaggggctgccaggcaagctgggcagggcgattgcgatgcccagactccagtccggggaatgcgctgaacgcacagcacgcacggctggctggccacagctgttgtctgccacacagaagtacccggctggtgcccaggacagaacctcgctcctattgttctcgtgtctctgcaggattgtggggacaatgcagtgaccgctggtagtgacctgcgatgtgccagggccaggctctcttgatttagagccatgcttggtcagtgctgcatcatgcttgtcttgcaggatgggttcattcacctgatccttttattgattctttaacataatatgaacgttcacggagccaggaatccagaaggcatgcagctcagctttcaggaacagaggacaacagaggctgctgcctccaaggagaagtggaggtgggaaggatggacgtgccagggatggtgtgaactagccaattggagtctattctgatagcttctgagccccaggactaaccaggcttagtggcgcacacctgtaatcccaacattttgggagaccaaggcaggaggattgcttgagcccaggagttggagaccagcctggtcaacatagtgggacctcgtctctactaaaaacaaaaaaaaattagctggggcatggtgtcgcatgcctgtagtcccagctactcaggagtctgaggtgggaggatcgcttgagcccaggagttggaggctgcatgagctgtgctcgtgtcattgcattccagcctgggtgacagaggaaaaccctgtctcaaaaataagtaaataaataaataaaaataaaccccaggggcaggatcggcttcatttctgggaccagatttagccacccctcccctctgagggcctcttttgggtaccaatgtggcaataatatgaataacaatagttttattgtggccctactatgtgcctgacactctgtgaaggactttccgtgtattaaatcatttgtccttcacgaggccaggtctgccacttgccctgttttatagatgaggagcttgggatccgaagaagctgagtaacttgctcaaggtccgggtgcttggacatggcaaagctatgcctggaatccaggctgtgggctcagagccccgacacggccacttcaccacactgcacatttcccaaggcttctggcaccagggaagaggttcgaaggccgcaagcagggctggatgctccttttgtagactcgtgttgcacatgaaattagtttttaaatttcctgattctcgatcttccttgatggtggaagctttaaactggaacgtgaacttttttgctctgtgcttactttaaaaaagtgctgctgtgtgaaatggagaaagttacggcgtgtaggggagtgagactcaagttgatattctggcgccatcagctcacaggtgtaggactttgggcaggtatttatcactagaatttctgtgttttcacttaggaaaaagagaatgtaaaatttcacagagtggttggaatgattaaagaaaagcagtaggtgtgaaaagggcttctccattttgatgcctggtgaactattcatccttcaaaacccggatttcttaccccattctcctaccagcctcaatcagaattaattgtgcctatatctgtatctactatggtctagatagtattataattaaggaattataattaagtaactaacaaggaaataatctcctaaaaggcagaagccatggctgctttgtgattgtactcctagtgctggaagattactgtgtgctagcacataacaagggctaagaaatgaagaaatgaggccgggcgccatggcttatgcctgtaatcctagtactttttgaggctggagcaggtggattgcttgagctcaggagcctgaaaccagcctgggcaacattgtgagactgcatctctgttttaacataatttttaaaaattaagaaatgggctgggcgcagtggctcatgcctgtaatcccagcactttgggaggccgaggtgggtggatcacttgaggtcaggagttcgcgaccaacctggccaacatagtaaaaccccgtctctactaaaaatacaaaaattagctggatatggtggcatgtgcctgtaatcccagctaccagctactcaggaggctgaggcacgagaattgcttgaacccaggaggcagaggttgcagtgagccgagagattgcaccactgcactccagcctgggcaacagagcaagactccgtctcaaaaaaaaaaaaaaaaaaaaaagaagaaatgtatctgctcatgtaggctctttgtgtattaccaggacagaagcttataaatgctcagtaactgttctctgcattaaattaaattgtggaagctaattacactcaggggacttggggctaggttgaaatttccaaatctctgcttctgtttcaatagaaagcaggaggctgagcgcagtggctcatgcctgtaatcctagcactttgggaggccaaggcgggtagatcacctgaggtcaggagttcgagaccagccaggccaacatggggaactctcatctctactaaaaatacaaaaattaggctgggcatagtggcacacgcctgtaatcccagctactccggaggctgtggcaggagaatcgcttgaacccaggaggaagaggttggagtgagccgagattgtgccacctgcactgcagcctcggtgacagagtgatactccatctcaacaacaacaacaaaaaattagagaaagcaggagtgagagctgactggggcagccgggagaacctacaaccctccatgggatgagatttacgaggctgctgctcccccttgcaaagcatgagttaccacttagcactcggcggaccatccacagactgttcgctgccttcaaagggtttcagctgtttacttctatgtggcgtgtttacacttccttaagccagtggttcatggaaggacggtatttgcataaccagaagggcctttttggcctgatgaatttcacctgggcctgggctcaggccgggggcacttcttgttgttcatgtcatacatacatacatacatacatacatacatacatacatacatatatttatttgtttgtttgtttttagatggaatctcactctgttgcccaggctggagtgcagtggcgacatgttggctcactgcagcctccgtctcctgggttcaggcgattctcctgcctcagcctctcaagtagctgggaccacaggcatctgccaccatgctcagcctaatttttgtatttttagtagagatggggtttcaccatgttggccaggctggtctcaaactgacctcaggtgatctgcccacctcagcctcccaaagtgctggcattacaggcgtgagccaccatgcccggcctcatgtcatatatttttaaaacacaaattgcacaattgaaaaataaaaagctcccatgcagcctgtgaatggtgggatcaggtatcgtatatggagggccaggcttattcatccatgagccgggggctgtactgaccccaatatacagatgaggaaactgaggcttagggaggactagttcttgagccaagatgagtgttcaggtggaagctagaaggtgggggactggaggccactttaaatgtggggcttttataatgggagggcagtgaggagccctgggaagatctgaaactcaaaagcgatgcatctgctttgttgatcttttactaaagaggttaagagcccttaggggagctgaagtgggaggattgcttgagcccaggagttccagaccagcctgggcaatatagtgagaccctgctgctacaaaaaatatatgaaaaaattagccgagcatggtgttatgtacctgtagtccaagctactcgggaggctgagcccaggaggtcaaggatgcagtgagctatgatcacaccactgtgaggatgcagtggcactccagtgtgggcgacagagcaagaccttgtctcaaaaaaaagtcttagagggaaaaacagtctcctaggagaaagaaggagatccctgcaccctaggtttgggcctggcatgtaaataaagccacctgaataagcaaagaattctgcccagcgggctgtgacctggctgccctccaccaaactccagaccagtgccagcccttggccagcctgccctagcctggtacctgccccaggcacctgccagcagctggcctccggacgctgtggtgcagtgattcccgacacagtcgctagcacggtatacagtcgctgtgccgtgaggatgcagcattcgaacgtgtacaggtcttaacctgaagaaatgaatctggagagctctttgtgtgtgaagtgcatgtttcccagccttcatgaaaggccgaaggctcactgcactctacatcttgcccctgtgtatgagtgtctttcctccccctcttctcttcctcttccctggaccgctgcatacttttgtccacctcttgtcattctttattctcggacatcttgcctcgtgagattcccttatgaaacaagcacacacgcttagtcttcgccccgtggtggttttattctaagtcgctgtggtttgccgaaagggttccgacaaaatgcaggagctaagtgatcagccactaccctccacctcacacagaggggtctgccccttcccgtggagcccttgccacagcctttagcagagcagagatatagcctgtgtcctttctcttgacatttcctaaatgctttttgtttttataatttgtttttgagatggcattttgatcttgtcaccgaggctggagtgcagtggcacgatctcggctcacagtaacctctgcctcgtggttcaagtgattctcctgcctcagcctcccaagaagctgggactacaggtgtatgccaacacacccagctaatttggtatttttaatagagatgccatgttggccagactggtcgcgaactcctgacctcaggtgatccgcctgcctgggcctcccaaagtgctgggattacaggcatgagccaccatgcccggcctgtttctattattgtaatggccaaatattattttgtaagtggatgtagtacaacatatgtaagtctgtgatacccattttgtgtgtgtgcacacctctgtatggtggtgtgtgtgcatgcctgtgtgtgggagtggatgtgtgtgtgcctgtgtgtatatatgtgtatgtgtgtgcactcctgtgtatgagggtggatgtgtgtgcatgcatgtgtatatgtgtgtacgcatgcttggatgtgtatgtgtgtgcatacctgtgtgcacctgtgtgtgcatgcatgtgtctgtgtgtgcatgcgtctgtgtgtatgcatgcctgcatgtgtatgtgtgtgtgcatacctgtgtttctatgcacctgtgtgtgtatacgtttgtgtggacatatccctgtgtgtctgtgtgtgtatgtctgcacatgcctgtatgtgcatgtgcatgtatgtgtgtgagagggtgtgtgtatgcctgtgtgtgcgcacctgtgtgggtacattcctgtgtgtgtgtgcacacttgtgtgggtgcatgcctgtgtgtgtgtgtatgcctgcgtgtgtgtgtgttggtgtgtgcatatctgtgtttgtgtgcgtgcatgcctgtgtgtgtctgttcctccacctggtgagttccctggcgtggagtgaatcctgtgatctgctggctacttcacttcctttgtcctcagttttctcatctgaaaaatgtgtatgataatatctcatggaattgtgaaaattcaataagataccatgtataataattgcctggcgtatatgaagtgttacgtagatagtatttacttatttatccaacttttgctgaaaaatggaaacagcctggtatttactggcaatgaacatctttgagtatgtatgttgttattttttaaaaattctgttatttctttgggaaaaatccccaaacatggatgtggctgaggaataagaaatgctgggcacagttttgatggggcagaagttgaagatctgaacctggatttaatctctagcttgtcaactgatcaataagcttgggctatttggagctccgggttaagggagattctgaggttaagcctggactcggtggggaaagtgccatgattaatttgtgatgtctcctgtggacaccggagagaggagagtatgtttcccacttgctttccatgcctggtctagatgaagccgtagttagaaattaggcaaggtgcgtttggggcttctgtaaatctctgtggtcaggaaagccgagcctgagactccaggcagttgcccaaatgctgaagaggtcaggggccctgtcggggtcacagatccaggcataggaacagccgcctctatttggttttggccaaaacactcacagcgtgcttctaggacatcacagtgtgcttctaggacaccatgccttccatcttcattagatggttaccctgtgtccacccgaaatacagccgtgtgcctctgtcttggcttttgttcctcaagtacagcagggtcgcgtcactcctgagctacgagggtttgacacaggtgcctttgttcctgaatctgtcaaacccgagcccgtgccattttgatctgttagtttttccctttatctataatgactcatgcctattataagaacctgttccggccaggcatggtggctcgtgcctgtaatcccagcactttgggagaccgaggcaggtggatcacctgaggtcaggagttcaagaccagcctggccaacatggtgaaaccctgtctctactaaaaatacaaaaaatagctgggtgtgatggcgcatgcctgtagtcccagctacttgggagactgtggcaggacaatcgcttgaacttaggagatggaggttgcagtgagccgagatggtaccactgtactccagactgggcagtggagcaagactctgtctcaaaaaaccaaaaccaaaaccaaaaccaacaaacaaaaaagaacccattccttttgagtaaattataccttgctggtagagtttttaaaacctcggtctttcaagcactttgaatagttgtgggagggaggtgtaggggcctcggtggggttggcagcaggtgcccagtgggtttcatagctgtgtgttttcatttggctcctcttccttggggattgccttgtctcctagcaagattcagggtgctggggactgtggctgtatttcttcagcagttcagagtctttggtttattggtcatcatcacccacttgtggaaaagacacattcatgtgtccagcacatgtcttgtctatccccggctccatcttatgcctgcgggaggggagattctagtccccacaccgtgttgtgagggtttgggaaggacctgaagccagcaggcagccttcattgtgagagctatgctctgatcccaaagctgacttttccatgccaggtttccccattgccctaggatctggtgtccctggtggaacttcgtcccgtgtctatgtgctctggaggcttaggtgtaggatccctggatgactggtggggaaaggctgggggaccctgttgtccagccttcttctttcacagaggtggaaaccagggcccagagccattaaatactgccttccgggcatttcagagcccgctgcttctatttttctattctcagtctgtcagagagaccagtaagtaccagaattttgacttcccagagcctaggagagtgtatggcatatgacaggtgtttattaatgtgtgttcgtgggaagaacaaattgtgtcgctttcattgtctttcaatacaatgaagatcagttcctctcctgggccccacttcatagaaatatgcattcctgacttcacaaatggaactgcccaagaatccccactcatgttttctccccggagcttcccctgcacccacattctctgcattggttaggaatatcctcataggcgcaacactcctgaatagcagaccttacacttgtaccccgacaggcctccttgttccctgaagctaaccctgggcctggctttggggtttgcagccggatttgtcatcttctgtctgccagtttcactgacttggttattccaaggaattcctgggacttccctttgttaaaaaataaacgttaggaatgagaagaggaactagctactgcctgtgtcttcactctgagtgactgagggaacttcattaaatctcagattcccctaacgatcctgagaatgaaggtgaacccacagtcctgtagaacattctctctgactgttgagcactccgctttgtaccaggtgttctcatcaagtgtgcaagccccttttatgctcatacgaccctcccaacagccctaggatgtgaagctgctattgtccgcatttgcagatgaggagactcaggctcagggaggttgagtccccagggaggctcaggccactggagatgcctgtggacaagggtgcctgtttgtatttggcctggacctgctcccagcatgctggggtttaaacctgggcagttgggagccattaaaaaatgaaaaggggtcaggtgtggtggctcatgcctgtgatcccagcactttgggaggccaagggggggagatcacttgaggccaggagttcgagaccagtctggccaacatgatgaaaccctgtctctaataaaaatacaaaaatgagccggccgtggtggtacgtgcctgtaatcccagctacttcagaggctgaggcaggagaattgcttgaacctggaagtggaggttgtgctgagctgagattgcaccactgcactccagtctgggcgacagagtgagactccgtctcaaaaaatgaaaataaataaaaataaaaatgaaaaggatgggctgggcgtggtgactcacccctgtaatcccagcactttgggaggctgaggcgagtggatcacctgaggtccggagttcaagaccagcctggccaacatggtgaaaccccgtctctactaaaaatacaaaagttagccaggtgtgatggtgggcgcctgtaattccagctactcgagaggctgaggcaggagaatcgcttgaacccgggaggtggaggttacagtgaactgagattgcaccactgcactccagcctaggtgacaagaacaaaaacttcatctcaaaagataaataaataaatgagaaaagaatgatttaaaaccaagacaggagaacatgcactttaaaatccagccttgcaaatagatggctagactctgtacagagcccctgtacctaacccgtaccctctgctatattaccctcctcagaaaggtggagacaggtttcgttggatgtttattttgcatctttgaggcatgaatctataagcacttgagaaaggtcacagggacaaaacttgtcttcattcatgaccagcctggccaacatggtgaaaccccgtctctactaaaaatacaaaaattagccaggcgtggtggtggttgtctgtaatcccagctactcaggaggtagaggcaggagaatcacttgaacccgggaggcagaggttgcagtgagccgatcgcaccattgcactccagcctgggcaacagagtgagagtccgtctcagaaaaaacaaaaacaaaaaaactggtcttccacttgctggttgcataattccaaaccattcaagcagcttcagccgcttggagtgagacttcgtcggatgaggcccttggaagaaaatcctgctttggcaagaaaagagaagtcccccgtctggcagctatgagagagcgacaccgagttcccagacaaaacaaagagctttcttcagccacaggtgacggtgcccccagactgacacatgttgctgtgcagtctctggcaggttgtggcagctgcctcgagggcttggcagtctagagcagcccctggaggcgggatgtggggagaaagtggggctggcaccaggaacgcatccccagggccctgccgggaagttgctgtgtcccctgggatgaactgcgtcccctctctgggttgttgctggtcctctacataatgaagaggtgaatggcaggtctcaagggtggagtgcagtggtgcgatcatggctcacggcagcctcgacctcccaggctcaagtgatcttcctgcctcagcctcccaagtagctgggacaacaggcgcacaccaccactgttggctatttattactattattattattattatttgtagagaaagggtcccactgttccccaggctagtcttggaactccggggttcaagcgattctcccttctcgacctcccaaagtgcttgggattaccggcgtgagccacagcgccccacctcccttcactattttgttcagctgaaacacaatttacatagagtaaaacgcagagatcttcggaatactactcgttgagtgtgtgtgtgtgtgtgtgtgtgtatgtatatatatatatattttttttttgagacagagtttcgctcttgtcacccaggctggagtgcaatggtgcgatctaagctcactgcaacttccgcctccccggttcaagcgattctcccgcctctcacacccagctaattctttgtatttttagtagagatggggtttcaccatgttggccaggctggccttgaactgctgacctcaggtgatccactcacctcggcctcccaaagtgctgggcatgagccactgcatctggcccaagttttgtgtattttgaatgttcatgatgcatacctttgaagccaccacccagatctggacatggcgcagatgtccacccccgtcagatgggctctaatgctctgcgattcacgattctgtttgcctgatcacattattctttcagacgctttcatgttctgtctagacctgcgctgttgccggccacgtgtggccactgagcgcctgaaagcgcacccagccatatcagtgtgtgccgtatacccggagggcacacagcgtttctaaggctgggttcaaaagaaatgaatgtaaaggacctcgtcagtaccttttagcattgattacattgtggaaatgacaatattttgcatatattggattagataaaatactattaaaataaatggcactggtttctttcttacatttttcaatgtggctagtagcaaattgaaaattcccggccaggcaaagtggctcacgcctgtaattctagcactttgggaggccgaggtcagtggatcacttcatctcaggagtttgagaccagcctgggcaacatggtaaaaccccattatctaccaaaaaaaaaaaaattagtcgggcatggtggtgtgtacctgtagtcccggctacttcggtggctgaggtggtaggattgcttgagcacaggcggtggaggttgcagtgagctgagattgcaccagtgccctccagcctggcagcgtgggtgacagagtgagacctgtctaagaaaaaaaaggaaagaaagaaaattcaaaattctggcctttgggaggccaagatgggtggatcgcttgagcccaggagttggagaccagcctgggcaacatgacgaaaccacgtctctacagaaaaatacaaaaatcagctggacgtggtggcttgtgcctgtatttctagctattaggaaggcggaggtgggaggatcgcttgaacctaggaggttgagcctgcagtgagccgagatcgcaccactgcacgccagcttgggtgacagagtgagactgtgtttcaaaaaaagagaaattaacattctgtgtgtgtccgcattgctctaggccctggaagtctccttctgatgaaggacttgcctcctgagtcttgccacctgcccctgcccccgtgggtgttggtggcatgtgggtgctggcaagtgctgtgtcttgaggtgtgtgtggtgtaggggtggccacgctttgcatgcatatgttccctctggtttccagcctcaggtgcaaggcagacttcagctgctccacgcaggctccctccagtttcaggcattgctcccaagtcagagtctgtctgcccagagctgttttgctcagcttctgcctcgttttgaaaacatgcaatgaagcccactccccagtggtgcttgcaactcccttatctcatgggagccgctggaaggcgtggaggtggagaggtgtggaggttgttttcagttggtttttaggctgaggctcaggttagacattttggggacattctgtggagtccacgccctgaatggaaggtgctggctcacctttgtaagcctctgggggcttgggagcaccccgtgtaggatggaggcctgctagtaccccctccatgcggcctgaccacctgggcccctgcagagttgctgctggccctatagaaggtgggagcggctcggtgtccactcaggagcaggctggggtccagctctggctgcaagggaactgaccactgttggtcacaggcccgtctcaccgtctcacccatgtgtccacgtgacgtccaggcaatgggcccgtgcatgaccagtctgccggtgaggtgacagcggggagccgatcccagggggatgattggatggagatgtagacactttatttggaaggtgctaggagtcactgccaggctcaaagaacggggaaggggtggacaagacacaggagcagcacgaggaggagacacaaagaggggagggaagctgatgggcaggggggagagatgagcggacccaggtgcaagggtggagagcagtgggctggggcatgactgccgcttaaccagcctcatggtgtcactcgccgagcctcagtttccccttctgaattgaggggcaagagatgacctctaaggaccaccaaccctgctgtctatgaggccatggtgatactaaggcccagagggagcccggacctccagtgtcctccgtccatcccttctctctgctcggctttgcactggcgtgggctgcatcgagtcccaggctgtacaccttggcagtcacgcggcgggggctctcgtgtgaggacgggagcagagccaaatgcaccagctgtcagccagactgaaggtgaagggagccaacaggctcatgtctgaatacaaggtcttcagcccacccctggaggcagtatgtcaggattcttccgaacagagaatctggggtctgttctaaaggggcctagagcatggccatggtcactgtatcttcagaaatgtttaaagttttgtctttcttggtcattggaagaggcaaaaaaggaaaaaaaaaaaagcaggaatgagggaagactcaattttgcacattctctctgtgttcccctgaggataaattggaaacgaaataggaatacaggacttttaggtatgagccagttcagtgtgttaagacacttgctttctaaccctttgctttttggcagtaatcggattgctggacgacttgtcttttaagacctctctaagtactgatgataaaaacagcccttcaacagggaaaataaccttccattctattttctaccgagcagagaggaaagaacatcagctgagccaggagggttatcaagttgcaggatgaccctgtttatcttgtgagactcagtttgctttaaatgttttcagagatcatatggttgcttttgtatatacttttgtttgtataacttggaatcatttttctgctaatcttttgattttaaatatgtctctggtatgtagtacaaggtttgagggttttttttttgtagtttgaaacatagcatttttaaagataattttgttcatttacatttattgttatgttttactagatctgctgtctgttttgcttgtttttgtttcattataatttgatttcctaagtacttgtggttttaggttgacctgtgcctagctccatgtatctttcatttgagatttcttagaccttatcaaacttatttttctttttttgagatggaatctcgctctgttgccaggctggagtgcagtggcgccatcttggctcactgccatttctgcctcccaggttcaagccattctcctgccttagcctcctgagtagctgggattacaggctcgcgccactacacccagctgatttttatatttttagtagattagggttttcaccgtgttggccaggctggtctcgatctcctgacctcatgatctgctctcctcagcctcccaaagtgctgggattacaggcatgagccaccatccatggctctcaaacttatttttcttaatctaaatcttctaatagctaaccgactggaacttcaagtgttcttatttctgtagattgccatatatagctatcacaaagcagaggaactttggacttttcttctataagcatcttaagctgttggcttcctccttctgaaagctctctgcccctccctcatgccgtggggctcagggttgagaaatacattaattctcaattctcctttctggctcttacatccaacttgtgttctttcattgcacggatcacatacacttagtaacacactgtagtggggtgggaacagaaaggatctcaagggtgttctgtcattctgggcaaatctctccaagcccagcccatgagtcttatcttcaaaaagtaaaataaaataaagttaatatactgagggctgaacgagaacatgagtgaggctgttcctggcacacatcagctgcttgataaaaattaacctcccgttctccactttgttagtgttctcagtggctttgcgcgccaaatgcattgtctttttattgtaaagcttgacttcgggatgctcctgggctcatcattcttggcaatatggcgacttttttgttttttattttttaattgtggtggaattcatttaacataaaatgaacctttttatgtttatttatttattttgagacagatctcaccctgtcgcccaggctggagtgcagtggcgcgatcttggctcactgcaacgtccgcctcccgggttcaagcgattctcctgcctcagcctccccagtagctgggattgcaggcgcccgccaccacgcccggctgatttttgtagttttagtagagatggggttccgccatgttggccaggctggtctcgaactcctgacctcaggtgatctgcctgcctcggcctccaaagtgctgggatgacgggcgtgagccaccgcacctggcctgaaccattttaaagtgtacaattcagtggctttcagaacattcacagtgttgtgcaagccctacctctgtctggttccaaaactttttcatcaccccaaaaggagatggtggctctttcaagacgccagctttggcatcaactggaccttctggttgtctgacttcggacaagcattgtaatttccagcctttgtttcctcacctttaaaatggaaataatgttgatcaccttacgggcctttttaaaaagaacttgattgaggtatgatgtatgtacctcaaaatcaagtcatcctaagtgtactttttcagtactttttcgtgaatttgtggagttgtgcacccattaccacaatcccaattttagaacgtctctatcatttcctgttcccatctccagctctgtgtaaccacgagtctgctttctgtctgtatgggtttgccttttttagacatttataccaatggcagctgacagtacatggtcttcatgcctggcttctttcactcagcatcctgtttccgaggttcatccatgtagttgcgtgtggcagcgcttcattcctctctgtggctgaggaatattccattgtgtggacggaccgtgttttgataatccactcctctgttgatggacataggggttgcttccaccttccatgattcatatttactactgtgtgtcattctcagtactgtggcactgtgctggtacacataagtgcttaataattgtggttagccgggcgtggtggctcacgcctgtagtgccaacaccttgggaggccaagctgggcggatcacttaaggccaggagtttgagaccagcctggccaacgtggcgaaaccctgcttctactaaaaatacaaaaaatagctgggtgtggtggcagacgcctgtagttcgagctacttgggaggctgagacatgagaatggcttgaaccctgggggcagaggttgctgtgagccaagattgcgccactgcactccagcctgggcaacaggcttttctctcaagaaaaagaaaaatggtggtcattgtttatgttatttccttatgggctttttttttaatgtggatgattttcttacctttagacgtgttatttgtggttttgatagcttttttttgtcaagctgtccgtcatcgttctgaaattttgtttgttaaagtcttatgatccacatatggcagtaactgtgtatcatcatggcttaagggtgtctgataagccaggtcacctggttccctcattcatgccacaagcgtttactgagtgcatcatgggtgcctgcgggttctatgggtgaaacctgtgtactgcaagaggaaagactgactgcatccattttgctgagccctgtagccccacagcctggcgtggtatttgttgaaagaaggcagagcctctaccctcgtgtaactcagtgcgggtggagagcccatggcagacccaggactggaggctcctgcgtcattaggaacattggtggctgaagcttgcttgtcccagctggcgagagccaattacgcctgtctccttccacctccacgtatggtgacatcactttgatagcttgacgtcagccactgggggactatttacatcatggatatgggcaaaagacaccaatctgagcttttgtccttttcttttttttggagtgcctgcacacccgtgagcctttccaacctcgtaacctattattttcctgacgagatagttttttacagatgagaaagttgaggcacagagaattgaagggacttggccaaggtaacagcccaaattcaagccccagcttcctcgggccatccccacggacatgggaagacgcagcatcagatctgccccactccctcctcccagtcaggttttttctgccagatgactctgctgttcaatttccattgactctgctgctgaatttccattgactgactctgctgctgaatttccatttccatctctcatcagggttttcagtgctttgcttcccagtgtgttgcctgagccaccctcacatcctgtgccttccttcttaataggaacgctgtgttttcctttgttcttgcagaatttcgctaaggagtttgtgatcagtgatcggaaggagctggaggaagatttcatcaagagcgagctgaagaaggcggggggagccaattacgacgcccagacggagtaaccccagcccccgccacaccaccccttgccaaagtcatctgcctgctccccgggggagaggaccgccggcctcagctactagcccaccagcccaccagggagaagagaagccatgagaggcagcgcccgccaccctgtgtccacagcccccaccttcccgcttcccttagaaccctgccgtgtcctatctcatgacgctcatggaacctctttctttgatcttctttttcttttctccccctcttttttgttctaaagaaaagtcattttgatgcaaggtcctgcctgccatcagatccgaggtgcctcctgcagtgaccccttttcctggcatttctcttccacgcgacgaggtctgcctagtgagatctgcatgacctcacgttgctttccagagcccgggcctattttgccatctcagttttcctgggccctgcttcctgtgtaccactgaggggcagctgggccaggagctgtgcccggtgcctgcagccttcataagcacacacgtccattccctactaaggcccagacctcctggtatctgccccgggctccctcatcccacctccatccggagttgcccaagatgcatgtccagcataggcaggattgctcggtggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctctgcactcagacagtttacagaaataaatgttttttttgtttttcagaaaacagtttggtttctgatttgtcctacaaagttcttttttttttttgctgtaataacagaggcagtcatcatcgccttcagatttaataggtgtttgcggagctgctgaggccgggcacattcacattcaatagcttatttaattcttagcaaccataagaaacaggtgctgcttttgtccccatttcctgaaatctgaggctcagagggactcattcacccgaggtcacccagatagaaagtggcagagctgggatttttttttttttttttttttttggtgacagagtctcactctgtggcccaggctggagtgcagtggggagatctcagctcactgcaacctccatctcccagattcaagagattctcctgcttcagcctccatagtagctgggattacaggtacccgtcaccatgcctggctaattattgtatttttagtagagatggagtttcgccatgttggccaggctggtctcgagctcctgacctcaggtgatctgcccgtcttggcctcccaaagtgctgggattacaggcgtgagccaccacacccggccagagctgggatttgaactgagatctctcaaagtccctggtgctgtggcttgtgaggggagcggggaggccacacatttgggatagcgatgggaccacaggtagtgattctttttgagtggccagaactcccctgtctgcctgtttaggaaaagccaagagaaagcatcttcctcgttggccatgacatcctttccgaggttatcctacagctgagaaactggacttccagcacaccagaccctgtgggagcccagaatcagggcagaggagtttcagacacagacagcggggcttggaggagctgagtgtggggcagggagggtgcggagagagggcagaagccgaaatcagggcaggaaggaatcctacaaggtatgggcaaggccctgatcatgctgcccagggtggcagggggccataggtcaccaccctccccagccccagcccaccccagccacgtctgggttctaatttctgctcatctgttcacagctgtgtggatttaggcaatttagttaacctctcagcctcggtttcctcatctgcaaaatagacaacattgcctacgtgtagaaaggcttaaggagcagtgaggattgtgcaggcaaagggcgcctgtcagggtgcagtgttcttatctcacgcctgccactggtcttgttagctctgtgggcttccgtcttttcctatacccagagctgagggagctaaactaggtccgttcccagtgcacgggttttagctccgttcagaacatgggctcagtaggtgcatgacttcatgtcactcatgcactgcgtcccgcaagccttccatcctctcctggaatctcctggtcggccaagccctcctccaggcccactgcccaccccactccctgccccaaagcagactagaaagaatgagcagctctcaaatctgcccctaggcctgtggtctcatccctggctgtgaattaggatcactgggagctttgaaaatacagatgaggcctctatcccagactagtgagtgaaattggagtgccagactcaacgaacgccagcttttcctttccagacagctgcagaagtggccctgatcccgggcaggaggggctggaagggaggcctgcctctccctctgtgggttcctctcgtgagtggaatcttgtttgttttcattttgttagttttgagacagggtctcactctgccacccaggctggagtgcagcggcacaatcacagctcactgcagtctccatctcctgggctcaatcgatccttctgcctcagcctcctgagtagctgggactacaggtgtgcaccaccatgcccagctaagttttgtatttttttagataggaggtctccctatgctgcccaggctggtctcaaactcctggacttgagcgatcctcccacctcaacctctcagagtgtagggcttacaggcgtgag

SEQ ID NO: 16464 - DNA, 58133 bp, Human
acttctctctgaagttgagccagaaagcatgtacccctaagggctgttggcagccatctttggacaaaaaccagagagcctgaatgagaacagaggaggtgcagaggagaaatagtgaaagcaaaactagatccaggtgtcagcatttaaaatccttgatgtcttagccccggactctccagttactacttaaattcctgtttctgcttcagctagcttgggtcttgttttcttttacttgtaactgaggttaaagtgatcctcagaataagaggggaaaaagtggacccttgtggtaatctagcactctgggtagacagtagctgttcaaggaaaagagaagaggggtgcaggtggctacacagaagcgattagccatcaagggacgagggtggcattgggatgaaaaaggaagggctggctctgagcttcaccatgaaagaagtgcacatgagaatggtttctgtcgggccctcactttggttaattctactgctttctcctcagggatgatgaaggcccccagctcatccccagggaaatgatgcaaccaggtagctggatcagaaatgaaaaagtcaggaaaagggaaaggttgcttgcgcagttactagggatatgaaaaggaggctaaaaaacggcagggggtggcctggagggaatgtgaaacatttttgtgtgttttacacacaccgaaaaaaaaagaggacatggacagaaacctagagaataggaggacagcatagtatagttactaagaataagctaagagttggttccccgggaccaaacagataccatttccaaaacccacgaattacttaccggctgtctcaattcacctaagcttccctttcttgtctgtaaatgagcatgaaagtgccacctgtataaaataactcaggctcccaaaatgtaacatagggaagctcctagcagcgtgtctgggaggaataagcattatctgtatttatcgtatcaaattaagatagaggaacacaggaggacagtagaggatgaaaataaaacactacttagatcctgaccctcctcagtggcaagtagtgagcattcacttcgtacagaagtagcactaaggcaaattaaaagaaaggttcacatttcctctaaaagaaatggtttttgagtcatgccaataccacttactcaatgtcctctgtactatactattctctgacagagccacttattaaatgtgtgaactgtgctgacaacacttgacaactttcaacatgagggaacagcaggatcacttaacagaacaaaatcgtaaaataatgtcaaagcttgatttcaggtggtgcggtgtagcactgctcttcacgaaatcaggactcccccgaccaggcagggccgactaggttagagtgtcctgccctcactcacctggcagggcttgggatgagctggacgtgactgccacaggcatttctgttcaaccttgaagccttcgctacaggagaccgcctggcagtcgggctgggaagcaaatctgagaaacaaagagagaccaggcggaaagcccttgggaccaggaaggagagatgagattctggtttggcagtggcacctggtacccgctattaataaataataggactgtctgacatttataaggcactttatcggtaataacagtgtcatctccataagccattctattagtggtaacaaataatagccccacgcctgcaatatctcctttaatattcccaacgtccgctaagcgcgtctcatcaccatttaaagaaaccgtggctcctagaggtaaagtacttcggtcacaacgcgaggaggtccagacttgaccccagacctccagactcgagctgggaagtggccgaggctcctggtgagccgcagggcagcctgcccagccccgggaggaccgcgtgggagggccgggagagcaggtggctgccccccacaagggggcgggctcagccggccagtcctgcccggaacccccggcaacgcgcatacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccaggtgagccccgaggatcgccctgccctggcaccagggcttctcggcgccttgactgacgagccacagcgtggcataaggggttcgcagagggaggttcagatcggaactgtaggtatagaaaaaggttggcagtgtttccttgaatcgcaaataatgatcttttaggaccacctgttgtggaagctgataatgtgctaggttctgtgttaagcactctacaggcagtgtggtttttaatcctcacaatgggtaggctttgttataggacttttatagatgagaccactgaggtcctgagaggtgaagcctcatgcccagctatctatctccaaattccaagctcttaatcaatacttataacatctgcattaaaatgcagaggatcttgagtgcgaactctagtggatccagaggggctcttctcacctctgctgcttgactggctgtgtgatcatgggaaagtcacttctcctctctgtcccttggtttgctcctctctaatgaggcaggcttcaatgttgcttccagctctcaactgctgttagcatcctgtcccctccctgcagaacaaaggtgaccccacctgatccccagggagaagatattggggatctgctacaggaccgttgtgagcccccactgcatctatcacaatagtgaccctttcagttctgtggttagctcctgccacatttcagccagacttgaaacagtaacttaagtgatgacaaggtcaggaagtgacagagaacctgttactcacagggctgatggctttcccctcccagagagcttgtctctgcacttgaataaggaccaagggttccttctctcagtcagtaagaagaggcctacacaggagtgggctgaaagacctgggtgacagggtaggggtcgagggagccgaggagcctcagctttctagaatgcatttctgtgctaagccctatagtagatgcttttattaccccgggagataacatatcactatccccaccaccaccaccaccattatacagttgagaaaactgaggcttaaaattccaacctagctctatccaacttcgaagccatgctctttcctacatcttttttttttttttttttgacagtctcgttctgttgcccaggctggagtgcagtggcgctatttcagttcactgtaacctctgcctcccaggctcaagcgatcctcccagctcagcctctcaagtagctgggaccacaggcatgcaccaccatgcccagctaattttttgttatttttggtagaaacagggtttcaccatgttgcccaggctggtctcaaactcctgagatcaagcgatccacccaccttggcctcgcaaagtgctgggattacaggtgtgagccaccacacccagcctctttcctacatcttattgttttcctctgcatggatgtaaactgttaagtgtgctggaagggatgaagtgtccacttgctctaccccttcatttcatagctggggaaactgaggcaagctaagcgggttacagaaagatgaaaggttaattcacttgtgagaaaccaggaatcttacacacctgcttcatgtggcatgaaataaataatccaaaaaatataggctttgtataaaagtttaaaagcagaaagccaaattttaggctgggcgcagtggctcaagcctgtaatcccagcactttgggaggccgaggcaggtggatcacttgaggttaggagttcaagactagcctggccaacatagcaaaaaccccgtctcgactaaaaaaaaaaaaattagctgggcatggtggcgcgtgcctgtaatcccaactacctgggaggctgaggcaggagaatcacctgaacccaggaggcagaggtttcagtgagccgagatcatgccactgcactccagcctgggggacagagtgagactccatctcaaaaaacagaataaaaaaaagacaagtttaaaggtggctaaattatttggaagagatggtcctttcaagaaaattcccattaatttctagctgcctgagaaaagtgataacttcactactttgtaactagaagactctcctaagcctattactttaccagcttgcttggagggaaattattaacacagtgatctttgtaccacttcaggaagcatttaaattctgtttatcactttagtatcccaggtcccctgagagggaggtcacagggtttggagttttgttgacaaagaagttcaggattaaatgaccataatacagtttgattctgcaataaagtcagaattacaaccagataccctcttcccacccagctaacagttgtctgccatagagctatgtgtttacatagagaatatatgggaatttctatattaaactcaaacgtgaaccagactttacagtggacctaaggcactctctggaccgtcaactgacctctgagggaggccacatatttgaaaaaaaatcagtttttccaaatcactgagatacctttgcacatgaagcaaaattacagtctgtcacagagttgcatgtttactaaacatgcccatgggaaaatatgttgaatggactgattcttagaattctttggtgttggaagggaccttagagatattctaaccctataatcctgtaagtttaatgaatgtgttatactttaaaaaaaaaagtttacagaagaaactttaataagcccaagaatcacctaggaagcttacttttttttttttttttttttttttttgagacggaatctcgctctttcgcccaggccaggctgctgtggcgtgatctcggctcactgcaagctccacctccctggttcacgccattctcctgcctcagcttcctgaatagctgggactacaggcacccgccaccacgcccggataattttttgtatttttagtaggggcagggtttcaccgtgttagccaggatggtcttgatctcctgacctcgtgatctgccggccttggcctcccaaagtgctgggattacaggcgtgagccaccacgcctggccggaagcttacttttaaaaacattctgaggctggacactatggctcactcctgtaatcctagcactttgggaagtggaggagggaggatcacttgagcccagaagttcgagactagcctgggcaacatgatgaaaccccatctctacaaaaaaaaaaaatacaaaaattaactgggcatgatggtgagcacctgtggtcccagttactggggaggctgaggtgaaaggattgcttgagcccgggaggttgaggctgcactgagctctgactgtgccactacactccggcctgggtgatagagtgagaccctgtctcaaaacaaaaaaataaaatttctgagatcatccccaaaaatgctgattcagtaagactatgttggggcccaggaatgtgtatttttataagaaaccccaccgccaaccctaggtgattttgaaacaaatggtctgaggactaggctttgagaaacagtctagtttcccattgtttttcattgttgtttgtttgtttgtttgtttttgagacagtctcgctctgttgcccaggctggaggtgccgtggcgcgatctcgactcacggcaacctccgcctcccaggttcaagccattctcctacctcagcccctcaagtagctgggactacagatgcccaccaccatgcccagctaatttttgttattatcagtagagatggggtttcaccatgttggccaggatgatctccatctcttgacctcgtgatccacctgcctcgtcctcccaaagtgctgggattagaggcgtgagccactgctactggccttctcattgtcttatagctgtataaacaaaggcctagagggatgatatgaattgcccatgatcaagtggatagttaggaacagaaaggtagagatagaacccaaatatttttttctcacttacgaggcactgtttattctatcacaccatcttgaacatgatacataaatgtcagtttgattccatattttgagtttcagcccagggcttgtggactagtaagagctcttgagctccatctgtcagtcaaattctgcagtatatgtaaaggaccagcacagaggcatttatcatgaggattgatccagttgttatgaatttgggggtttctttataacacttaacaggactcaaccctatcaggaatttcagtactcaattactcttttcaattttactatagttacagaaagtcaagactcataaacacttccctgaatcaagcagcagcactgtttcccagagaatatgactttctctctgttgtacatttcaggatcgttctccagggcagggtatgatctaggtaatcacatgggaaaattgtctccaaggataagaacctgtatcaatgttgtaactaataaaagccacatggctgggccagtagtttttcacccaactttccaaatacagaatatgggtaaaacagtaaaacatattttatttcacacaatatgggatattttataaaaacctacaaaagaggcctgaaattgtacatttgttccatttccatttatcctagcatcaagaccatcaataaactagctcttccactgggtagataacccaggtctcctgagggtcccttcatcagctcactggcagggtatacactgcctaactcaacacagccatgcgaggctcccacagtgtaggcactactcttatgcaaggctttagtaacagttaaagatactctctgttgcaaaactgagtcccaggtaagttataaaacgttccagattacctttgacctggttttgcaaggttgcagaaaacaaaatttgacctcctttaaacaatgtgataaaggaaaaatgcttacaatagctttcaaaaatattgcatcattaaaagctataagactgaagaacttcattacaaaacaagtgttgggaccaaggataacccttgtcatccaaacttttgagattagattgagaaaaactgatggtacaacaatttgattttcaaagcaagaaacatttagagggaggagaggccaccaaaaaaaaaaaaaaaaggagtgagagtcccaacaaggtacaagctagttttctctgtgccatgatgggatggagaaataagatgaattagttcaaggatcttacagtccagtaaaagaactaaaccgcatgcacaaatgattgtgacacccagtagaatgtgctcagtgtgctgggagggctacaagtgctgcaggaaaacaagcagaggtcaagagaaggctttttggggcactgactattgagctgaacaaatgcagtgggggagggggcattccaggcaaaaggagcaccagaggcagttctgatcaggtgcttaaaacagtgagatgcttcattaaaggatattgcgatgtaagaacaatggcagtctggacctaataatagtcatttttttaagctgtttcctgaagggacaggaaatggaaaaaatagggactcagagagtccaaagaatggccaacagcagtggcctcacttccacagaaggaaatatttaattttctaatgccaactttagtccagaatcaaggcacagaaataatctaatctacactcttcccaactctttggactgcccaaggagtaacttaaatgagttgtttcaatgcactttgtctcaaaggcttagaattctctcatatatctttgaataattccctagtaatgtctagcacatagtaggcaggcagtcaataagtgtctgttgggcagggcacggtggctcatgcctgtaatcccaacactttgggaggccaagatgggcagatcacctgagttcaggagttggagaccagcctggccaacatggcgaaaccctgtctctattaaaaatacaaaaattagtcgggcatggtggcgggcatccgtaatcccagctactccggaggctgaggcacaagaatcacttgaacctgggaggtggaggttgcagtgagccaagatcacactactgcattccagccgggatgacagagtgagactgtctagataggtagatagatagatagataaatagatagatagatagatagatagatagatagatagatagatagatgcatacaaacatacatacatacatacatacataatggatagataatgtctgttgaattaatgggttccattattctggttgattgtgacaggctttctctcctgaagcttaaggaccactgggttgggcatgagggcctgaaaaatgatgtaacaaaatcagatgtgaaaaaatccatttaaactcaatctaccccaggcccagccttaccctaccacaggcttacttacctctcaaaggtcctcctaatcaatgactctgtccagctctctggcagtacatggtaggacagcggtgctctccttgggtctcagtgcagcaagtaagcaggtggtgagcacaggatgggctggaaaggacctgtgagtagggtggtggaggaccctgtacaaggacagaaacccagacaccaaatgattaatatatccaagggctgggattcccagcctagtagcccaaggaaagatagcttaaagatattctctaaaatttttcttctctccctgctcttaactaaagcttgcaaaggaggtgattgtacatctccatccaagaacaaaactagcactttgctggcatatatgggaatgcactttattttcttcagaaacagggactgaagaggtaaaaacaaactctgaatcaggtgttgttattgaatctgaaagagaaggatagagttcagattattctatataataggtgctagtatttgaaaaggaccttcccacagcctctgagaaaagggaagtagatcattggtagaaagatgacatggttgcttacagatatcaaatgctaacaattatgtaaggccttatgtgacctggtaactcatgataaggaattacctttgattccagggctatttagaaagcaagagttcatataagcaagaactttaacttggagaaataaaaattaacatcaaggagattactacttaattacctaaatgtaaaatgagtatgtatttccttgttaaatttttgcttactcctggtggaacttaaacatttttatgacctccgggtgatttgtgtggggaagaaggaggagcacatgcatgtctctctctctatatatagtattataatgtgcatcatcttgctgtacaaaatactgtcattccaaactgccaatgattgagatgcaaaattacagttacaaatggcattttaggaactatttttaggttgtcttcaaggactatgttattaatagcaccagtttgcatttcagttgcttttctgaatgaagaaaagagataaatcttcaagcttgacttgctcatcaaccaaccatttcatgatcagagtacatttcctttcactaccttccttttggaccttaccttcttggtaaatatttctggggtgttttgtttaatccagtcagttactcattcactgaggcagtctagtagcagaacaagctactagactgaatgttttcctattggaaagctgcaggtttagcctgagcacctgacaccttagtaatgaagattgattcagctcaccacctacccaatctctctgccttctagcaatggacttgtttattcagaaaattcttcctttttccttaaaaaaaaaaaaaaaggcaggggcagacttaatatgctaccttaattttttaaaattttctttgaacagactttaaaggggatgggggagtagtgttgtaatcacttgatttttcaacacccaagtgtgtgctctttctctgtgggtttatttcagtctacaacttaaaactagactgatgaagaaccgactgatggagctgctctacacccttcaggcaactttctgtgaccactgtttctcatactcaaacttttaataaagcttgaggttttgctcttcaagaaaagatcatccatgttactcattaaatgcagatccacatgattgaacaagcactgagcagaaggccaagcagccagcctcttccaagaaataaggcactttgctagaacttaatctgaatggctcatacaaggaggtgggaacctcagaagcccagaatgattcttttcattttgcatgtgaccctccatacactgacttggtgagcctcttctcatttgtagaaataagattactggtatctatatcacagagttgttatgaaaattatgtgaagtgatgtatgtaaaactataccaacagttctatgcaaatgaaaattttaaatgtttgttattagtaaagagagaggtgggtgcatgctctgatgtgccacccagatccctgctttaggactgacggactcactcttcagctgctgggagctctcagctgagacctctcccaggacttctccttggttgaagagagacactttggccaaggttaagcaccaccaccccagcctgagtccattggactggtcaatgggcaggtgtgaaggcacagcctacctcccttaatttaggaggtaactctgaagggcatcccaggtccagagtccccttaggattagaggatctgctgagggagactcctgttgtgactgcattacagttcaatgtctccctctatccagtctgcttcccttgcagcctcacaggtcccattcccaagagcactcctgcatgcacatctcggagtctcagagaacccaaccttgacaaatagaattataggagcttacatgttctgattgatagatgagcagactttacaataaaaattataaaaggtagatagatattttatgcttgcattagaaaatatgtaggccaaccaggcagtggctcatgcctgtaatcccaacactttgggaggccaaggtgggcggatcacttgaggttgggagttcaagaccagcctggccaaattggtgaaaccccatctctactaaaaatacaaacattagccgggcatggtgacagccgcctgtaatcccagctactcgggaggctgaggcaggagagccgcttgaacccaggaggcagagattgcagtgagttgagatcgcgccattgcactccagcctgggtgacagagtgagactccatctcaaaaaaaaaaaaaagaaaaaagaaaatatgtaggcccaaacatatctacaaaagactcaagaaaataaaagacattaaatatcaactagatagttgacaggtagattcacatccagaatttcctttcaaatttcttttttctttctacatctttaagggaagaaaggcttccatagtgtgtccagatatggttggcaagccgctggaaactcaagtctgcccaaataacaaatctacaccaacagcctagaggagatggaaggagatggtgtagggcaggggcaatggccctcccttcagattagatgacttgcataaaaggtcaggaatcacaaactacatgcctgcagagggccagctgggaacatgaatgaagtacacatgaggtgaagttgcttggactgtgatcaagcatgacaccagcttaattacatttccttttattattaatttttcaagctaatacctgagtacatttttcttttttttaaaattttttttttgagacagggtcccactctgttgcccaggctggagtgcagtggcataatcatggctcactgcagccttgacctcccaggctcaggtgatcctcccacctcagcctccagagtagctgggactacaggtgtgcgccaccacatccggctaatatttctttgtgtgtgtatttttttgtagaggtgttttgccatgttgcccaggctagctgtaagtacatttttcttaaaaaaaaaaaaaaaaagaagaagaagtacagaaaaacttaaagtcccttttgacctaccattttcccctcattaagatgattacttggaggtgaaaaataagaaaaaaaaaagactgttgctaagtcctatctactctacctaccagatatctcttaagtacattcacttctctctacccacactgctgcctacacagtgtagacaagcatcatctaacagctggtctccctacctcttctcccaaccttattcccctccaactctacattccagtcagctttaacctcttttagttactcaggccccaggctgcgttggctctgggcctttgcataagccgttccactgcccagactcaggcttagtcagtcccagctgatcttcatctccaccgtctgctcatctttcaggtctcagtttacagggcacttcttctaggtcgtctttctgccccccaccacctgctccccaaataccttttccttcccctgttgtgacacctgtggcaatttattttgatttttgtttgtttgtttctcctctattagacctgggctctatgaaaacagggagagcgttttgctcactgtcatatccagcatgtagagacctgcctggcacacagggaacactctttaaatagatgttgaataaatgttgggagggagggaatgagaatggatccaggtaacttatgaacggattgtttgactatggaccctgagtctcatgacaggaggaaagaaaggagatttcacaattctttagcagtaggagttgttgttttaaaatttgcctctgtgggcccttacttgtaagcaaggcatacttgtatctcagaaattatttcatcttacattatgtttcattaaaggtttatcaactgccagatctgaatcctttaagcagctttagcttattcctctgtgtcttccacactaatatcatattttgtgcaaaattttttcaattataaacatttattgagcacttatctagtagttctgggggtacaaagatgatttgattattatcttaatttcaaagatctccctgtctaatagaggagaaaatgaattaaaccacatccgccaggcatggtggctcacacctgtaatcccagcactttgaaaggctgaggtgggaggatcacttgagctcacaagtttcagatcagcctgggcaacgtagcgggacatcatctctacaaaaagttagctgggcatggtactcctgtagtcccagttacttgagaggctgaaatgggaaaatcacttgagcccaggaggttgacgctgcagtaagccatgatcacgccactgcactccagcctgggagacagagcaggaccctgtctctaaagaaaaattaaaaaattgaaccctatcatactgtgtataagtgccctgataattataaatacgggctcctatgggagctgtagaagggagcagctaactttgcagagggagggaagataacagaaaagaagtgctacctacactgagtcttgaaggataagcaggagtgttccaggtgaccagggggtgagaaaccatgaaacaacctgggcaaaagtaatgagacgtgagcatacaggtaccttcagggattttccatagatcaatgtggttagaggaaagagggcaagaggtagagagtaggagatgacacagaaagcaagcaggagtgggaccgggaggcacctccggtcctcccgaataaggagagtggattctatcacaaggaatgaacagccctgaaggatcttaaacagggtggcaacaagaaattggatgagagtgaagctgataaattagaagcaggaagagactcaagggcaggacattggtcaggaggctatagcaataatctaggtaggaaataatgaggacatgagccaaggcagtggcacaggagtggatgctaccactcccgtttctacaacagtcatatttatggtaacctttctggagtgctgaaggattagagagcaaccagacaaaattttttaaaaaatgtaaaggaggggaataaagattcttggggcaaaagaaaaaaaaagaactgttcaagaaagtaagtacaattatagtactttacttggctccgtggtgaatattttcatagtcacatttatgttgattctgattattggttttcagcttctagagcaaatccataaagctgggaagacagaataatggtatcagaataaatataaatgctattaccctagacaatgtaaagggaagataataactgtcagaaatgaacagggtgaaatggaagtagggatcaaaattgataggccaagaactagcaggaaatgcatattttttggtgatggaaaggtaattgccagaagaaacagcttttaaaaaattgacagtggtgggccaggtgctgtagctgatgcctgtaatcccagcactttgggaggcagaggcgggcggatcacgaggtcaggagatcgagaccatcctggctaacacagtgaaaccccgtctctactaaaaatatgaaaaaaaaaaaaaaaacaaaaacaaacaaattagccaggtgtggtggcaggtgcctgtagtcccagctactcgggaggctgaggcaggagaatgctgtgaacccgggaggcggagcttgcagtgagccgagatcgcgccactgcactccagcctgggtgacaaagtgagactctgtctcaaaataaataaataaaataaataaaaaattgacaatgatttcccctaggcattagctttagttgtgaggaaggcctgggtgaggacttgtttattttcattgtaaacacttttgtactatttgatttattgttaccaggtgcatgagtcttttgattaaaatatttttttaaattttaaatgcatctatcccggtgatatttcttgtctttatggagatatcatacacaaacatctgaaaaacaaagcatatcagatgaattaggtgtagcctccccaaggtaataccctgggacatttagtcaccttcctacccagcactttgggaggccgaggcgggcggatcccgaggtcgggagattgagaccatcctggctaacactgtgaaaccccgtctctactaaaaatacaaaaaattaactgggcatggtggcgggcgcctgtggtcccagctaccgggaggctgaggcaggagaatggcatgaacccgggaggcggaggttgcagtgagccaagatcgcgccactgcaccccagcctgggcgacagagccagactctgtctcaaaaaaaaaaaaaaaaaaaaaaaaatgtatatatatatatatatatatatatatatatatatatatatatatgtatgtacattcacttccgttatcacaattcaagacaagtaggcttaaaagcagtctcactttacggcttaaaggcacaaaatccaagtagcaagcatgaaatgtggtttgcatattaaatcggtgcctttaacatttttgaccttaacccagtaagaaatacttttgtgcgtgacccagtacccacacacccacataactgaaacaaaacttttaaaaatgaacagccctgttcatctattaggaataattcctaaaacagtgttataggaatactgctatctggaagaagcaatattaagagtagtgtgtactaggcatttttcaaggagctctataacatttattgataagattctgctaccactcttgagatgagtactacttttattccattttagagattcagaaaatgatgcttagagaggttaagaacttctcaagataagcggtagaactgtcagtagaactgttaccttttactatgttaagatgtgcttcaaaatttctatttccttaagtatttttcattttttaaaatatcgctcagtttaaatgattttaacaatccactactgtaattatgacccacaggttgggaaacactgctctaaattaatcactccttttttttccctcagattagaaaacaggcttttgaaatttagagcttatttctcagatcagtttaaccttcctaggaaattacttgttactgatgcataagaaaaaattgttacataaagttagcttctatcatctttgttaattagcatggctcccttcttttcatttctcttctccttccttaaaattttctctttttttcatctttagtcctgtgtggcacatattaggaatagccaaatttatttctggagtatatttagatatacatcagttacacacggatatttcttgggttttgcccatatgtctattggtttgcacttgccacaagaagtacagatttcagccaaccatctgctatgcttgtgaaaccatcaaaacccaaccttccctcaaatattggaatcctgtgatttttttttcaaatgtagtaaatttcatgtttaaaatgcataatagggctgggtgcagtggctcatgcctgtaatccccacactttgggaggccaaaatgggagaattgcttgaggccaggagttcaagaccagcctggtcaacatagaccccatctccattaaaataataataataatataaaatgcataacgataagcatcatttgtcatgcccacacatttaagcaaaaaattatgctgaaaataaaattatgatgcttgttgaagcactaatagaactttaatagactgatttagtttgttttgatttttttcttattaaattaagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtaaaaataaaggggggattctccaaaaaaattaatctgaaggagttaaatgttgacacaggttttcaaatctctttctttggcaaaacgtattgggtaactaatacttcaggagatttagttatttgcctgcggaaactgatcttatttcatagcatgtgatcccatttgggtttctccaagctatgcatattttccgccagttggtatagaacagataaagaggttaaccaagaactacagaagtagttatgatgatgaatgagatttggcactgaatgggtagttggaattttttttcatgcttgttgtattttgattatattacatccagagtccatatagactgtataattgattataaatggaacacaggagaagaccagtgaacaatgaggaggttctatttatataaatgttttaaccgttatcttcccatgcaacactgatttggagctgtttggtgctgtggatgtggggtggctgtagcataagacctaaaatactgtatttcatcaaatctaggatgccttcaactgtaagctgccccattatgagccactaagaagaaacactgccaattaacaatgttatgggaacactgctgtatggaagaagcaatattaagggtagcatgtgtactaggcattcttcaaggagctttacaacatttgttgataagattctgcccccactcttgacatcggtactctttttacttccattttagagattcagaaaatgatgcttagagaggttaagaacttcccaaggtaagcattagaactgtcaggattcaccttgcaggctgattccacagctcatacaattgacagctctaccccagtaccttcttgtttattcgtgtgatagatatttagtgtctgcctactacaggccaggaagaccaaaatgtaataatatgaagcctgagggatatatttaaaagaaggacaggaagccagccccagcatgccaattattattattaatattggaaaattgaatctatgagtcttttacctctgttgattaaaattttaatttaatttaagcaggtaatacaggtcttctccttgttaaataatcaatagaccaggataaaatttccttgagccttttatctcagctgcagctgacaggaactgtctccttcacctcgacaggccctcagcacccacctgagctcacagttcctggacctgagtttaacctgattgttgacttcacttcatacagtcacttttgctaagtatttaagtaaatgagaggaagccaggaatgacatattaaagctggtgcccaaaacataatgtctatcttttttttttttatttttattgccaggccaacagaaaggtgagatggcacaattaaccaattgcttctgctgcatgcagacactcccttaacatatgggacttttatcatcatttcttaatagaatggtaaaattaaattgtaaatgtttataactttgttacaatgcatgttttcacagtcaaatagaaaaccccttttattgggaggccgaggcaggcagatcacgaggtcaggagatcaagaccatgctggctaacatggtgaaaccccatctctactaaaagtacaaaaaattagccaggtgtggtagcgggcacctgtagtcccagctactcaggaggctgaggcaggagaatggcatgcatgaaccagggaggcggagcttgcagtgagccgagattgcgccactgcactccagcctgggcgacagagcgagactctgtcttaaaaaaaaaaaaaaagaaagaaaaaaaaagaaaaccccttttagggagaaaaaagagaatgagcatcctctgatttaatctcgtaagtcagaatttatatttaattggaagacaattagaagggtgtttattttacttttttcattttctctgaatcaaatatttgctaggccaagcacagtggctcacatctacaatctcagaactttgggaggccaaggcaggaggattacttgagcccaggagtttgagaccaggctgggcaacatagcgagaccacatctttacaaaaacattaaaaaattagctggcatagtggtacaccttgtagtcctagctacttgggagactgaggtgggaggatcacttgagcccaggagtctgaggctacagtgacgtgccactacaccccatgctgggtgacagagcaaggcactgtctgtagaaaaaaaatagtgctaagttactcttgtaaacattaattaaaagaatttgtttaaacagttggagaataaatgttcctgctcctcaaaggaagtcattagcacaaaattatataatagttaccagatattctcatttattcattaatacaaaatcttaatttaggaaagttctgaaagtacttcaaggcaacaaagatgagcatttctttttaaaaatttcagaggccaggcatgatggctcatatctataatctcaacactttggggccaagatgggaggctcacttgaagccaagagttcaacatcagtctgggcaataaagcaagaccttgtctctacaaaaaatataaataaacagccaggcatggtggtgcacacctgtggtcccagatacctggggggctgagacaggaggatcacttgacctgaggctgtggtgagccttgaacaccactacactccagcctggcaacagagtgaaagcctatctcaaaaataataataataataataatacataaaacaaaacaaaaaactgggccattgtcaaagaaaatgaattttgaattgtgtttacaataatggtaggttgctagccatatttgtctgccttgtaacaagttgctgctatttgggcactatctggtgaaggtaccaccaagtattgaagaatctgagtcaacagagatctgtcttcctcttcacgaagtctgtttacccactcagatcttaaactcttagtccccttcccagtgacttcatgccctccccaattgaactgttcttccatgggaaacaacataagcatacacttacagaagaaaatcttacaaaaaacgtatataaattatggttaagaaagtgcaagcgcatttagtctaatgtactaaaactacactgagatacggtttttcacctttcagactggcaaaggccccaacatttaagagcacacattgacaaggctaggaggaaacaggcacactcatgtattgctgataggagaatgaatggggacagcccttataactggcaatgtggaagttatctatcaaaattacaaagactcttactctttttttgagacagaaactcattctgttgcccaggctggagtacagtggcaggatcagggctcactgtagcctcaacctcctgggctcaggcgatcatcccacccaagtagctaggactacaggtgcataccgccacacccagctaatttgttttactttttgtagaggaggggtctcactatgttgcccagactggtgctgaactcctgggctcaagcgatcctcctgcctcagcctcccaaattgctgggattacaggactggccaacttttatcttttgacacaacaatctcacttcagtgaatttatccaaaagatatggtgtcattcatagtgtgaattgccatgtggacgagcttcttcactgcagcatcatttataacagcaaatagtataaataaattataatacacttataaaaggacttgaaggagctgagaaagagaataaataaatgaataaataagggaaatctttatgtacaaacatgaacaaatctccagtaaacattgttaagcagcagagacaaaaaacatgcaaaagagtgtgcatatttcttttttttttttgagatggagtcttgctctgtcacccaggctggagtgcagtggcgctatctcggctcactgcaacctttgcctcccaggttcatgccattctcctacctcagcctcctgagtagctaggactataggcacccaccaccacgcccggctaattttttgtatttttagtagagacggggtttcaccatgttagccaggatggtcttgatctcctgaccttgtgatccgcccgcctcagcctcccaaagtgttaggattacaggcgtgagccaccgcgcctggccaagtgtgcatattttttaatggaaaaggcaagaacatataagcaaatgttcatatttgctttgtttgtataaaataactctagtacgtaagaaatctctctgactctcagccttcacatctgtggattggagaatataattctgtttatgtcatatataaacttgttatggatttttaaaatgtcttgcaaagtggtagccacagggcagaaattcaatggacagtcattcctctgtttctgtttctcttcagattactactgtcataaccatctaactcaggagttagcaatctatggcttgtgggccaaatacagcctcccacctgtttttgtaaataaagttttattggaacacagccacactccatttatgtatgtgtatggctgcttttgactacaatagcagagttcagttgttgcaacagagattgtatgacccacaatcccaaaacatttactacctggtcctttatagaaaacatttgtcaactcctggactaactggtcatggcccttcccagtgcaattctcaaaatacagggtgatgaatcttcctaagccagatctctctcctacactgtaaatgcccaatcttggttaactcatgccttctcttgtatatttacaaaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtaagctttttctacaaaatgttggaggcgagtgcacatttacattttcccagaaggaacagtaatacaaaatttggctacgttgctgtctgctaggaacagttttcaattttgcattaacaataaggcaatttgaatcacatattacaagcaagcatctaaaataatctgtttttcatgcctgcctatctaataatgtaatgctataattgttcagtatatcaagagacaaactcctttaaaatattttagggctgggtgcaatggctcacacctgtattcccagcactttgggaggccaaggcaggaggattgcttgaggccaggagttcaagaccagcctgggcaacatagcaaacctcatctctaaaaaaaatatatatatatatatatatagccaggcatggtggctcaagtctgtagtcccagctacccaggaggctgaagtagaagaattgcttgagtccaagagttcaagattgcagtgagctgtgattgcaccactgcactccagcctgggtgacagagtgagaccttgactgtaaaaaaaaaaattttaggttatgacacttgagtcttagattctatgtcatgtcatttccatctttagaaacttgcatgttaatctccatcagctttaaacttctgcagttgtgtgcactcttctgtaatctcccatttccacagcttttcagctctactagaaggagagaagatggcaactccatcagaatacttggcttggcttggcttgccatctcttctgtttccttctcagactttactattcaaattggagttgccatcctctctccttccaggaggattcatgtcacttgtatacattaccgcaaagttcaatagccaactcttccaggaagctatatgtaactttctgactgagctaaataaacaactttttctctcatgtggcatttcattttaaataatcatatatgtatatataaaaatatatacacatatgtatatacacacacatatatgcgtgtgtgtatatgcatgcatgttatggatggatatttgtgtcccccaaaaatgtatatgttgaaatcctaacccccaatatgatggtattagcaggtagggcctttgggaagtaattgggtcatgagagtagtgccttcatgaaaggtagtgcccttatcagaacaggagacagccagcttctttcctgactctgttctgttccatgtaaggacacagggagatgatgaccatccccaaaccaggaaaaatgccctcaccagacaccagacaccttgatcgggacttcccagcctccagaactgcaagagataaatgttgtttaagccacccatctgtactattttgttatagcagctcaaacacacacacatacacacacacacacacaatccaaaaatttgaaatccaaaatgctccaaaatctgtaactttttaagcaccaggacaccacaagtggaaaatactacacataagtacttaacacaaactttgttttatgcacaaagttatttaaaatattgcatgaatgggccaggcacagtggcttatgcctgtaatcccagcactttgggaggttgaggtgggcgaatcacttgaggtcaggagtttgagactagcctggtcaacgtggcaaaaccccatcccttcttaaaaaatacaaaaattagccaggcatgatggtgtccacctgtaatcccagctacttagaggctgaggcacgagaacccacaaggcagaggttgcagtgagccaagatttcaccactgaactccagcctgggcaatagagtgagacccgggccaggtacggtggctcacgcctgtaatctcagcactttgggaggccaagggggacagatcacgaggtcaggagattgagaccatcctggctaacacagtgaaaccccttctctactaaaaatacaaaaaatttgccaggtgtggtggcacgcgcctgtaatcccagctactcaggaggctgaggcaggagaatcacttgaacctggggggcgggtgttgcagtgagtcgagatggcaccactgcactccagcctgggtgacagagcgagactctgtctcaaaaaaagaaaaaaaaatagagcaagactctgtctcaaatatatatatataaaatacatatatatgtatgtgtgtgtgtatatatataatatatatgtatgtgtgtgtatatatatgtatgtgtgtatatatatatacttgagacagagtctcactctatttatacatatatttagtatatatataatataatatatatatatattgcatgaaatctctttccctctcccctccctccctcttaggacttcatttgaatctcttactgcaagctaacttttattaaaatgacctttgtatgagtcttctcctccatagattggaagcccctatcgaacaaaaccatgtcttactaattttttgcatttgaatataaggtactcaatacttgtttgcaaatataatttatttttaaatttctaccgttcaaagttgacaaattaaacataactgggagaattttttccaccatttctttcttgacactttctgtgctttctctgtaggtgctactcttgccttgcggactaaattttcagccagccagttttgggatgactgcagaaaatacaacgtcactgtcattcagtatatcggtgaactgcttcggtatttatgcaactcaccacaggtaacactccccccgttttactatcattttgaaatgggtaagatggaaattcaagtcactttgggttgtgctaggcttcaactgatttgcatatatcagttttgagtttaggatacaattatcatgataaagtacttggcactatacctaccatatagaggggacttagtaggtgggagttaatattattattatgatgatgattatttcctgcctttttacttgttttcacatcttactccccacctagcatatcctgcatttccccctctgcttactaaaagccattgtcaaagcccagttcaaatgatacctcatacattaaacctatttgggtcactccaacaaaagtcattactcttctcccctacgtcattttatttctaccctctgtggcccttgtcatgttgcaggagtttgtgttcatgtctcccatccttccttggctgtaatatctttgatggctggaaccacatcttgtctccttgttttctgttataccgaaggcatacaggaaacttttacttaatgctgtttaacaaataaatctctgtgtgactttgaaaccagccagccaagtctgtcaccaagctgggaacagatgccccagggcatctccaatggccttggatctgccctgtttgcagatgttcagctctcgatggggttgttctcaagagctcctcctgcccagtccctcaactctcatcagagatctggtatcagataggatttatcaatggtggcactgctgacattttgggcttttaattctttgccgcgcggacttattctgtgcattgtagagtgtttagcaccctttggactttgcccacgagatgccagtagtaacctccccacctccccaggtcatgatcatcaaaatgtctccagaaactgccaaatgtctcttggcagggaaatgctaacctagttgagaaccactgtactagacaatgcagtaaactcaccagattctaatccctttcaccagattctagttcctttattcagtcagtttaaactcaaaggatcactaagttgataaattgctattgataagcacctgttgtactcacctaacataccagctgccgtgtgacgcagaaagaagtgtcagatgctcttcccccaggtctctctcacctcactttactcagtctctgcccagatgttgcctcattagaagacaggcctcttctgctaataatcaaacatatcatctgcccctcactccagcttgtcactgcatttcatggcacctgtcactcctgacatagtaaaggtttatgtgattattgtctgccccccctcgccccaattaaatgaaagccgcatatgagcaggggctctgtccactaccagatctacggcaccaagatctgtaaatgacacatcataggcatcaacagattttgtggactgaacctctaaatccttgcccctgaaaaatgtgtagttgagttgagggagctaaaatgtttccccaaaatgtttgggcttagcacatattattctgattttttggcatattcaatagattctcgaggatcatcattagcagtgagttgggttagggtattttccacagcagttctgttcatgtcattattgaatttttttcacattaatattccacgtggcctccaagatagcatgtctctctattaaaatccagaaatccatatgggacccttctgctgggcttttcttctctaccttaaaggcactcctttgtcagttagaaaatctcctggggagtgtgtgttgtttctgtatgttctaatgggagcttcctttggactggacgaaaataaatatgtttgtgtgtagctgtcttcaggcccacacatatccacatatacacatgcacacatacacacatgcatgcactctcccagtttttctcttactgttgtctcaaatactggaaaacaaagacaatttcactggggttttacaacttcaaaatatactatgatttaatgcataatcttgaatgacccctggacttcctatttgccagtgcttccccacccctgagttctgtttggaaaatatttataaaaagtataataaaagatcaaagttatctcaaaaaaaaaccttcagttaaagatttttttaaattataggtcatcagtccaggcacggtggctcatgcctctaatcccaacactttgggaggtagaggtgggcagatcattcaaggtcaggagttcaagaccagcctggccaacatggagaaacccagtctctactaaaaatacaaaaattagcggggcttgttggcacgtgcctgtaatcccaactactcaggaggctgaagcaggagagtcgcttgaaagcaggaggcagatgttgctgtgagccaagattgcaccactgcactcaagcctgggcgacagaacaagaccctgtctcaaaaaaaaaaaaaaaaggaaagaaagaaagaaaacaatcatatgtcattagacaagcaggagatctatgcaaatttttttaaatttaatcataggtcatcataggaagtagaaagtacagattgtatgggatgtagggaaagattatatcaaaaagactttgcaaaaaaaaaaaaagaattggataaaaactagaatgaatgggggaagggcctggatcaatgtaatcaggaacttcttcacccttagagctgcctagaatacgctgttgctggagggactaaccccaccagcgacccccaagcactggatgccagggaggcaacctctgccttagcagaacagctaaaccaagtgacacccatccacagacatatatggcccagctcatcaggagaatctggggccagtgttgggaggtagaagccactgtgcttctctgccctcttcttaaccatattcagtagcttctctagtagagcagtgggctatggagaatgcttccagccctgctcaggtcagtggttcagatttggccccaggtacttaaagtaatgctgagagcaagtactctggagttagtcggcctgcattctgactctggcattggagcaggatagttaacctctctaaatctcagcttcccgtcagccaacaaggagataatagtacctacctcacatggggtctatgaagacaacctgagatgatatatataaaccacatagtagctggaacttagtaaattctcaacacatgttgccattattatcattatcactttccatgcctaacagtgtgtagctcataataagtaccccatacatatttgttgaatgaatcaatgaaaattctgcccacttacacaaaggaagaaataagggaaaacattctacttagttaatcactctcatctgaggttgagtaggggatgggatagcaaagctactgacttaagtgatttttaaaatattatagtgaatattttctattttgccgtcttcccgcattgtatttgggcctttgctttcaaagcgactgtttgtaatgaaaggccattctgattcatttcttgcagtgtatggttgtcagctcccattcggtttttgtagttgcctaaaaacaatgtcatctagggaaagttatttattggagcatgatattgctaaagctcagtgtttctttcctccagttacagactgaagctacagtctgtactggacaaggctccagtacaggggtctcaatgaggctttatgacacctgctggagtgtgggaggaggaagacagaaagggaaccaaaaaagagttccaggggccacacatagaaccatgatatttggaaggagaaataatattggccagaaccctgaaaaagctgaatagattcaacttacctctagtgttgactgcgtccccccagaattagataacctctgtggtcccttctagcctaaaatttctgtctctgcatcagcttcattctgttcaaaaaagagaatggatggatctgttgcagcacagagtggagagtggccaatatgactggggcccaagacagagggaggccaaaagaaagagggaaggggagcagaatcaggaaggttcgccagggaaggtgggctttgaagagtacggagaagttctgcagccaggcaagaaaagaagggcttctggctagcaggaaaatcacgtgagcagtgagatgaaggacccagcacactgggaactgcaagcagtctggcaggaggtgaagctgaggggctgggtcaggtggcaagggctttactctgctgagactcaaatgtgaacatgacaagccatgactaaagggccttacatggaagagcaatgtgggagatggcatttttagacagtccttttggctacgatgtgagaatacacagaaggatgaagggcctcttctgtaaagcaaacaggtggagccttgtccaggcagaagtgtaacatattaattattaagaacagggactctggagtttttctaaggtgataaagaccttcttccctttcacctcttggaagtcaccccaaaacaaggcgatgagaaaaacacacacaagcaccatcatctcagaaactaagagacattgcaaccatgaactacatagtataggaagctaaaagataacagtgactgacatagtaggctgagaagggtgaaacttaagaggcaagtcccaacaggaaggaagccagttgccttcctgaaggctgagaaattgcaggctttgaatacagctgaaggtgggatgaagtgtcagacttaaaacaggggagttatttgaaaatctgtgtaagaagtaaaatacggaggacaggatcatggcgagcgggaggcaggactagattgtggctccagacagagcagcatgagaggctcacattgtgaattttagctccagcttgactgcaagaactaaccagcaaccccaagaggacccacagaccctctgaaagaagtggattgctcctagaggacccgggagacaccccaaatactgtgatcgccccaactgcagaagtgggaaagggagaccctcatctcccgaacacatactggagaagctgaaggtctgtttgtagaacttcccgactttacctggagcctcgtcaagttagagagccaaaccgagcaaaatacaaaggtagaggaagctgcagaaaggccctgggagctcactggctcccctagcagcccattcccgcctggcaccacagggatccatcaggagggtggccagaggagcagggggcaaaactccacagggagaaggaattctctagctaaactttgggataatttgaacggggcaagaagactcctggccagaactccagggagggtgtgaatctggcttgcagactccacaggcggagaagaactaaagccctttctttaacagctgggaggcagaaagccttgggcaagttttcaagcctgactcgccctccacctggaaacagactcggggccgttgagggggcacggtgggagtgagaccagcccttcaggttgcctggaagctgggtgaggcctgtgactgccaactttcccccacttccctgacaacctgcatgactcagcagagacagccataatcctcttaggtacacaactccagtgacctgggaatctcgcccccatcccccacagcagccacagcaagacctgaccaaggagagtctgagctcagacaggcctagccctggccccacctgatggtccttccctatccaccttggtatcagaggacaaagaacatataatcttaggaattctagggccctgcccactgctggtgcctgtccacactattacagctgatgctttctggaaagtaccacctcctggcaggaggccaacagcacaaaacagggaattaaaccaccaaagttaaggatcccatggagtcattgcatcctctgccacttccactggaacaggtgctggtatccatggctgagagacccataaatcattcacatcacaggactctgttcagacaacccccagtaccagcccagagccaggtagacttgctgggtggctagacccagaagagagacaacaatcactgcagttcggctcacaggagccacatccataggaaaagggggagagtattacatcaaaggaacaccccatgggacaaaattctgaacaacacccttcagccctagaccttccatctgacagagcctacccaaatgagaaggaatcagaaaaccaaccctgctaatatgaaaagccaaggctcatcaacatccccaaaagatcacactagttcaccagcaacgaatccaaaccaagaagaaatccctgatttgcctgaaaaataattcaggaggttagttattaagctaatcagggaggaaccagagaaatatgaagcccaatgcaaggaaatccaaaaaaacgttacaagagtgaaaggagaaatattcaagcaaatagatagcttaaagaaaaaaacagggccaggcatggtggctgaagcctgtaatcccagcactttgggaggctgaggcaggcagatcacaaggtcgggagattgagaccatcctggctaacacagtgaaaccccttctctactaaaaatacaaaaaaattagctggagtggtggcaggcacctgtagtcccagctactcgggaggctgaggcaggagaatggcatgaacctgggaggcagagcttgcagtgagccaagatcgcgccactgcactccagcctgggagacagagtgagactctgtctcaaaaaaaaaaaaaaaaaaaagtaaatgaaaaaaacaagcaaaaattcaggaaactttggacacacttttagaaatgctaaatgctctggaaagtctcagcaatagaattgaacaagtagaagaaagaaattcagagctcgaagtcaaggtctttgaattaacccaataaataaagacaaagaaaaaataataaggaaatatgaacaaagcctccaagaagtctaggattaaaagaccaaacctaagaatacttgatgttcctgaggaagaagacaattctaaacacttgaaaaacatatttgggtgaataattgaggaaaacttccaagccttgctagacctagacatgcaaatacatgaagcacaaagaacacctgggaaattcatcacataaagatctttgcctaggcacattgtcatcaggttatccaaagttaagaccaaggaaagaatcttaagagctgtgagacagaaacacctggtgacctacaaaggaaaacctattagattaacagatttctcagcagaaaccctacaagctagaagggattggggccctatcttcaaccacctcaaacaaaacaagtgtaagccaagaattttgtatccagcaaaactaagcatcatatatgaagaaaagatacagtcgttttcagacaaacaaatgctgagagaattcgccattaccacgttaccactacaagacctgctaaaagaagctctaaatcttgaaacaaatcctgcaaacacatcataacacaacctctttacagtataaatcacacaagacctataaaacaagaatacaagtgaaaaagcaaacaacaaaaaaacaaaagttcacaggcaacaaagagcatgatgaaagcaacagtacctcacatttcaatactaacattgaatgtaaatggcctaaatgctccacttaaaagatacagaactgcagaatggataagaactcaccaaccaactgctgccttcaggagactcacctagcacataaggactcacataaacttaaagtaaacaggtagaaaaaggcatttcatgtgaaaggacatgaaaagtgagcagaggtagctattcctatatcagacaaaacaaactttaaagcaacagtggttaaaagagacaaacagagacagtatagaattgtaaaaggccttgtccagcaggaaaatatcacaatcctaaatatatatgcacctaacactggagctcccaaatttataaagcaattgctactagacctaagaaataagatagacagcaacacaataacagtgggggacttcaatactccactgacagcactagacaggtcatcaagacagaaagtcaacaaagaaacaatggatttaaactatactttggaacaaatggacttaacagatatatacagaacatttcatccaacagcagcagaatacacattctattcaacagcgcataactttctaactttcaccaagatagaccacatggtggcccataaaatgaacttcaataaatttaagaaaattgaaattatatccagcactgtctcagaccacagtggaataaaactggaaattaactccaaaggaaccttcaaaaccatgcaaatacagggaaattaaataacctgctcctgaatgagcattgggtcaaaaacaaaatcaagacagaaatgaaaaaattcttcaaactgaacgacaataatgacacaacccatcaaaacctctgggatacaacaaaggcggtgctaagaggaatcttcatagccctaaacgcctgtaacaaaaacactgaaagagcacaaacagacaatctaaggtcacacctcaagaaactagagaaacaagaacaaaccaaacccaaacccagcagaagaagggaaataaccaagatcagagcagaactaaatgaaattgaaacaaacaaacaaacaaaaaaaaagataaatgaaacaaaaagctggttctttgaaaagataaaattgatagaccattagtaagattaaccaagaaaagaagagaaaaaatccaaataacctcactaagaaacaaaacaggagatattacaactaacaccactgaaatacaaaagatcattcaaggctactatgaacacccttacgcacataaactagaaaacctagaagagctagatacattcctggaaaaaatacaaccctcctggcttaaatcagattaaatcagaattagataccctggaacagaccaataacaagcaggaagattgaaatggtaatttaaaaattaccgacaaaaaaaagtccaggaccagatggattcacagcagtattctaccagatgttcaaagaagaattggtaccaattcttttgacactattccacaagatagagaaagaaggaaccctccctaattcattccatagagccagaatcaccctaataccaaaaccagaaaggacataaccaaaaaagaaaactgcagaccaatatccttcatgaacacagatgctaaaatccttaacaaaatactagctagccaaatccaacaacatatcaaaaagataatccaccatgatcaagtgggtttcatgccagggatgcagggatggtttcacatatgcaagtcaataaatgtgatacaacacataaacaaaatgtaaaaaatcacatgataatctcaataggtgcagaaaaagcattcaacaaaatccagcatctctttatgattaaaactctcagcaaaatcggcatacaagggacataccttaaagtaataaaacccatctataataaacccactgccaacataatactgaatggggaaaagttgaaagcattccccctgagaactggaacaagacaaggatgcccattctcaccactcctctttaacatagtactggaagtcctagccagaccaatcagacaagagaaagaaatacagggcatccaaatcagtaaagaggaagtcaaactgtcactgcttgctgacgatatgatcatttaccttgaaaactcttaaggactcctctagaaagttcctaggactgataaaagaattcagcatagtttccagatacaagattaatgtacacaaatcagtagctcttctatacaccaacagcgaccaagcaaagactcaaatcaagaactcaaccccttttacaatagctgcaaaaaaaataaaatacctaagaatatatctaaccaaggagtcaaaaggcctctacataaaactacaaaatgctgctgaaagtaatcataaactaaacaaacaaatggaaacatatcccatgctcatggctgggtagaatcaatattgtgaaaatgaccatactgccaaaagcaatctacaaattcaatgcaatcccatcaaaataccaccatcatccttcacagaattagaaaagaaaattctaaaattcatatggaaccaaaaaaagagcccgcatagccaaagcaagactaagcaaaaagaacaaatctggaggcattacattaccccacttcaaactatactataaggccatagtcaccaaaacagcatggtactggtataaaaacaggcatgtagaccattgccacagaatagagaacccagaaataaagctaaatacttacagtcaactgatctttgacaaagtaaacaaaatcataaagggggcaaagtacaccctattcaacaaatggtgctcagataattgccaagccatgtgtagaataaaactggattctcatctctcaccttatacaaaactcaactcaagatggattaagaacttaaacctgacacgcgaaactataaaaattctagaacataacattggaaaaacccttctagacattgacttaggcaaggatttcatgaccaagaacccgaaagcaaatgcaataaaaacaaagataaatagctaggacctaattaaactaaagaacgtttgcacagcaaaaggaacagtcagcagagtaaacagacaacccacggagtgggagaaaatcttcacaatctatacacctgacaaaggaataatatccagaatctacaacaaactcaaatcagtaagagaaaaacaaacaatcccatcaaaaagtgggctaaggacatgaatagacaattctcaaaagaagatatacaaatggccaataaacattaaaaaatgctcaacatcactaatgatcagggaaatgcaaatcaaaactacaatgcgataccaccttactccttcaagaatggccataatcaaaaaaatcaaaaacagcagatgttggcatggatgcagtgaacagggaacacttctacactactggtgggaatgtaaactagtacagccactatggaaaacagcgtggagattccttaaataactaaaagtagaactaccattgatccagcaatcccacttactgggtatctacccagaggaaaagaagtcattattcaaaaaagatacttctacacgcatttttatagcagcacaattcacaattgcaaaatcgtggaaccaacccaaatgcccatcaatcaacaagtggataaagaaactgtggtgtgtgtgtgtgtgtgtatatatatatatatatatatatatatatatatagtatagtttgaagtgaggtaatgtaatgcctccagatttgttctttttgcttagtcttgctttggctatgcgggctctttttttggttccatatgatatatatatatattccataaaaatatatatattccataaatatatatcccacaaaatatatatattttatggatatataaaatataaatatatagtacatatatccataaatatatatatattccataaaaatatatatattccaaaaaatatatatatattccataaaaaggaataaattaacagcatttgcagtgacctggatgagactggagactattattctaagtgaagtaactcaggaatggaaaaccagacatcgtatgttcttactgatatgtgggagctaaactataaggaaacaaaggcatgagaataatacaatagactttggggacttggggggaagagtgggagggggacgagggataaaagactacaaatatggtgcagtgtatactgctcaggtgatgggtgccccaaaatctcacaaatcaccactgaagaccttactcatgtaaccaaataccatcggtacccccaagaacttatggaaaaataaaaataaataaataaaatctgtgtaagaagtagctggacctgctattcccctcttccactgtgtgggagacaggaggatttttctctggagagctaaagaagctttgactgaaggaccccaagaacagaggagagcagggacgaggcactgaaaacagagattaagaaagtatctacgtactaaccagggagaccccaccagctcctttcccctgcacagatactggaactccagtagccaggttatgcttgcaggcaggatattgaaggagtgtaattcttaggaagaactaaactttcccggaaaagacattggacatgggctcactgcctcgtcaaccagcagtgcagcccagctagcagtagccccctcaccctgcccccacagaactgcctaatcatctttctgttgcattactcttaaatctgaacaaacatgaagaatcaccaagcacctgaggaacgcctcctacaggaaggatcatcaaaagaaaagaagcatcaactcaaaaaacagaagaggccaggcacggtggctcacgcctgtaatcccagcactttgggaggctgaggtgggcggatcacaaggtcaggagttcaagaccagcctggccaacatggtgaaaccccatctctactaaaaatacaaaaattagctgggcacggtggtgggcgccagtaatcccagctactggggaggctgaggcaggagaatcatttgaacccgggaggcagaggttgcatcgagccgagattgcaccattgcactccagcctgggtgacagggcgagaggcgagactctgtctcaaaaaaaaaaaaaaaaaaaaaaaaacccgggagaaatgtttttaatgtatcattaatatcctcagagagactggagaagatattgtatccataaaacaagaatagtgtactgttttaaaagaaaaaaagaatcagacttgaaaactaaaatgatgtttaaaaatctttaattcatagaaaagttggaagataaagctgagaaatcttacagaaagttaaaaagataaattgatggtcataaagggagagtagataggaaaattagagactaatcaaagaggtcccatatatatttaattggaaatcaggaaaagagaatagagaaagtggagaggaggaaatgatcaaagaaatagtacaggaaaacatccgagggctggacagactgaaagggctaatggagtagccaataaaattagtgcaggaaaaagaaattgtgccatgatgaaatttaagactaccaaaaaaagatagtgaaagtttgactgtcagtagcaacactgcaagctgaaaaacaaaggactggtgctttcaaaattctagatacaaattattgcccatctagaattctatatccagccaaatcatcactcagatatacaatattcagatattccaagtctccacaaaaaaatagtaaaaataaaattaaaaaaacttaccatgtacatactccccttcgggaatttactaaagaaaatattccatccaaacagaatgaaaaaaaagcagaggaaaacacaggatcaaggaaagagagacaaagggaccccccaggcttagaaaataactagtccagactggagcagaggagacaaagaagcataatggaaaacaggaaattccatgagcagatagatttcaccatgaggaaaattttagaggctgttggaggataaggggaaacttaccaatagaaactaaggaaatgaagcaaattggaagaaaggcaattaattccaggaaaaataaaaatttgttcatagtgtattacttggctcctcagtgttgtattatgggcagaataatgtgaacactgaatattggtttaaccaaaaattgtgatactggaaaaatgggagagagaataggaaagaactgaatcctcatctaccacaataggaaatctgaaattgacgaaacaagagaaagaagtataagcatttaatttagaatttaatttagaaatatgcagatagcaagaagcagctacaagagttaactgtctgcctctgggtggtaaactgggggtgaagggtgggaacaggtagatggcgtgaatacagcattgttcacttaagggtctttcaggactatttgtttcttatcttacactatgtgtgtggcactctctctttgttgctttttttccttttttcttttttttgtggggggtggaatttattggtgggcatgagtaaggaggggcagcacagtggacgccctctcaagtgcagggctttaaaaaaaaaataaggaaaagagctctctgaagccacattgattcagatttgaatcttggagcaaccgttttgctacctttgtgatcctgggaaaataattttaagcttcctgagtctccatttcctcaattgtaatatgaggcaaatacttttattagctatcacctttcatagggttctttagaaacaggtcaactgcctgacccacagaaaagccttcaatagaagctttctgcctgtgttaattacctggcacccttcattcctctctggacatcttgacctcttgctcctcatcagtcccccaggtgtgtttgcatgtttcaccttagctctaatgtgacgaagaaggtttttttcttgtttaaaaaaaataagctggtgacccttgatctagaaatcagttcctctgaggagtagctttggtgatggagaaacactgttcgccctatgggaaaggaaaacttgagtcatactctttcagccactggtgagcaaaagcttaggtgagaaccagacatcttagaagcctccaggatctcccatttgtgcccacaaacatttccagccttaatcccttttgctgatgtaataagattcttcagctggatgatgaaaactgagcccatggtgttgtgattatgagctcagctacctgctactggcaggtgatagctgcacctgtgaggctggtcagcttcccacacacccagggtgcctgcggcctcctgcaccctaagccctgccctgacctggccactaattattgaacagggagtgaggtttcctggtagagattatctattttactgccaggattatgctctatgcaaagcacaggtccaggcactggggatgacatagagatacatgtacatttggcctcaaaggagtttaccatttaatgagggagatagataatcaccatccaatagacaaggaaataaacgaagtgggtaggagaagggctgctggcgggctgcatgtgggataagtaagaccttgggtctacatgtgggaatgctgctttggagcttccattgcaagcctgggagcaggtgagcacccagctcaggtgatcttctttaagcaaaagcaagtcttcaaatatgtgtgatgttttatccttggggcggcagtgggagggggtggtctctgaatactgacagtccttatggaagaggatagtgccttgtgggcagggtgaccctacaattcattatccaaacagggacacttgagagtgaaggtaatgaaagataaccagcattccaggacacgtatagccagggcttgccctggcaaaccagacatatgatctctggacttaacgggagcttggtaattataaagcggggtagagtcagtgacctagggaccagaagagaatagattctggctgggcacagtggctcatgcctgtaattccagcattttagggggccgaggcaggaggatagcttgaggccaggagttcaaaatgagcctgggcaacatagtgagaacttcatctctacaaaattaataaataaattagccaggtatggtagcacgcacctgtagtcccagccactcatgaggctgaggcaggaggatcgcttgagcctgggagttaaggctgcagtaagccataattgcaccagcctaggcaatggagcaagaccctgtctcgaaaaaaaaaagagagagagaaaatagattcctactcagtctgaatgtctaggtctcatgcaggttcaaaaggcttctcaggcagctcccccagacaccctgggtaagagccactggcggtggggtgggggtgggctggtctctcttgacacatttcctcctcagaatgactgctcaaggggcccattttcaccagtgaccagcatcagtccacctctctgggtgggactcctcaaaaagccgcatatgttctggccaagctacttaaagattaaatgtttattttctgcttccctggcgccttagctcctcctgcatggaaaccaattcagagtttgccttggtgtggtttttaattgccatgccaaagtcccgtacccttatagtgcttttcaaagagtaattcttattccaaaaccacttcacagtgatttcacagtgtaagaaataatatagaaaaagctctaaccaattgctgttttatcaaagaaattaacagttgatgtgagaggacagccctaatgacctagcactgttaccccatttcattctgtatcctgatagaataaaggtcatagagtaacagaatttacaacgtaaaattatacctatttatttgtctcttccaccaacctgtgatttcctggaggacataaattacattattaacataagatattaaaaccatcaccgggctggtctgaaggtagtgagttacctcaattgattgttcacagttatagatcaaacttcttgttctactctttcccctcttctcactactgtacttgactagtctttgttaacaattaaaaataataaaataaaataaataaaaccatcattggcatggacatatttgtggggtctcctaaatgactgtggttgaatggaaggcagcctggtcatagccccacctctcttgctgacaccagagagactcctttcagtccttacacccaaaacagactttcctttgtgatctttacttacagcaaatcatattcttcccaggccacctgaggcaactgggaggtggcctcctccttctcttcccctccccatcccactgggacagttttgttgtctcggttcagctctgcctgatcttatgaacactggagtctacctgttaaatggggcagggcatggtcaagactcttccctgcagttcccacaggatccaactgttgctctttaatggctttgtggaaaatggctttctctctctctctgtcgctcactggactgtgtttcctgttttcttctttattgtcataaaaatcctagacactgctcagggtcccactggtagtagattgtgcccatctctgacagatctttcccatgtggctcttcctttctggaaattcaccagtgttcaccagccccatcaagaaaactatgaacatattatacacattattctaactttagattggatatggattaaatgttggcatcacctggttctgtcagattgcctcatctggctccttagaaaccaaaatgggagaattcacatgttttggttgttaaatcatagttccagctgtcagaccatactgcttgtgctagaggaatagggaacgatgtgtgtgggtggcaggaaaaaggcagacactaaggggcatttataaccaacataaatatgtaataaaggcaatgtcagtataaattaaatacatacaaaataaaggcaattattaatatgtaagcataggctccagagatgtttcagtttggtctccttcttctcccccaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaagtaagtacattgaaaaatgagagcatacgtagccagttttcagaatacagagacttcttaaaagccaagtcatgatgatgttatcagaagtcaggcagcatcagagccatggcccattcctatcaccaagagaagttttgctcattctctgtgatgatgacttcaaaaaatcagatcctccaattaaaagcatctcaacttctattaagaacaatccattgtgcccttgccatctgcaacttaggtgaagtcttcctgatgccatttatacttgcatgtgataaaacacctgaaggttacaagttccgtaagctaatcgtacactgtgaaacatagtatttccctttaattgtgtcgtgcagcaccatcacctggggagttttttttatatgcacagatgcaaggaccaacccgctaggctttggattcagttgttctgaggtggagcccaggcatctcagtgctaggatctggtgaacatttatgtctacctaataattccaccagaaagatatttgtaagccagctcacatagccgtctcttttccctgtcagtcattttattgctcatgggtctctgttgtcttttttgtactcaagcagtcagtcttccagataaccaacaattctgcaaatatccagaaatgttcagcaaatgctgagcctcctttggcttgagaagtcactgcggtcattgtgcctctgggcagctcatcctttctggccatgaaacagccgcaccagaactcccacgcaacctgtgtccccagggacaggccagcagaatacagaggacagtagttcatgtgcgtaagagccctggctgtggagagcaaatctcagtgccaccatatgctagctgagtgaccttgggcaggtcacatatgttcctcaggcctcaatttcatcatctgtaaaacagagataacaagagaaaatattgaacccagtgcctagcccacactcgataagggaaaaggattgttgaaaggattaaacagccaggcgcagcggctcacgcctgtaatcccagcactttgggaggccgaggcaggtggatcatgagatcaggagatcgagaccatcctggctaacacggtgaaaccccgtctctactaaaaataaaaaaaattagccgggcatggtggcgggagcctgtaatcccagctactcgggaggctgaggcaggagaatggcgtgaacccgggaggcggagcttgcagtgagtcgagatcgcgccactgcactccagcctgggcaacagagcgaaactccatctcaaaaaaaagaaaggattaaataacttatgaaaaggcccttagaggctatagcccaatgcctgtcatttaacagccttgaataattgttagccgtaatgatgataatcactctatttcttatattctggcctaatctcaaggtgttcccaagttcaaggaccctctctgacaatgacagctccacctacgctacacaagtccctccacagtcctctagacctgcgctgtccaaacagtagccactagctacatgtggctacttaaatttaagttatattaataaaagtttaaatccagttcttcagtcacactagccacatttccagtgctgaatagccacgtgtggttagtaactaccgtattgagcaatgcagacagagaatatttccatcatcacagcagattcctgggcagtgctgctgcagactgagaatcgatctcctacaccccactggaactgctgctgagggtcagctaatgctgtatattacccattctttactttctcatccattgattgccatattttattgtcagtttttctactttaagcaaaacattaaaaaaaaaaactttaaaaaccggatgatcccatgcaattgatgtagaaaagaacatttattactacctataaattttttacattcctgcaaataagatctacatttgttgaccataaacaccacttgtttttttaacaagtactagctgtctgctaatactaaagcatatgattgtttgcttcatcacatagacttgaatataaatttgaaatagacacagtaatcatggctaataattatatccaaatactgtcatgtttgcatttttcttccaacaaggaaaataatatatttattattgctcttactgaattgctgataattaaattctcatgctttgaattatatgttaaatatgatagagttttcataattttatagtcatgggcatgaaataattatggcttcgattctaaaatatattagataacatttccttagaaacatgaaaaatctaatagtgtcatattaatataaggttatacaagattttaaaaacccatttgtgatacatccaccaaaagacacaagaatgttcataacagctttatttataataggccaaaactagaaataatccaaatacccattaacaggaaaatagataaataaatcgtggtatgtttatacaagggaaaattgcatggcaataaaaaacaccaacatggatggatgaatattatagacatatttagtgaaagaagcagacacagaagcatacatttatttcatttatttgatatttaagattaattgacagcagtataagtcagaatagtagttaacttcacagaaaagggcaggaggaaactttctaggtgaaatgaaagttttctctgtctctctctgggtggcagttttaagggtatatgcaaatgcaaaatttcttcaacctgtacgcctaagatatactttgtgttataccacaattaaaaagggaaaaattataaaagatttatactcaaaattattttaatcttgctagaaaatcataacttatgacctgattaaatatgatgtggagaaagatgaacctgtccgtgatgaaaatggatattgcgtcagagttcccaaaggtacagtggacttttgttcaatcaacctgtgccccttcttatcttgatcaagtgacttttaaggactaacatattattgccacatggtaaaatttatcagagtggggaaaaggggggtttatttaagtaccctccaatatacaggaattccaaaggtgctaatttaccgctgcatgtaacataattctagttttaaacatagcttaacaacttcttgcttatgaggtaatgttttgtgggaagggatatgtaattgtggttgcaaaactatagttttaggtggcctttacctttaagctttaacaactgtgcgtttgtgtaagtgtgcataaatcattattcagtaaaaaattagcagtaaaagaattacaggccaggtgtggtggctcacgcctgtaatcccaacactttgggaggttgaggaaggctgatcatttgagataaggagttcgagaccagcctggccaacatggcaaaatcctgtccctactgaaaatacaaaaattagctgggcacgatggcacacacctgtaaccccagctacttgggaggctgaggcaggagaatcccttgaccatgggaggcagaggttgcagtgagccgagactgcaccactgtactccagcctgggcaacagggcaagattccatctcagaaaaataaaaataaaagtaaaataattaggccatatacaataatgtacagtatatgtgtgtgtggtgtatgtatgtgtgtctgtaatatatatgtacatataattcacaggtatacatgcatggaaaatgatacttcctacagccagcttgttgccagcaggttgtatggcattagttttaagagaaggttgatgtataaatttgacctctagcacataaaataagtttactttcttctgtcttaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggttggtttttctgaatcattgagccaaaaacaaacacacgcacagtttggcttactcctagtggaatcgcattccactttggttatggtgcatttccttctctatctttggcacatcaggtcaaactcctgtgttcccagagaatgaggaatgaagtgcatgaagtgtcactctgcagtgcacggttaacttggctgagcaacaccagatgagaataaggcaggaaacctgtatctgatttctggagacaaaagtacatttaactcctcttgtttctcctgcattattactggtcactcttaggacagccaaggattttcacctttccaatcatggaggtgtttagataaaatcagatgcaaattaatgtggagctgatctagttgaagaggaggtgaggggttcggagccccttcccccaacccctttcatccccaaccagatggtttcccacagaacccccaggtcagcacaaggaagtttggaagtccttctaacagaccatggaattaacttccaaccatagcacagtcctccagcctcatgacacagcttccttcctgtgtaaactccctgagggcaggccctgtgtctgcctgttcacccccagcacctaccatggtgcctggtgtcattttttgcatgaatgaatgaggaagggatggaagttgtctaactgcagtagaaagacagcaggtggaatgaggagaaccaggctcacctctcccactgagcagcagtggtatcaagacagataaccattctggacctcagtccttttgcccttgagatgtgggtcacgatgattctcagggtccttccatctctactattccatgtcttaagatccatatcactttatgccatcttcatgttattaagatgatacttctgggagggctaaagaatttttaatgggccaggcgtggtggctaacgcctgtaatcccagcagtttgggaggccgaggcgggtggatcacctgaggtcaggagttccagaccagcctggccaacaaggtaaaatcctgtctctactaaaagtacaaaaattgctggacatagtggcacgcgcctgtagtcccagctacttgggaggctgaggcaaaagaatcacttgaacctgggagacggaggttgcagtgagctgagattgcaccactgcactccagcctaagtgatagaatgagactctgcctcaaaaaaaaaaaaaaaaaaaaaaaagaatttttaatgaaaacaaaatttaactctttattaagtgaaaaatagcacctggttgggccttaacattagaatctccctgtaactaaagtgtgattttttttttcctttcttgttgccgtgagaccctgaaataaaatatgaagttctattaaaaagaacttcagaaactgaattaagtagcaactgagttagtaaatgagaaattgagagacctaaacagcagaaaatcgttgagatttctttctaatttccactgcctttcttagctagggctgtattttaacattagaacattattctgtgtattgtgtttcatgtggcaacattgaaattccatattttgttatctaggtctatacttttcccttttatgcctcaaacaagataccccggccaggactaagttggggagtttgaggggccaagatgaggaacacgagatcaggatcatgcagaaatctaaaggaaacaccagctctccgacattgcaacctgggccagaaaccaccagtgacctctgctaactttgtcctttcttccaggtggaaaggggaaaatgtggccaccactgaagttgctgatacagttggactggttgattttgtccaagaagtaaatgtttatggagtgcatgtgccaggtatatacaagatatgatctgtacctaaacccatagagtaactgaacataattttggcctcaaggcgaagtttgtcattgctttctcccgccatccagagttaaacagttctttcagctgccagggagtaaggagcttatgtctggcttatgttccactataaaagccaactcagtgcatctgaacatggccttctcttcatttcagctcccagccattcttgggctctcaggcaaacaaagtctcaaatatgggagctccatgccacatttggcacacctcgagaaaagtcgtgtcatgcttaagagctgggaaatgatgtcctagcctctgaactaggaggcaaaaagaagagccagtgcagttgctagaagaaaaagctggggaaaagtggattttgtacagcctcttctttttaagatttctaagcccagttcaccacactaagtttcagaatcatcacacaagaacgttgtcaccgcagcttcatctgcagatccacttctgccagcagagtcaggagggccagtgtctgaccttgaatcctggcttcaacatctgctggctgtttgactgcaggcaaatcactaaaattaaggataatgccagccctgcagttaagcttgtcaagagaacaaattcattttaattacatcaacgctaagcatatatttatcaaatatatatataagggttgttgtgacaataaatcacattaataatagacatcagagaggattccagcctcaaaattactgtccaaatataaggcattaggggtattattattcccccacaactcatatttgggattcccacccatattcaaagtagaaatctaaaagtccctttttcccaagctctgacacttctacatggccctgtgcttgttattttttaaagaatattcaaggccgagcatggtggctcactcctgtaatcccagcactttgggaggccgagacgggcagatcatgaggtcaggagatcgagagtatactggccaacatggtgaaaccccatctctactaaaaatacaaaaattagctgggtgtggtggcacgtgcctatagtcccagctactcgggaggctgaggcaggagaatcgcttgaaccagggagtcggaggttgcagtgagccgagatcgtgccattgcactccagcctgggcaacagagcaagactctgtctcaccaaaaaaaaaaaaaaaaaaaattaagtccggacactgtggctcacacctgtaatcccagcactttgggaggccaaggcggatggatcacttgaggtcaggagcttgagaccagcctggccaacatggcaaaacttagtctctactaaaaatacaaacattagccaggggtggtggctcccatctgtaatcccagctacttgggaggctgaggcaggagaatcacttgaacccgggagatggaggctgcagtgagccaagatctcaccactgcactccagcctgggtgacagagtgaggctccatctcaaaaaaacaaaaagaatattcaagaatatctcttgcttgttcctccccaactcagggacaatgacacgaggggaaatatggccacatcttgatgtgagaggggacagaatggaagggggtgtgaatactcccattggagaactccccaggccttatgctgagttaacacaagggtctaagttgtggttgtcagccattgtgccaccctacgctcttgcagacccttcctcaaatgttgtgtaaacatctaaatgcttgattttaaaaagaagaatcatacaaaagagtatgtgtgaggtgagagaatctagaagatgaaacagaaggatctagcctagtgttcctcaaagtgggtccccagatcagcagtgtcagcatcacccaggagtctgttacaagtgtaatttctcaggcccaccccgaactaccaagtcaaaatctctggggtggggccaggaaactgtgctggcacaaacaccccagagattcttaaaaacattggaagtctgatttagggggtgatgaaaatgcactagaactagatcctggtaatgatagtacaacattgtaagtgtgtaaaataccactgaattgtacacttttttttttttttttttttgagacggagtttcgctctcgttgcccaggctggagtgcaatggcgcgatctcggctcactgtaacctctgcctcccatgttcaagcggcaattctcctgcctcagcctcctgagtagctgggattacaggcatgcacgaccaggcccggctaattttgtatttttagtaaagatggggtttcaccatgttggtcaggctgctctcgaactcctaacctccggtgatccacaccccgaccttggcctcccaaagtgctgggattacaggcatgagccaccacgcctagcaaattgtacactttaaaaatgagttggaatgataaattttatgttatgtgtttatcacaatttaaaaaaaaacacacacactgaagtctgagaagcactaaagcccagtggttccaaaaatttggccaatcatcagaaccatctgggaaactttttaaagcctggatctaatggaccagaagctctggagtatgggactcagaatctgcatgtcttttttttaattcccaagtgaatctaatgatcagtgagttctgggagccactgaaacagaacaaagggaaggagattgacagtcttacagtgttggcagacagtcagataggatgaggagcaggtgtgttctgtgctgctccagtgatcagaactaaaaccaatggattaaaatgaccagggagccagttttagcctgagaactcccctgtaaccaaaggaaccatcaatagaatgggcttgtctcccaggataggaaatgcccccaccaactagggcatgtaaagagaggctggatgtccacctgggatcctgggagaactcttgcagcagtgaaagattagagataaattctaaagtccctcccaactttcagattctgtgattcccagtgccacaactgctgctgtctggccccccatccacagaggccagtcccattccagactagaaatgcagcagtactgtctgaagtaaggcatcattccactatgggtgattctgcacaaggcaatcacacacctcagctttggaacaggagagaatttccaggtttgggcctggagaggagttcactttttctaggtgtcacacctgaactgcccaactactctgtagaactttctgcaatgatggaaatgttccatatctgcactgtccagtatgatagccaatagccaccatgtcactatggaacacttgaaatgtggctagtgcaactaaggaactgaatttttcataatatttaattataatttattttagttttaatagccacaaataaccagtgggtgtcatattagacagtgcagctctagagaacccttggccaaaattgacctttacaattagcccagagctcctataggctggaaccattccccctgaagctgaactagtcccaaaccaccctccgagagttggggcagaggcctgagacctgacaggcccatttgcccgtaggtccagcgtcgctactaccagagcaagaagcaaggagacggtgaatgtggaggatttctgttgcatgagccttaattctaaaaggagcttattggagacacttgagatttctaagacaggtgctagggaccctaaactaagaggatctggtgccactgcctctctccctcagacaagaagcaaaccaaatgagggggcatctttttttccttttgctgtttgccttctttagagctataggtaaacacacaatcaccataggagagatttcgaaagctggggcccaggtaaccaagggaggctcctgtctcctctctgattacagctgagtagtttagggaagtggaactggactcccgctgggtctgctggatcaggtagaagatacattaatacctaattaccactgtcctcacaagaaggcagtggtaattgttggaaacttctctgggctaaattccctgatgtaggatctgttctctctgtggagagcacatcctcttgggactaatgggccttaatgggagggcacaaaacagctcctccctgtgcctgccttcacctcctgtcccacatcctctccaaaatgcagacaagaaaagccattagaaccttgattagataagtaggtctccaaggtggtatttgtgcccagaagtgcaacaaacctgacattgcaacctgaagaacaacccaagctcagtaagtcatgcatggaggtggagcaaggactttcactggagtctaaagtaacttcctgtagccaccagtccaacctactccctactaagatgtgtttgtataggctgctagaaagaaggatgatggttataagcacaggatctggagccaggctgcctgaattcaattctgtaccctgcctagtatttgctgtctgaccttgaataagtctcttaatgtctttaagcctcagtttcttcatctgtaaaatggaaataatatctacatctcttcagaaggttgttgtgaggattaagtgagatcatcaatacaacacacttagtatagggcctggaatataataaagattcaaccaactgttattattgctattagtattagtacaatcactttacagtatcttcatgtatttttaataaaaattccagctatccaaatgaaacccatgctataaatgttgtctgagcccacagttctttgaactaataaagcatcataaatagccttaacacttctaattttttctcactttatttctagatcatgagggtcgcattggcatggcctccatcaaaatgaaagaaaaccatgaatttgatggaaagaaactctttcagcacattgctgattacctacctagttatgcaaggccccggtttctaagaatacaggtgagatctcttattatccagttcaatgatctgtcctcttggagattcctaccacttagggaacaactcgccttctcccaggatgactacatttgccaagttttcaccgcactttccaggaagctcagaaaagtgtcatagaccaataaggaagtggtaatatcaggctgggtgcggtggctcatgcctgtaatcccagcactttgggaggccgaggtgggaagattgcttgagctcaggagtttgagaccagcctaggcaacgtagtgagacttcatgtctactaaaaatgaaaatttttaaaaaaggccaaacgcggtggctcacgcctataatcctaacactttgggagacagaggcaggtggatcacctgaggtcgggggttcgagatcagcctggctaacatggtgaaacccggtctctactaaatagacaaaattagctgggcgtggtagtgcatgcctgtagccccagctactcgggaggctgggacaggagaatcgcttgaacctaggaggaggaggttgcagtgagctgggatcacgccactgcactccagcctgagcaatggagtgagactccatctccaaaaaaaaaaaaaaaaaaaaaattagccaggcatggtgatgtgcacttgtagtctcatctacgtgggaggctgaggcaggaggattagttgagcctggcaaatcaaggctgcagtgaggtatgattgcaccactgtactccagcctgggcatcagagcaaggcccagtctaaaaaaaaatatatcagaaaacagctagaagaaatccaatcctaatccctttctccttacaatgacaggccagttcattcagcaagagacttagcacataactcacaaagtctgtttggtgagtcctgacagatagcgcaaatagaaatgctctgaccctgtttgttgtttccagttttaaagaacacagaaatccacagaagttctacacctttctgtggtgtgaaatttaattggacattagccagctggaattgcctaagacttaactatcaccgctaggaggattttttttcttcctccaacattaaccctttggttggtttaatactctcacttttagactttgagctctgtgattctgtagctgaagacttgacaaaggaggtcttaagattccagatattgtgtgtataggattattcctgttgatgttcatagggcaccaacatttgctttgcaaccagatggtaaagtggcatgaaaatgaaatatcctcagatattttgattaacacataattgaaggaaaaatcagtcttcaatctaatctaatagacaagcagactgagaaaacagagttgtctgtaaatgatccctccttctaatcccaccatgaatcaggatatcctagcggtacctgaagccttaccaagaaataggcaccacccctctgctcagaaatctatgcacaggtatctcatccttggcaggtcctccctccccacaggtgatcctaaagctttaagggaataaaaaatacctcacaaagggctccctaatggagatcctgcaaacagaatgtatgggtatcatataaaactttcacttcgctagaaaatgtaaagagtggatgttacttgcccctaccacaaaaatgatatctatatgaagtaatccatttgctaactagccaaactattccacgatgtatatgtacttcagcacatcatattgtacatgagaaaaacacacaatgttatctgtccatttaaaaataaattaaaatggaaaactttattttaactttcacttcccagctctcacatgagccagggatgctaatgatttgctagatccccatgccccacccctaccccttgctctgcatcctaatctattgcaaaatgcaaccaaaatgtggattatttgatgtttttcaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaacaccaacatgtgagatggcactgtctctgtgttctttcctcactttactctaaatacaaagcctgtgtcaattactccaaagcctgaagtcctcactggtaacttttcataggtgtcccattcgtaagagtaaagacgttctaggtaaaaatggctgggaacggggggtggggtgagggatggtagggtgaggcggctagatcagcagtggccaacacaatggaaatctactccaatgtgaggaggccaactttccctacccggaggcatcctgtccactgtgtataggtagcattatccaacaggtaataatgccatctatagtccttacaggagcctaattctatggcatcagagttctgtacacaaaaggtgttcaggccgggctcagtggctcacgcctataattctagcactttgggaggccgaggcaggtgggtcacgagatcaggagttcaagaccagcctagccaagatggtgaaaccccatctctactaaaaaaatacaaaattagccaggcgcagtggcaggcgcctgtaatcccagccactcgggaggccgaggcaggacaatcgcttgaacccgggcggcagaggttgcagtgagccaagatcacatcactgcactctagcctggatgacagagtgagatgccgtcttaaaaaaacaaacaaacaaacaaacaaaggtgttcaatacattttagctactttaggggttgcaaactcaagtgtcttcagaattcacataggtaatgtggatgagaaaagcaggtcacaaatgaatgtggtaaacttggggacggccactaagcttcagtcagctaaatacaggccaagtattgctggaattttttaattattcagaaaacagaaatccatcagaacttattaacattagtgtcactaaagttgatctacaaccaccccccccgcccacatacacactctcacaactacgaagtttgactggctttttaaaaagaaaacaaatccagatatgtatgtgaatctcccaatttttgaaatctgaagtctcaaaatttttaaaacttctatgcatcccaaacaaaatgtgtgtctgggccagataaatcccagctgtccagttagcacccgagtcccacttacatgtgcccctactcctcagatggcaactggtttcactccaaagccagtctcctgcccacggacccttttcaaagaccggaggacctttagggtggcacgggaggctttgggaaattctgaggagctctttcacataagccctttctccttagacccagctgcctcccttcctgggtttaattgctttacctctgcatgtatgagctgcaacagaattccaggagcaggtcatgggtgaaagcattcaagacgacatgtaccttacctagagcttgtcctaggcatgggagcatcatggtcattgagttcacatccagaaagcatggcccaagtttaccacagcctctctagaagtttctgtcatggagtttccttccctagaggacatcttcagatgaccaggagctggtaatgtgtgctaattctcccccagtttagtccccataaagccccaggcaaacacttctaggacttctcaatgatacatgatgagaggtgttgccacccccagccccaacagagtactagaaatattttttttaactctctccactcttttgggtgactttaagaagaatcatgaccaaaatccttgcccccactcattatacctaacaataaacatttcctgagtgcttaatatacactgaggacttgaggagggtctaaagaaaactctagataggctgcacctttgtgaattttgccagtaattagaatgattattgtttgtgggtcagcacttgcgaatttttgcaaaattctctctgcctttgagttacaggagaatgtgaacctaagtagtgggagataggacagcctttgagtatcacattgtgcaattgtgttacctggaatcttgtcaaaggaga

SEQ ID NO: 16465 - DNA, 14551 bp, Human; identical to SEQ ID NO: 12313

SEQ ID NO: 16466 - DNA, 78157 bp, Human
tattcatacaaacatcaataacaacatccacttcagctggacattatttttatctcctttttaccagtgtgaaagaggctaagtacttgaccagagtcacccaactagcaagaggtgaagtcaagatttcatccagatgtgtgggattctgcagatcaggttcttgactgccattttatacccttgctcctcctgggacaaatgaaggcagctgaaagatgacagcacggtcacacggcaaggagacaaaggacccatgtgccgccttgacagctctatgtctttatggttccttgtgtctatgtctactctggcccttaccacattgacttttttaaagtctttaagagagatgcactttattcacctttttattcttctaaggccatggacattgtctaaaatatagttgatgttcaatacaaaccctagttagaaaataaattattacagatatatagaaaaacattatattagaaaaatacagaccactcttaatccatcctatgtctattatctattcacagatatcttgatgtgatggtgatggtcacgataactgccttccatcttagtgcatgcttatctctcagtcctagaatgatattctttcagcttggatgttacttcctcagggaagcctcttatgcatccccagaactgggtcagatttccctcttagtggactctcagaaattacatacaattcacttctatgtaatttcctgttgacttgctgtcttctccaccagaatgaaagctttccaagtcttgattaacactgtacttccagcacctggcaccatacctgaagcaccatggtgtttctttttttttgccattaacattatatatatatatatacatataattatatatatatatatacatatacacaagataatagcataaaaaagttttaaagagttatacataccaaaatattatacgtaccaaaaaacgtcactacggatttttccatttttttctgaattttttttttaagttctgggatacatgagcagagtgtgcaggtttgttatgggtagggagagcattaggtgtttctcaaaacaccaaacagcatgttgcccagtgtgaaagaatccaaatggcaaaaatcaaaatttaacagaattatttaaatacccactctgacttcctgacgtgaatcgcttctcaaggctaaagccatcatattttcagaactctctagcctcttgtctttcaaggaaatcacaacttcttctctctgccaccagataccaggcatatgtatttcaatcaatatatatttgccaagacattcctgtagcaaattttggattctaggacattaagtaaaaatgttatggcctattatctaggaagagcatgatggggctataatttactcctcagcttgccttctactcagatcaaaagttgtggtttccccctggactgatgagtcaggatattttcatatatatcagacaaggtgagagttgtcttgtgattgagatgtttcatcaggtctacagacggcctgctggaggtgttccagtagaggtatcagcggtcagaggaggccttttctgtgttgaatgagaaattcttcatctctggggatattcagggacatccttagattatgtggatttcaataggcctgcaatctcacctcatctctagtagcagagagaataggttgtgatttccttgaaagacagagcctagagagttctgaaactagagtagctttagccttgagaagtgattcaccccaggatgtcacagcagtacttaattctattaaattttgatttttgtggtctggattctctcacactggtccacattgctgtttggtgttttcagaaagattcctctacttccccctttcacttcattatctcaatcagctttatgcagagaagaagcttactgagctcactgctggtgctggtgtaggcaagtgctgctttggcaatctgggctgacctggcttgtctcctcagaactccttctccaaccctggagcaggcttccatgctgctgtgggcgtccttgctggcctttggtaagtgatggggaggagacctttgcttgctgcaaagctgagcctcaccatgagcaaaagccctcttttctgctgctgcaatcatggatttttactcccattttagaacagcagaaaatgaacaaaaaggaaagataatgatttactggtagaaggggaaaatgataataattgatttccaaagatgtatttctcatctatttttgctatgaattgcctatggaaaatcattttacccccaaatggacttattttgtttatgcaaaaagaaacctatggctaggttcagtccctacgtcacagagcatgaggacccagaggaaaagatggactgagttctttgtgaaggataaagtcctgattgtgaactcaggtagaaaggatcacctgctgagaatagttatttccttctctgtattctaaggtcaaacctgttctgatgtttgcaaagagcatgagaagagaagagataagatgatttccctttgatttttttcttcctgcttttgtaccacttgtcagtgtttgtccaaatgaggcacagatttcctagttgctcaaactagggaattaaagaacagtcagtcttttgttcattaaatatttattaagcgtatttgtctagttcccacctgatccccagaccccaactaagggaagacctattagtgtgattggcacatgataggaactaaggagtgagtggatgggtatacttggcatgccacactgctgggcaccacagaggatgcagagacctgaaggacacagattctgccctcaagaggtgacattctcaatagaacctcaacgtacacatgcaagaacatctgactcgacaatatgagaaaaatattacacaaatagttacaggataatgtgtgaggatgtcagttaatttgtgctaagccctggctacatcccacttttctaagggcaccccatgtataaatgtatccaattctctaacatttgatcaggtggaacttttataactcccatttacaaatgaggaaatgaaggcacaaagatgttggtcttgtccctgaggtttatgcagctagtacagtggcagagtcaggattcgaacccataatctaactttggaaactaggcttttaactactaccctctactgtctgtctcattttgagttccaaattagctatgataataagtgttctgagtcaagagaagaggaatcagcagcagccccatactaaaaaattaatgacagcagccattaattgaaaccttactgatctaactcattacagtattactatgaggtcgctttcatgagcctcatttttcaaatgagaaaactgagacttgaaagttcatgtggtttgccctgggtcatacagctaaaattcaaaccagactgtctgagtccacagcctgagcgtctggccactgtgtttccccgcttccctgggatggatggaatggaacgtgtttctcttcctcttggttggaagtagcatatgagcgtatgggctctcagggtgaatagttcgggactcttcgcctacgctgatggctggctctttactctctttcagctccagtctgtggacaatctggtaagtccttattttctttgctcctttatgtctctagataccctaataactatattttatctcaaatacttacaagagtccctgttgtccatttcatctttttcctgagtgctgcagggatgtagagacatcagctcgtgtggtgaccctgaccctaagaaccaggctatttgggggtgactctcttaaaccaaaactgccattgtgctggctaaacatggcagggcctgggatatgtgtcacagcgtccacaggaagaggagctgtcaccccgcctgatgtgggattctagccaagcctgatggaatgcatagcatcccaagaggaaaagggtagaaataagccaatacttcagagggggaggctggggctccagcagcttttccactaaccatgtgtaacaaatttatccccaacttctgcatcccatggagacacacttctctgttaatagctcaaattatgatgactctgagtctccatctatcctactggtcagcaaaaagtcccatcctctataggcagctgcctcacaggtgttttggccattcctatagagcaccctaggagctgctggagccagcaagggccttggcccccttgaggtgcactgtctcttgcagctcctaactctgctgttcttcccctcctcggtgccttggacacagactatttcccacacacccttcctgagacaagattataacttggcagactttgctaatggttctagaatggggaaatgaaatacaaaaagtgccttgaattaactgcagctagggatgtggttaacctcagagcccatcaactcagtctcaaacacacgaaggccatgaaaagttatgtcccttcctggccatagggccacctgcacatagcaggggcagcttcctcagagcaaagaagagtctagttgcatacatcaaaggaaatcaactctccttccctccagtagaagacctattgcctaagtcccaatggccctgcatccaggtgcttcccaggaatatagctggtagggttttctattctcttcagcagaaacacagccccattcccactgatgacatagagtattctgtccaaacctttaaagacagaattttctttttaaaaagtgtctgcagaggctgggcacagtggctcatgcctgtaatcccagcacttcgggaggctgaggtgggtggatcacttgacgtcaggagctcaagaccagcctggacaacatggtgaaacctcatctctactgaaaatacaaaaaattagccggttgtggtggcacatgcctgtaatcccagttactcaggaggctggggcaggagaatcacttgaacccaggaggtggaggttgcaatgagctgagatcaggccactgcagtccagcctgggcaagagtaagactctatctgaaaaataaaataaaataaattctgcagagacacagagatgtttcaccttaccaaacagaacatttagcttcttcatgtaaaacatgcagttgggttattttacaattttctttttcccctcaaacagagaaagggcattttcttcacatttagatgtaactaaaagatctatttgggaagttcttctgggcaaaggcaagaatgtttaaagttttaagctttaaaaaagtaattgcctgaaaatctttaaatgtagacagtcctcatctgagtaaaaaaggttccaaggagaaaataatttattctattaaaaatttcatagtaaatagcaatccccaaaattgagattttatttttgaaaattaatacaaatgaaaacaatttgttttattttctacttcacagaagttacattaccacaggcaatttgtagggcaaagcatgaatctaatattgacttttcaaaatgtggtagctgccacagctccaggcatcatgactttgttcaaggcagaaaatggggagaagtagggagacaggtggagaagggaagtgaagctgtcaaagagcacccagtgtgcatctcttctttcaaataaaggaagaagattttcccagaatccctattccctagtccatccctagcattatttctctgacatccctttattcagacctggatcatgtaggtgggaaagttaatacttcattttttcaaacacattagtgggcagaaggttagagagaagagcattgggactgacttttgagagccaaacaagtgttttccctattatagatttctccttcataatcgttaataggtcttgctctgccatactctttagtgattttatgactcatcagagcagtggttccacataacttttaccgagtttataaattactgcatcttcaacagaatctaaaatagcaatcaattttcatttgtacacccattgaaagattagcctaccaaagcacttatcttggagaaggctagatagtagtattatattggtaaggacgtttgagtgaatgtttctaatagtgaataatttgtgttgtagttacttttgttgttagccggcacaaagtcagaactacaaaactcagaaaataaacattcagattaaaaagagcctcggaaacagtttcttcttagaagatatataattaaaaacaaaatctcctcccagctcagaaatcttctctacaacggtagtagagaaagtaggtattattgaacaacaataagccagaatatgatgagcatcacagacaacccactaagaagctgcaaagtcagaaaggaattccaccccctcatacagccaattagatacagcccatgcatacatgttttcaagataaacaataactaggcctcaagtaagagggcctgacagcaacttttcttctactagttcatcttaactttatcctggtaactggcgagacaacctgtcttaagtaactgaagggaaacaaacttctgtctttacaacagcaggtagtttagcacattggagaaagctgagcccaccaaagttaggtccttactctcccacaggaactgagagagacggaggaactatctctctagatgtttgtattcaaaaaggtggttcccaggacttccctgggttgtgagccaggcaatagtcttatttttttattattattatactataagttctaagatacatgtgcacaacatgcaggtttgttacctatgcatacatgtgccatgttggtttgctgcacccatcaacttgtcatttacattaggtatttctcctaatgctatctgtcccccagccctccaacccctgacaggtcccagtgtgtgatgctccctgccctgtgtccatgtgttctcattgttcaattcccacctacaagtgagaacatgcggtgtttggttttctgtccttgtgataggttgccgagaatgatggtttccagcttcatccatgtccctacaaaggacatgaactcatcattttttatggctgcatagtattccatggtgtatatgtgccacattttcttaatccagtctatcattgatggacattttggttggttctaaatctttgctatcgtgaacagtgccacaataaacatatgtgtacatgtgtctttatagtagcatgatttataatcctttgggtatatacccagtaatgggatggcttggtcaaatggtatttctagttctagatccttgaggaattgtcatactgtcttccacaatggttgaactaatttacactcccaccaacagtgtaaaagcctttccatttcttcacatcctcaccagcatctgttgtttcctgactttttaatgatcgccattctaactggcatgagatggtatctcattgtggttttgatttgcatttctctgatggccagtgatgatgagcattttttcatgtgtctgttggctacataaatgtcttcttttgagacgtgtctgttcatatcctttgcccactttttgatgggtttttttttcttgtaaatttaagttctttgtagattctggatattagcctttgtcagatgggtagattgcaaaatttttctcccattctgtaggttgcctgtttgctctgatgataatttcttttgctgtgcagaagctctttagtttaattagatcccatttgtctattttggcttttgttgacattgcttttggtgttttagtcatgaagtctttgcccatgcctatgtcctgaatggtattgcctaggttttcttctagagtttttatggtttttaggtcttccatttaagtctttaatccatcttgagttaatttttgtataaggtgtaaggaagggatccagtttcagctttctacatatggctagccagttttcccagcaccatttattaaatagggaatcgtttccccatttcatgtttttgtcaggtttgctgaagatcagatggttgtagatgtgtggtgttaggtctgagacctctgttccattccattggtctatatatctattttggtaccagtaccatgctgttttggttatttaaccagtgtaaacatttacatgcatttgaaaaggacagagaaagaaattctgaaagaggaagagaagtcacttacttttggcagggagaattaagcctcttatttttaatttgcattatccttgaattcttcagtttctatccacaaatgcttcaaagattttagggcctactttcatgtagggttagtattttactgtcacaagagagtgcctttgaggtctgggaagttaggagcacctacctccccacactcttattgtctgcaactatctggatatatttcttatgacaaacagagcctgcttacctctcccatatatatttattgtcagtaaaaatataacttaaatccctttccataactgtctaattgacctcccaatttctatattcactccatctacaacccctgtcccaccacatgctcatgctacatgtatgggagggaaaaaatttccctctatctatgttaggtttaaagaaaaccaaaatatttcaccccaaaatatggccacctggtataactagtattttgaattaaaggcctttaaagatcaacagaagaaacttttccctatccacctaaagaccaaaccaacccaccagtaagaacagttgttcttcccttctctctactttaggaaagaagactgacgggtgtaaccacacctgaacagaccctatcacaacaaaatatctatccttcaggcgcattcatcttccaaatagaaccatttatccattaattcaccatagtcattatttattgcccttcaaaagagttacctacattccccctctccccactcccctctaaaaatggctgtgtaagtatctgggccttattggtatatttggggaaccactctgtaattcttccttgtacatgttaataaatttgtaggccatttctcctatgaatctgcttttcatcagttgacttttcagcaaaccttaagagggcaaggaaaaaggttctcttgattcctacaggttaattttctggggcccataaattaacctgataaaagatagattagacggggcatggtggctcacgcctgcaattccagcactttgggaggctgaagcaggtggatcacgaggtcaggagatagagaccatcctggctaagaagatgaaaccctgtctctactaaaaatacaaaaaattagctgggtgtggtggcacttgcctgtagtcccagctgttcaggaggctgaggcaggagaatcgcttgaatctgggaggcagaggttgcagtgagccgagatcatgccactgtactccagcctgggtgacagagtgagactctgtctaaaaaaaaaaaaaaaaaagacagactaacaagtgaaaaaaggttttaattatgtacatacacaggggaatttacaaagaaaaaaaatggctcaaggaggcagccagatgattgagatttacacaggttgaatatccctcatccaaatatctgaaatccaaaatctgaaagtttttaagcactgacatgatgatcaaaagaaatgctcattggagcatttcatatttcagatttttggtttatgcgtatgttccaaactctgaaaaaaaactcaaactctaaaacccttctgttccaaagtgttttgaataaagtgtactcaacctgtataccatcttggattaaacaaagggaaaggagttttgggcttctgggttggggaggcaagctctggtgggtggactaggaaaaacatggtaaacaagggtttttatgcatatttaagtcaatgccttctctattgatgaaagttgtcaagagtcttcctcttcctggtatgggagaaggagacatatttacaaaaggaaatttcctttataagggaaaacttccttttttacttataaaggaaaacttgtgccttgcttttagacttttcctatttctggtgattctcaatagcctttagctcaaaataatccatatgccaaagagacaaatctggagatggcatcttctggtacccttcacatacaagaactcatcttagagaggtctctgtaacaacaagatcccaggtgagagtctaggagaaatgcaatttccaactatctacctgaggacctggttcactgaaacaagtaagagggtttgtgagcctcccatcatctatcactgctgagtggatcctgccagggctgccccccctctgaaaggccagtctgctgctatagaccactgagcagccactgcaccctgcaggaggtgagcacagctcacctgcaacctgggtaaacagaagtcatccgggggcatcttagggatctcccaagccatgtcctccactgtaacccacacaagccactgcagctgggactgcaggcacctccacctcagacctattactctttcctcctcagcagctgcacacaaacctgtgatttccgtccatcctccatggaccacattcttcaaaggagagagagtgactctgacttgcaatggatttcagttctatgcaacagagaaaacaacatggtatcatcggcactactggggagaaaagttgaccctgaccccaggaaacaccctcgaggttcgggaatctggactgtacagatgccaggcccggggctccccacgaagtaaccctgtgcgcttgctcttttcttcaggtgagaaagaaggtgaattagttgaaactttataaatggtatcagtttatcttagctccctggagattccacgaactggggtctttcattcctctctaaccctcgatcccagctcctttagtttcatattttccctccaatgtctacaaatgtttttcaaactactactgaaacttgagtttaaatggttaatattaatcgacatccccacacacttacacagtcaagaaaatgagttagttttagggagtacaaaaatgaagctgtctcagatcctgccctgcagggctttatagcctcataagggagaaattacacacatgtaaatgtgctgaggacaaaagtgccatcgaaggagctcagaggtgggaaatctccaacctgatgctttttatccccacccgttgttatgcgtcccttcctcattcctagttttccctctgattggcatcaagctcccacagctcctcctgtccagttttacctgatggataatgattttggtcacttccaagggcacggactacaggagtaggcattcaacacagtcatctaagaaagaagagatatagctaacctcaaattagaattattagaatatgaacagcatggaattcccataaaggaccacatccactgtcccttcaacctagactgtgtctctgacaagaatcctgctacaaatcacactccaatgtccaggaagagatcctcatgtagttctctaagtgccacttctttcatagctcctgctctgagactcggtgagcaggttggtgttaagttctgctgtactctatcatgtcagagattttgatcacaccttctctcagcttttattctccgtattagactccttatctttggaatctgactttgaatgataaaatagttgagtctgggatttatttaggaattgtacctgaagcatgttacactgatttaggaggagtttcgtgagcttggatcaggaaactacatcctgtggaagaaagaagaaaacaataaagcctttgtaattcaagagaagaaggaggtagcaggaatgctttgaatgacgatctcctctctgtgtcttttccagactccttaatcctgcaggcaccatattctgtgtttgaaggtgacacattggttctgagatgccacagaagaaggaaagagaaattgactgctgtgaaatatacttggaatggaaacattctttccatttctaataaaagctgggatcttcttatcccacaagcaagttcaaataacaatggcaattatcgatgcattggatatggagacgagaatgatgtatttagatcaaatttcaaaataattaaaattcaaggtgaatctttcagttcatatagatttgcttagtaatgacagggataggaaactgagcatgtaaggaaagaatttacgggttactattgaaactctggatagatgagaggcacaaatcctctaagaggcagagaaagtggggtgattggacctgaataatcctgtagaagaaaactgtgatagagggcttgataagtttgtcttgctgtgtgtctgaagtttcctgggactgagcatccaaacctgtctctcacagagtcctaaatactctcgtgctcagaacttgacttacctcttctctctagaactatttccacatccagagctgaaagctacagactctcagcctacagaggggaattctgtaaacctgagctgtgaaacacagcttcctccagagcggtcagacaccccacttcacttcaacttcttcagagatggcgaggtcatcctgtcagactggagcacgtacccggaactccagctcccaaccgtctggagagaaaactcaggatcctattggtgtggtgctgaaacagtgaggggtaacatccacaagcacagtccctcgctacagatccatgtgcagcgtgagtgttggagagccaggcatcttccctgcctctctctgccccttgggctctgtaggcatggggactatgtagcagagatgggttttatcatcctgacagaggcaccaggcttaggccaagaagtgcagtactataataaaagaaatacatgacttcttttctacctccattttcctaaaaactcagtcttcctttgaaattctatcacttcagaatcacagctgactcatggagttaggtttgagagctatggaaaacaaaacaaaacaagaaaatgaggtgccctgctagggatttggcagattctagaatggctagatcttaaggataactatttagaagacaagcatccaccttttcctggtcagtagcaatgaacagtgtgagtgcctatgatgtgtacagcagaaaagaaggagagatagatagatagataggcccaataaatatcacttaggtacaaaattatgacttttgaaaacagatgtggtccagcctagtgccatgatggctgctattgctattacctgtccctcaaaacaactcagacctccagccaggatgtcagacaaaacccaaatgcttcttcagggttagtccttttttctttcctggggcctcgtatatcaggatggaaagcttatcacatttagtgatattctcagcgctaaatctgtggtctattggccacaatgctagtgcctgctgaagagtatatcttgaagtcacataaaaagtaaccctgcccaacaccccagctacctagccctgccctccttcacacccgacccccacctgtggtctcattttcacatagggatccctgtgtctggggtgctcctggagacccagccctcagggggccaggctgttgaaggggagatgctggtccttgtctgctccgtggctgaaggcacaggggataccacattctcctggcaccgagaggacatgcaggagagtctggggaggaaaactcagcgttccctgagagcagagctggagctccctgccatcagacagagccatgcagggggatactactgtacagcagacaacagctacggccctgtccagagcatggtgctgaatgtcactgtgagaggtgagttttaatctctattgaccttatttattctcagcaaacttcctcaaattaagggtggggatagctaacattaccctgtgactctgctgtttctgtttccattttgccatgctccactgtgataaacaatttcttccattagaatagtaataactcactcaggtcagagtaaggtcctgtagtgaggtaatggtggctgggagccattttgctttttggaggtgattttgtttgtctgtgtttgggtccattgtgtgtttatctccaagaggagccttacttcattagcagtgtttctgggtggggcacagctctgtcaccctaccgtgtcatcctacagtatcaactacacctctcctttcagtaaatcattcacacacaccacacacatcagacctgcagcctcaagtccacagaaccaaaagcacaaggcattcctttacttcattactataatagaatcctgagggattctcagcagccaaattgtatgtgggtcaggaaactcacaagaagcagggagagcagatacagagcccacttttgtccattgaggagagaagccttactttgggatatcacaggtttagctcatatacatctcttcctccatcgctgagaagccacactgggccaagctatgttctcactcagctaccttggcactaaggaagtggtctttactgggcttcaattcctcctcaatctcaggtttagttgtattcctgtctctctgaaaaaggaaagaaagaaagaaaaaagaaagaaagaaagaaagaaagaaagaaagaaagaaagaaagaaagaaagaaagagagagagaaagaaagagagaaggaaggaaggaaaggaggaaagagaaagaaagaaagagggaaaggaaggaaaggaaggaaagaaaggaaagaaaggaaaggaaagaaaggaaagaggaaagaaaggaagaatctagcttttattaagttactggaaagctagatttccctgcttttctatacaataaaactcctcaattcactctccttacctccctgattttttcttaaacccatcaccaccaggcttgcctcactccaccaaaattactaatgatctccatatttctaaggccagtggaaaactgttcccatttgatttgacctacctccagcttttgatacaattgatccctccctccttcttgaaacattttcctgctcaatttctgggacataacctgttagtattctatctattcagcagatacttttttaaagttttctttccagatccttataatatttccaacttctaaattttggggactgctccccaaaaacagctgcactgtttatacaaagtcagctctgacggtcaaagccataaacctgaacagtttagtcagaggctccagcaaggggttgctatgcgaatggcccagatgcggctcaactttcccttcaactcccttgaggcaagtcttatgatcaagcagggcccaccaggttaagagactgaggtgtttccccagaactaagtaccacagcaatctgcatctcagtctgggaacatcactgggtgtaattcccagcagagaaggactgagactgagctaatgtcatttcaatgacttttttttttttttaagatggggtctctctctgttgtccagagtggagttcagtggcgtgatcttggctcactgcagccttgaccttctgggttcaagcgatcctcccacctcagcctctcaaatagctgggactacaggcatgtgccaccatggccagctattttttttttaatttatttttcatagagaaaggttctcactacgttgcccagtctggtcttgaattccagggctcaatggcatttcaagaatcagattaggggagaggaagaagggattagcaaaactgcaagctgccaagggctccctcgaaagactcctgaatgccctgaaatccagagtaacactgatggtagagggtgtttcttctgcaggaaggctcttattctgaaaagtttacctcaggaagttcaaagattataatctctgaggagataacagtgaatctgttggtaagtataaattattcctcttccttttgggggttaagatcatcagaatggatcagcttctcctgatccaggcagtgaactggccacttcacatgtatcatttcattttattctcatgacagccctggaaagcaggtgtcaacatctgttaaggaaacagatgatctcaaagattaaacaaacgtcaaggatccagtgatgtttgctggaatagggattccctcctaaatattttttaatcatggactttatgcaaaatccccgtgcttagaaataggagaatatatagcaaagagagaaactctgcagtagcctcatgcactgggctaaggtgggctgtctcaggcagcttgaactgccataaccaaacaccagggactggggagcttaaaaaacagaaatctatttcctcatagttctggaggctggaagtctgggattagtgcactaatataatttggattcttgtgagggctctctttctggcttacagaaggctacctgcttgctgtgtccttacatggcagagagagagagcagcacaacctttctggtgtttcttcttagaagggcactaatcctatctttggggccccaccctcatgatttcatctaaatctgattacctctcaaaggccctgtctccaaataccatcacattggggttagagcttcagcgtatgaatctgggggagaagggcacaaatcaatccatagcatggactgaggatgtctggggtagggctgtgtgggagcaggcttaacctatggaggtgtcctctaagctaatcagagagcagcctgaatttcctgagagtctagggcatggtgtcaggaccacaaaatatgaactagtatttccctagacataacacttaagtggcaggcactgttcaaagcactttacatgtattaactcatttacaacagtaaataggaaactgaggcaaagggagattaaataattttccctgcccacacagtgagtaagttgaggagctgggattctaatccaacaacctggatttagaatctgtgcctttctaactgagacaaaatttcaattactttccccaaagtagccatttcttttaggaaatagggttaccaggaaggtagagtaacttgctttctgccctttgagtctagaatcctaggcctgggtgtggctgattctgattttgcaccggcggatgccccagcaggcaatggggaaagattcaatacaggatgtagtggccaagcctctctgtccttagatttctgtcctgctctccaccgtactctttcagctgttgtggctgggaagctgggctggctgtccactgaatactgtttattagtggaaccactcataggtcaaagggcaggtttgttgatattgttgaggagggaaggataatatcagaaatgtcaccagccactcctagccaatggctcctctgtgcccaaaatcatagatgaaaataaacggaaatcatgatcagtgttgctgttgttctactacctgcatgttctctgtcaattctgtggtacctgtgtctgaggtctgaatttggtttacctggggaccaagaatacatatgggaaagtaccacgccccactctccactctctgtccctctctcatgctttttgctctttagcgcatcactacagggcacggtataaatttatttatttgtttatggcttgtctcccctccctgggttataaactcaagagccgggactttaacgtcttgttcactcttgggtcttcaagggttaggtcaatgcccagcacagggcagcctcagtaaatatttgttgtataaataagtaaattgaatgaaacctccttttccgtggatgaaaggataggagaacggaccccatggaaatatcaaaagcccctaacaatttattgattatgtgtacttttccatccgtttttttctctcctgcccttcagagcacacaggcacaggcttctatgaggaaggaggctgatgccatttcatcgtggtgtcccaatgcggagcaatctcagagttactgttggttcaactggtgccataatcagtggtgcaattttcattctctctcaggcagtttgctgttcctaagttaggtgctgccaagccatgatcccacagtatctctccaggtgtctgggggcaatttgcaggaagccagcttaccagaatacaacattaggatttcccctaaattgttagtttctaaaatgattcactgaaggtagagggagctgctgtttcctcttgcactcaggccctggcccacccaatgtgagcttttctggccaaaacctggcccaagatgtctttatgagacctagtcctttagatttttctctcttccagggctcgttacccaaccaagctgaggaaaaggcaatcccaaaccctgaacctctccactgagattcacacaggtcctttccccttagagaccccaggcaacagagatggccttgtcgccgcgggagccactggagggctgctcagtgctcttctcctggctgtggccctgctgtttcactgctggcgtcggaggaagtcaggtttgtgctcttttctttgccacagttcctgccctgttccttcccctgaactcagcatgcagacagccttagtggccaccaggccaccactcccaagtctccactcccaagtctccactcccagcgttcacacacactcacgtccgtcccttccttaaggggcagttttgcaaacagaagccatgaatgagagctgctcatatctagtctgattggctaagtctcagtgaaggggaggaagagtgaaatttttaatgtaaagttccaaaaactttatctgaacagtttacttaggcagtttctttggttcatatagactggccagttagatacttcagcctatcctaaatccaccataaatggagattcaaaatgaactaaaggctctgcagaaatgattgagaataagagctggctaattttatccttctgtcccctcaggggcttttctgggtctggcttttcaggggcttttctgagcaggcttgagcctgccatctggtgctccagtggcccctctctcctcaggtcagcctcccctgcctcttggagatggtctgtcccaggcactgtttgctgcgtgcttccaaagacttcttgcctcagcccacctcaggctggctttagatgccaagaaacctggtgtagaagacaggagcagaacctttttcagctctagaataattacccacatccttcaactctgtctcttaattcaattcaactttccagattcctgacagcaccttctgtgtgtcctgcattgaactggaggtagggagctttggacctctgaccaattctccttagtggggctgagtcagagcccagtgctcctctgggcatggccacagatgttcctcgaagttcacccacagctcactactctccaagtgacactttggttatatgtaatgtttcctgagggatttcaacacagacttgagtcttaataaattctcaaacaattacatacttaactcaggagtgtgcagtcctggcctcaaaaagttatatgctttgtacaatctttttttcacctcattttcatgaaaacccaggactgggcaggtgtttgaattgactgtcttgattacctctcttagatagctcctgttacatgaagtcattgagaaagagctccctctgctgacaaaaatgcgtctttgctttattttgcaggagttggtttcttgggagacgaaaccaggtgagacctcagtttctgccattcctttttagtttcccgagtacacaatatgcaaaactgtggggttatgaaattaggtcaagttatacctctttggccctgtggctagatacttccattttcacactccatgaatttgtcaaaaatgaagcttcctagaactttgcttgtcagctaatagtttgcaatacatgcaaaataatagatttcttatttgatcttaacctactcatctaaatggataataccaaaggttataaagtacagaatatttcttgtactataattaagttagacaatgtgttactataattatgcatacaatgactagagtctagattttctacaaatgttctaggttttccagagaactctatgtttctaataatcttctttttgcaccatacacgcatatatactcattaaacgttatgtgcttaacttccatttggaaaatactgtcatcttcctccttctatgtcagtgtctcagtcttaggtaaggaataagagtgtggattatgtctaattccttcttggattgtacagacattacaatgtaaagacattttttatgtatgtatgtatgtatgtatgtatgtatgtatgtatttattgtcacccaggctggagtgcagtggcacgatcttagctcacggcaacctccgcctcccaggttcaagtgagtcttgtgcctcagcttccaaagtagctgggattacaggcgtgagccaccacatctagctaatttttgtatttttagtagagaccaggtttcaccatgttggctgggctggtctcaaactcctggcttcaagtgatctgcccgcctcggcctcccaaagtgctgggattacaggtgtgagccactgcaccaggccaacagtaaagtaaagacatttaatcactacttcctgatgatgaagaagccattaagtatatatttgagacaggatctggctctgtcacccaggctggagtgcaatggcatcatctcagtttcctgcagtcttgacctgccaggcttaagcaatcctcccacctcagcctcccaagtatctaggactacaggtgcatgtcaccatgcctggccaactttattttattctgtgtagagacaaggtctcactatgttgcccaggctggaaagccagtattttttaaccaaacaagagtaatcattctgactatgagacgatgattgttacgatgatgtcagagactccctaaccttgtttccaggcagcctgtccataccacagctccagggtttttttaaaaagaacagtctcactctatatagacctattgaaactctgattaaaccattcaggctttccagttccctactggctgctgactttctccaaatcctctttctcctctgccgctctccctgggtatctcactctcccgcatgttacagtgttccagggtttattatgtgtttctgtgtctcacaggctccctcccgctccaggcccaggagagtcctcccattccatctgccctgcccaggtggagcttcagtcgttgtatgttgatggtgaggattcccttctaggaagctgttcctggcctcagccatggaaagataatgcgctttcagccctgggaaatgcccctggactccctaaagtgtcccaaatccagatattcccagataattgttccattatgtgtccaagaagagtggagatgatgcttaggaagaggcatctgtagcactttaatactaacaggaacagccttgaaaatgtcttttctttccagtacaccccaaaaagggagatttggtatactctgagatccagactactcagctgggagaagaagaggaaggtacgtctttgggaagagattctggctgcaaactatattcattcattcaacaaatatttactgagcacctcctatgtgctaggtattcttgtaagtatgggaagtcaatcagtaaacaaggcagacaaaaatccctgcagtggagagcttagattctaaggagggaagataggcactgaaatacacacagtatacttttgctgatgatcaggatgaaaattaagcatccttctgatagatattgtgatcattatagtgtatgtactaaggtctcccttaggtctgaatgaataaatgtttgtaaaatgtctactatgtggtaagcattgtgctgagaatatatatacatatatatatgtatacatacacatatatgtatatgcatggcattttaattaagtgctagaaaatgtgatttttacagtattatattcctctaattactgtcagattttaaattttatattggagcaaggtaagttatttggaatgagttggatccttttgaggcttgcttttatttaagctttgttagggtaagtctcgagcaacctttagagtagggttaatctagcctgatagtaaagcaatgcatttctggggactctacatcagatggtccattaattacaaaatctgcatcagcttctggtattattctgcctgttcttttctggtagttcttaccccggcctaagatactttcatcttacaaatatgcctatcagtattcagcctaagacctgaggagaactctctgcagacttctggagctttcgatctgttttcctcctgtctctctggtactgtcctacaaattctagctgcttcagtaaaacagaactgttggtctctgtcacttcaagtcagcaaggcctcaagccagaagccaggctctttctaaactcccaagtccatgcacagcttagtggtaaactggtgcaatatctgaaaaccactgttttgtccttttttctcattgtttaaaatgggaagataaatccagtccctgttagtccgttttggccacaataagctgaattgtttcttgaagttctacttcacttctttaatcctattcagaccccatttcaagacccactaacaaattgagatcttttgttagaaaaatacctctctaggtaactgcaacctatggtccactttggctttctgaggtgggagctctatatcccagtatcagggaaatcacttcaaaatcacttcagaagttcaagaggaatttctgagatctccttcaccaggctgggggctataacctgctactctcacctcagaaagctaaagcagagacacattggacataaactgatccatctttctaaagacatcgcttcaaccaatcttcttatttttttcctccccacacttccttgctttggttgattaacctgggttcttagagtcaaggaaacaagcaattctctctatttcttgtataaatccacccatggcacctcacttgggaagttaaaatctaagaattttagttgtaacctgatgctgaaggtgttctatgaaaatgaagtattacacataagactcagagaaggactttctcaaggtcacaaagccagtaaaggacaaagctaagaccaagtcttctgtcttgctatattttctgcatgcacagcctattactatatttgaccaacatatatcacctgatcacttgttttgtctttcactttgttccctgagccacctccattaatcaggatcccctttgaatggcagcattagaatggccactacctttcttgggttgattgagtacatcttatcttataaagctgtcttgataattttgcttttcttcatactctttccttgacatatttatcaaaacaccatttaagccaagcattctgttgatggactagttacatttcagactcttgaattattaatgatttgtagaatggtttcttcacctgttccttaaggtttacatgaagcccctgaaatcatatgcaaagttttgtacatatgaccattattctggggagagtacatagcttccatcatattattaaaaatatctgtaacccctaaaggtttggggtaagaatatggtaacaatacagtaagaaacagagagaaacctcaagtgccccagagtgtatctgtttttcaggctctctctctccataaaattgctctgctgctctgataattctaccttttactctgagactcttaatttctaatatgcatggttcaccaaatcacatctgctaaacttacctctcactctggctccaactctaggaaatcatggcaataaaaatcaagaactagaacttgttaatgtaggagagagtttttctcacagggcatgcatatggagtactctaatgggaacttgccaaacaatcgggggtggtgagatgacagtattgtaagttaagagaagcaagaactaaaactaagaaaaaaattatctctcaatatctggtagaggaagggtgtgaggtttcttagtgtggtattgatggaggactttacggatcaatggagcttgaaaagaacttgcagagggctgggttaagaaatggtagaacagaaagtcatatgtattgcaggacatgttaggggatgaggtggaggggatgaggtggacagggcccagtggctctcagactctagggcatcagctaacagactgagttctaagtgcatcattatgcccatagtccagtgattctctttctgtccacagctaatacctccaggacacttctagaggataaggtgagtttcatttccccacagttttatctccaccattacctgcagcctcacactccctctcggtttccacttctttcttccatttcaggatgtctcagttgtctactctgaggtaaagacacaacacccagataactcagctggaaagatcagctctaaggatgaagaaagttaagagaatgaaaagttacgagaacgtcctactcatgtgatttctcccttgtccaaagtcccaggcccagtgcagtccttgcggcacctggaatgatcaactcattccagctttctaattcttctcatgcatatgcattcactcccaggaatactcattcgtctactctgatgttgggatggaatggcctctgaaagacttcactaaaatgaccaggatccacagttaagagaagaccctgtagtatttgctgtgggcctgacctaatgcattccctagggtctgctttagagaagggggataaagagagagaaggactgttatgaaaaacagaagcacaaattttggtgaattgggatttgcagagatgaaaaagactgggtgacctggatctctgcttaatacatctacaaccattgtctcactggagactcacttgcatcagtttgtttaactgtgagtggctgcacaggcactgtgcaaacaatgaaaagccccttcacttctgcctgcacagcttacactgtcaggattcagttgcagattaaagaacccatctggaatggtttacagagagaggaatttaaaagaggacatcagaagagctggagatgcaagctctaggctgcgcttccaaaagcaaatgataattatgttaatgtcattagtgacaaagatttgcaacattagagaaaagagacacaaatataaaattaaaaacttaagtaccaactctccaaaactaaatttgaacttaaaatattagtataaactcataataaactctgcctttaaaaaaagataaatatttcctacgtctgttcactgaaataattaccaaccccttagcaataagcactccttgcagagaggttttattctctaaataccattcccttctcaaaggaaataaggttgcttttcttgtaggaactgtgtctttgagttactaattagtttatatgagaataattcttgcaataaatgaagaaggaataaaagaaataggaagccacaaatttgtatggatatttcatgatacacctactggttaaataattgacaaaaaccagcagccaaatattagaggtctcctgatggaagtgtacaataccacctacaaattatccatgccccaagtgttaaaactgaatccattcaagtctttctaactgaatacttgttttatagaaaatgcatggagaaaaggaatttgtttaaataacattatgggattgcaaccagcaaaacataaactgagaaaaagttctatagggcaaatcacctggcttctataacaaataaatgggaaaaaaatgaaataaaaagaagagagggaggaagaaagggagagagaagaaaagaaaaatgaagaaaagtaattagaatattttcaacataaagaaaagacgaatatttaaggtgacagatatcccaattacgctgatttgatctttacaaattatatgagtgtatgaatttgtcacatgtatcacccccaaaaaaagagaaaaagaaaaatagaagacatataaattaaatgagacgagacatatcgaccaaaaggaatatgtgggtcttgtttggatcctgactcaaattaagaaaaaataaaactacctacgaaatactaagaaaaatttgtatactaatattaagaaattgttgtgtgttttggatataagtgatagtttattgtagtgatgtttttataaaagcaaaaggatattcactttcagcgcttatactgaagtattagattaaagcttattaacgtaaattcggcgtacatgaaattagtagatgaaatgatgtgatttggtttgaaataacccgatgaggtgagggtgggtaggaagtgggtaggtatagatgtagcaggatcagtcatatgtgcaccatttctggagctgagtgaagggtacattatgggaagaagaggaggcttatactattctttacttttgcaagttttaattttccataataaagagttaaaatatctacacccagaagaccacctcgttataccactccattattctactcttgtctgaggtgctgctcacttccgttacagtggtggcttcgtgtctcccttctttttccctttcgtccccacagcccattctcagcactgcggtcactgtgctcaaaaccctgcagtgcctccccatctctcttacagtgaaagccagatgccctaagtgcccacaagcctccacctgatcgctcccattgcctccagtcttctgccattcttccccttagcacttcactgaggaagcgctgccttctgcactgcttcttgcacacatcaggtaaatgcctgtttgaggcctttgcatgggctgctctctgcttagaatgctcttcctccctgatatccaccaaggctttgaggtctgccctggtgactcaaggctttgaggcacatgtaaatctggaaactacttccccccatctttggcacctccagtctccattaccctgatttgctttctttccatagcgcttatcactttcaaacatactttgaaacaaacgttgccgatttactacacttactgcatatcatctctctaaaaactagatttcttaagggcaacaaactgtgttctctttgttcattgatataccccaagtacctagaactctgcctggtacatagtaggtgtttaatcgatatttttgaatgaatgaatcaactatttcagtaaggaaaatcattgccctctccatgatggaaaggatccaatgcaaataatccacaaccacagagtacacaggcccctgaggagctgactctccatcagaggctcaggtttggcctctgtgtatgtcaattgggcacttagcagtggtcagactggcctgggtgagtacatccttatgttactgaatccttccataaactctgcaccttccaccaaggccgcttcattaatgagccctttgagcaattgctggagtaactggagaaagaggctgcctgacattcagccagagcagatgatcacagcctcctgattcctgagatcttcctcagtaaggccttgggtgagtattctcataagacacaaatattctcatactctggattcattcaaagaggtccaacaatatgattcttgcctaatcttgcagttttattctctccaaattcctgaccatacagctccaaacactagccactgctcatgaatcagagtaaagcctcacctctggacatctcatcttccaggcaaagtggaccactgggaatacccatctttgtcacaatcctccagggattcctgaatgtggttgaggtgctgcaattgtcaccctcagctgatgtgagggcatatttaaaccaggatagactgttttttcctcctctgtcagttggtcatagggaactcaccaccaggtcatagttgctggttgaaacagagaggtaaaagagcagcagaatatgagctattcattgtttattcaacttaccattgctttcagaccattctggagtgagacctcctgcaaatcacttccacttaatgatggaataatcctcaatatattatgaatttttgctttgtggatcagacagcttccagttcatggggaacagctcaggtctctggtgggccatgttcaagtgtgcagtgaaaaagaaaagttacttgaagagaacatagttttgctccaaaattttatggttctcaactgtgattctcctgtagagccttgctgtagcctttacacaacattgtgaccagccatgacagttttgggctctttggatatgctggatcctaaaagctaaggtcagtgctgcttgcactgtagcttagacaagctaaagaccccttgcttgctcaggggtccactcaaggatgataggtttgtgagttatccagttattgagtcagaacaagcaaccaaatgtgacatctgttgcttccaagatccagaggcctgtcaaatgttgggcttcttccttaaaagaatagaagcaacaatttaatatactatcccaacatgttgcagacacccgattgcacaataaatccccaaaaaggaagaattagatttaatagaatttctttaattattaattttaacagcagaaatctgtatattttgctaagaatagtagaccaaggatagaggaatataattctgtttgaggctaaatgaattggtacagatacacttggaagagactctcgactcagtggactagatcaagcagctgggagtgattctaattagtttctctcttggtagatcaaaatctgtaggcaacaatggccttggaaaaataaagttgagataataacaagtccttggtataacgtaggggaagaattcaaagatttatagagatgggattgtggcagtggatatatcgatatatcacacatgttccattcacatgtaccctatatctcttaaaagggtatttccacagagcgttgaaaaatacattagtgataaaagtatcagcacctttggaaagtataacagaaataggtcaaggacaaaggtgaagacattgcctcacaagtaggctccctgataatgatggagtctcagagtagcagagacaaaagaaggcatggctacaataatgagaaaatggtaatgacaatactatgactgaaaacaactttgcggccaggagcggtggctcatgcctgtaatcccagcgctttgggaggccgaggtgggcggatcacaaggtcagcagatcgagacaatcctggctaacacggtgaaaccccgtctctactaaaaaatacaaaaaattgttgtagttccagctactggggaggctgaggcaggagaatggcgtgaacccgggaggcagagcttgtagtgagccaagatcgtgccactgcactccagcctgggtgacagagcgagactccttctcaaaaaaaaaaaaagaaaagaactttgggtcatgggaacaaaataggtgagcagaccatacgcacacaaatgaaagtaaactggaagcctgcttggaatcatagaagagaatcatattcacccatttttgtgccagttgctgtaccagtcagggttcagtggcagacaacagagtccaccctaactaatttatgaagaaaggaatttgtttagggtattagtggaaagactagagagtaaggctctaggctgagcctgtaggaacaacttccagaagcaaactgccaaattggcataacaagagggcagccactgtcaccacagctgactcaagatccatggggcctctgctgctactgcaaaagttctcaagtcagaaagctgcataactgccactcggtactacaagattagactgaccaaaggccatagctcagaagaagcaaaatatccacttgcatcacccagcttccaaaagagccacacagttatgacttcagtagattcaagctcacttctgagtcttctaggtggtctgtttagtggaaaagaggctatatgcaaagacccttgctttacccttctacttcctattgaacaagaagtcacaagaagtcactctagaaagagcttaaattgcaattaaacagttactcttcagtatctaccaccatgtttcttttagaatggtgtgtgtgtgtgtgtgtgtgtgtgtgtgtgtgtgtgtgtgtattcttttagtgtaattactaaaagctgcagacagagggagtgtatcaaaacagaatatagatttttaaattcaagagaatttagttcaagtccacaatgtcacacttattagtataagcccttagacaagttacttacattttcggggttttatttccttctgtgcaaaatgaagataacacctaccttgtacagctgctatgagcacatttcttcttccaagcttttgaacttgccattctctctggctgtaatgctcttcccctggcagccactgtctgcgacctcataaccttcagtgcctgttcaaatgctgtcttttttaggaggtcttctgttgccacatgtttagaatagcaacatgccccaacccttatcagcctccttcatcctactctacttcatgtttctccaatgcacttttcaccacctaatattctaatttttttctcacttctttatctgatcatttcacctattatttatgctttatgaagacaggaacttttatctgtcttgttcactaatgtatacccactgcatcctacagaaaccaatatatggtaagcacttaagtaacatttgtgaattatgaggattatataaagcaatgagtgtaagtgccggtgcctttctcatataagcacccaatacatgttaattattagtattggtatttactactgatatgtttctaggtcaaaaaacatttattgaacacttggtataccaaacacaatctttgatcagaaaaatgtgtctctcttgaccaacatacaggttagggggaaaagtgtctctctttgtgaaatttccccagtaacgtactggaagagatagatgcataaagacataacttccatataatatgaaagtaacattagaactaataggcactaagtctgtgtgttagggaaggtaacactagcagttttaactgacgatcctagaaatcttaggagctctctaaaacaaaacatcccatcacttgttcccagggtgaagggcaaggctctgctgctccacatggtcattcaggatcctaggctccttacatctcatcgtaccaccatattcagggcttccaaattctctgcaaaaagagggagtgtgtggcagatgatccaggagactctagaggccattcctgaaagtggcatgcattcatccttcccacatttcatctgccagaattcaatcacagttccttgcctatctcaaggggtgggaaaatagtctagctatggcccaagaagcagaggatacagatctgcttatcatcctggaaagtaactgccatactcggcaaagggaaacattcagggaaattttactggaggataagcacacagatattaagacagtgacatgtggagtcatgaaaagctgagttcaaattcaggtaagaattagtaggctttgttaagtcactcaaactctccaacccatttttaatacttaaataatgggaataacagtaaaatataataaacttgaacctataaacttatcgtgaggattaaatgcgtgaaatctttttttttttttttttgagacagagtcttgctctgtcacccaggctggagtgcagtggcgtgatctcggctcacttaaatgtgtgaaatcttaagcacagcataattacatagtaagcatttaataaatagtacctctcaggaagaggaggaagtttgagaaggcaagagggaacagaaagaagagcaaaaggagatggagttggaaaattagacacagagaggatgtgctggggaatgaagaaaatgactttagactgatagaaaatgtgcagaggcataagacaataacatgtgttcaagaaattacaagcaatttagtatatttgcagaataaaattctctttactggaaaatcatgtcagtccagagagggtgagaccctagcaggccttggtgccataatcaggagcttcatcttataacaactgaaagccactgaagtgcttaatcaagcaacatatccaggtttgtgcttcagatagattctcctggtggttgtgtaaaaaaatcactttagggtaggagagactggctggtggtagggagggtggttggttgctgtgactatcacgtaggttagaaaaagagggccagagccacagatgtgctagagcagaggggtgcaaaatttgttttgtaggaaacagtaaaagtagtgattgactggaggtgaaggagacagtctaggctgactcccaggaatttggcttggacaaccaggggaatgatgtgctgtggagagagactgcagcataatctaaaagctccttggtcatattgaagtttcattctttttctattaatattgcattttatgccccatgatttaattttccaaatcttttcccaaaacaatttctagaaactttgagactcatattggctttctttctcccagaatatcactttgtgtcttaactaaaaacaaaaaattgcctttgacaatttcttgcctttattcttgagtcaaggtggaaagttgacctatgtaatctctgtgaccagtgccatataatctatgattcccgtgtgcacaccatcagctttcagtgcacatcagcttcatcccaaattctcgcttgtcgtgtttaatgaaatctccaaagccgacatgaacttgagataagatttaaaaacagcccccacccaggctaggcgcggtggctcatgcttgtaatctcagcactttgggaggccaaggtgcgcggatcacgaggtcaggagatcgagacaattctggctaacatggtgaaaccccatctctactaaaaatacaaaaaattagctggcgtggtggcaggcacctgtagtcccagctactcaggaggctggggtaggagaatggcttgaacccaggaggcagagcttgcagtgagcccagattgtgccactgcactctggactgggcgacggagtgagactccatctcaaaaaaaaaaaaaagaaacccacagcccccacccaaatgttagttctaaacttgcagaaagaggaacctcaagataaatatatcatttatgtttatgcaaaagtatgttgggtcatcggacttcccagagccatggaaaaataacacctcaagtatttacataagctgaggggacaaggggaaagcctcaaaccagttggcttctattttctggtttaataatgaggtttttcattacaaaaggaaggaagttcatctgcatagggccttccttctctgagaacacatttctattatctcttaaaaaagccaaagtcatcccctggcagttgcccagggactgcagaaaagagaacagagttacatgcaaaactggctacatgatttgtggggctgagcgcaaaaagaaaatgcaaggcccttgttcaaaaagcaagaaaaaaggtgccattaaaggcactttttcctttattccatggtctctcccttaacttgtcatgagatgctttttatttgctatttaatgtcattctaaaagaagaaaaaaaatgacattttaaattatcagtgtgaatttttactgttcatctttatattttgcactataaaagcatttaagtagtatgcaggattattaaaattagacaatacttacttcgtagcttatacacgcaggcattttgttcttatcggaacagtggaaatgctacataattcaaaaaaatacacaattctttttattttatttcttgatatgtgcacattctaacaacactttctacctttggtttattgatgagaatggaaggagtgaaaggtaaaacaactccaggttgccctatctttccctttcattctttgaatggaatgggatgaatcctttcaatgaaagtgattagctaatatagggacgtaacataagaaagatacaatagatagagttccttggctgtttgtttcttagaaacaccactgccttctttctatatgagaagcaagatctggatcaaatggaaagtgatgtcttcttagggttgtcggtcattgatgtcatacacttaccttgtacttgctttgcatctcactgaagtcccactcattgtgggtacactagaaatactgggatcatgtgatattgcaaatgtggacatgcatattgcaagtatctcctcagctcatgcacagactcttatccaattagacttcatgtaccaaacacaagttcgaagatagaactattacaagtttcaagatggcaacaacaaagcattaaaccaagctcagggcccttctgagtgctgggccctgtgtgaccacaccggacatatccaaggaagccacctgtggttggatattttcatcaagtcacaagaggctggtaggagggctctccaatagggaattgatcttctagaattaaacaggccccaaacaagttcttactctcttttaataaattatttgcaactatttcaacctgtcattggaatttctgaccatgactgtgctgggcttaggaggctactgagcctgaaagccctggactaagaacagccttgatgaaatagtaattgtgtgactggaaagaagaactaaggcaagagttcagggtggtaggctgatacactttataactgctatttatgcagcttctgctatgtgcttgtaatatactttacaaacatctcatttaatcctgacgacaactataaggcaagtataaccaacacctgctttataaacgaaaaaactggggtcagaattttgcaaaaattttcccagtcacacagacagtgacagagctaagattcagtttcacgtctgtccaattccaaaacctatgctcgtatttattatttatgtatttatttttgagacggggtctcactctgtcacccaggctggagtgcagtggcacaatatcggctcactgcaacttccacttcctgagctcaagagatcctcccagctcagcctcccaagtagctggaactacaggcacatgccaccacacctggctaattttttatttttttactttttgtagggatgggtttttgccatattgcccaggctgatcttgaactcctgggctcaggcaatccacccacctcaacctcccaaagtgctaggattacaggcatgggccaacatgcccagcccaaaacctatgttctttccatataacaagctttctccattgccaaggatcagcgtctgaataaacaaggccaatgctgtattgagacagctgagtgggagaagagccacaaagaagagaagagtctttgtgcagagattttagatgagagtcaccttggcaggcccagcatgtatcctaagatgggaggagatttgcttaacaaatctaatgatacctccctgtttcaattattctttttcctaaatattagcaggtagctattaaaaaggaagaaaaaagtcaatacaaacaaaataacaggaagtatccacgggttgatttaggtgtgggaatgggcacatactggagaactagcaaagagtttgaaggctgcagagcttttgttcctagaaccctgttcaagtaagcaaagccacagcacacaaaaagaggatggccagcattcagggacaaagtcaaggggccaatttaatctgaccaaatattccttttgaatatagttgcaaaattagcagcaagaatgcaatgtaacccaaaagcatgagtggcatgcccaggaagtctgagcagctgcttatggtggacatcgagacattttctttcctcatctctagctgttgcccttatttaacacactcaggttggtataggtagtacactcagaaaattgtgaaatattccagtagattcttttttcttcttcccctttttgagataggatttccctctgttgctcaggctggagtactgtggtacaatctcagctccctgcagcctcaacctcccaggctcaagcaatccttctgcctcagcttcccaattagctgggactacaggcaggcacctccatgcctggctactttttgtatcttttgtagagacagggtctcactatatcgcccaggctcatctcaaattcctgggctcagacgatcctcctgcctatacctcccaaagtgctgggattacaggcatgagccactgtgcctgccctccaatagattcttactaaacctgattatactgctctagaagatttaaactgcaaaatacaaattcacaaagtagtgatgtatgctattatatggatgagcctcagaaacattatactcattgaaagaagccagatacaaaagggaacaaattatatgaattcatttctgtgttcaaaataggcaactttatagagaaagaaagtcaaatggtggtaatcagttagttgcctgggttgttggtgggaattgagagtgactgcaaatggatgccaggtttctttctgaggtagtgaaaatgttctaaaattagatgatggtgataaaacgagtgaatactatcattaaatattgtacatcaatagagctgttaaatacataggcagtcacccagggatttttaataagcatgcattaccacaagtaaagacaactggtagaaaggctgaagtgcagaaagtgaatagaactttgaaaaagcaagagattttggtgtcatgcagacaaaggttttgaatatattgagttatctcctgtgatttttcacaccatcctagtgaggtgggcatcgtggtccccatttttaggatgaagacacttaagctcgagtttaataattttctcagggtcacctagctggtgagtggcagagccctgagtttttctggtaacaatgcccgtgctccttcacctctccatcgtgacagaacattgcctgtaagactttccctcaggaaaatccaatattaacatttaagaaattaaagcttctttttgcccagatttgttttcactgccaacactttctcttcatctgtatcaactctctctccccctttaccatagtacactttgtggccacagcatcctgcttgtcagcatacaaaattctgctcatccctccaggagctcctgagaggctctgcccactctccaaactgactgacagagcccgagagctactccaagcccactcagtgatcatgagattactgtggttaattccacactgcctgtttaaatacgccctccaagaacctttaatttttatctttctgtgttgtaaatagtacagtgcttatttataaacttcagaactctaagtttccatttcctgtcaccaaaataggctcctagtaattgctcttgagaggtaaccattaaaccatggcccctgctgctgctacagctggctgaaggaagatcttgcatctagattcctgttcagatacctgtgactgttgaagctctttattgaattttttaggctcatgctcagacagctgtctaccactaattgtgccttttggcttacaagatgcttgaaagtaaagtatgcaatttctttgaacttcagtttttcccatctataaaatgacgataaaaatacctgcctgaaagaatattttctgtgttttttccctgttgattcaaaggttaaataaggtaatatttacaaagtatctggtgtgatgctgtgttacagtaaccatccaatatatggcaaccattattgagataagggtaaggatctccttcagttgagaaaaaggcatatctaccacattttacttactgaaaccaaccacaaatgaccaaaaaacaaacaaaaaacaaacaaacaaaaaaagaaactccatcttcagtgaaacttttgaaaacccacattcctcaacttataaatgctggagagcagcttctaatcacagtgaaattgaaattcaaaccaaaccaagggaagaaatgaggtggcaggaaacgcaggctccaatacacatctacgggaaaagctccaagttttccaacagtaaggggcaaagtcctgaagctccaaaccagtaaacccatactcagaagacaaggtgttgggagtatggagactgtaggagcatcctcaagtcccacagaacactcaaaaaagcagggacatccgatcagaataaggcactttgcagatgtgaggagagatggtacacagtactggctctgcaggtgtgaacattattcgctgaagagaagtacatgctaaatcaccacatggaaaaaatctgtgaactacaggatgtcatgctaagccaggtggaccacctcttgattctcaagaaagaaaacatggcagagatggcgaggaaatgctctgaagcaaaatacctatgtctgagctgtctgctgcctcagctcacaccccagcttgtcccacaatctgctcttcagtcaatagagagttgggaaagtgtggcccttgttgagagataagccataatcagactgtcactagcatgggattcaggcatgtagacagaatgaaaaagcataggcagtaaaacagtataggcagaagaagcacaacgccacccagccatccaaaaaaaatcagacaacctcttctccatgacatcagagaaattttaaaaataaagtctttttttcatataatgacactttgggcttgaaaaaatgtagcagaaacagaagaatattgagggtaaattaacaaagctcaaaaaacagaagaggaaaatcagccatattaaaatcagaaaacaaaaaatgaataaaaattgctgaaaatatagtaatgaaagatggatttgataaaactaaacaaaataaaataggaaagaacaaaggtttaaattatgacagagaaaataattgatatgagtgacagataaaagatatccaatattcccataagtggtattctgaagccaacagaataaatgcaaatgaaaaatatttaaagatataatagaagaaagcatccagaaaactgatacagaattagcaacatgacatatttggataaagttactatacttcagagattttttaaaacagaatttggtggactttgggaggccaaggtggatagatcacctaaagtcgtgagctgaagaccagcctggccaacatggtgaatccccgtctctactaaaaatacaaaatcagctgagcatggtggcacatgcgtgcaatcccagctactcggcaggctgaagcaggaaaatcacttgaacctgggaggtagaggttgcagtgagctgagatggtgccactgcactccagcctgggtgacaaaaagaggctccatctcaaaaaaaaaaaaaaattgaagaatttggtggacaaccagaaaaaaatcaagttatgtggaggaggggaaaaagctgtcttcaaactcgtagctgcgttcaaaactagaagacaatagtctaatgtttaaagaccctcaagagaagaaagattaacccaagaattttaaatccagatatatttcaggaataaagcaaaaacatactttctaacatgcaagaactccatgactgtggcactttaagacaaaacatgacttaaaacctatgaggactattgaattcaattaaatataacactaaaatcaggcaattatgagaattatggttatagaacacagtgtaaatgttataaaccctgagaatatagaaattatactattaataataaaatcaggaggtggaggatatgaaaacatatgggacaaagtaatagcaggccgattcctttcttttttaataggaaataagtagatattgtcaaatcaagaaagatagctataagaatactacagttacaaggttaaccactgaactaagaacaaactataactccttcaaaacatgaacagtgctgtaccctctttaaaaatacaaaggattgaaagaaaataaaacatttaaaagaaaaagtttgataacatgaattagataacagagttaagaccaaccacctttgtcttatgaatgtggaaatatgataattttatcaaagaaatagatttataatctaaaaacaaaacccaagcatatattatatgcaagaaataattctaaaacaaagtagcctgagacatgataaaatggtgacaaaagtgtacagccatgcaaacaaataagaacaagaatcatgacgttaatatcaaacaagtctaattcagctaaaataataaagtattaaatcagaccaaccattgtggaagtcagtgtggtgattcctcagggatctagaactagaaataccatttgacccagccatcccattactgagtatatacccaaaggattataaatcatgctgctataaagacacatgcacacgtatgtttattgcggcactattcacagtagcaaagacttggaaccgacccaaatgtccaacaatgatagactggattaagaaaatgtggcacatatacaccatggaatactatgcagccataaaaaatgatgagttcatgtcctttgtagggatatggatgaagctggaaaccatcattctcagcaaactatcccaaggacaaaaaaccaaacaccacatgctctcactcacaggtgggagtcgaacaatgagaacacatggacacaggaaggggaacatcacacaccggggcctgttgttgggtggggggaggagggagggatagcattaggagatatacctaatgttaaatgacgagttaatgggtgcagcacaccaacatggcacatgtatacatatgtaaataacatgcacattgtgcacatgtaccctaaaacttaaagtataaaaaaaagataatttaaacagataaattatcatagtagaattttaaagtttccaaggaacaatcctatttaagaaacctatcagtataacatagtttcaaagataaatctttctaactttcaaagagtgaataattgcaatttacttaaatggtcctgaggcacacaaaaattaaaactagaaggaattttttttttttttgagatggagtctctctctcccacctaggctggagtgcagtggcgcgatctcagcacactgcaacattcgcctcctgggttcaagcgattctcctgcctcggcctcccgagtagctgggactacagacacatgccaccatgcacagctaagtttttgtatttttagtagagatggggtttcatcgtgttagccaggatgatcttgatctcctgacctcgtgatacacctgcctcggcctcccaaagtgctgggattacagatgtgagccaccgtgcctggccagacctttttcttaatataataacaattatgtatctcaagccaaaagttagatttgcatttaatgaagagcaccaaaatagtttccagtaaggcttgaaaaaatggtaatttagaattgttctggtagtgtgttttagtgagaagaagacagtttgaaacaaccctaaaaattgagtgactcaacacataatagcttattttaactcaagttacatgtccaacatgaattggcaacagatccaggctcatagaggcttcaccattttgtacctgcactgtctgaatcacataggctgtttggtgccaatagcaagagaagtgatacaggggcatttcatgtctgctcttgtatatgtcagcctggaaataactcatactacttcctctcacagactataggacacatctagtcacatggtcctctactatatgagagctgaacaatgtggagcatacgggtattctgtgagcagtaaatgtctttatttcaagagaaataaaacatacaactataaaaattgcaaagaacgagataaaattaaagcatgcaaaagttatgctataaaagaaatcaagagttgagatagattaaaattagaaaagatgtggatttgaatatcatgatttacaagtttgacctaataagaaaaataaattttaaaacaaacattactagagataactggattatcacttagtgataaaaaagaacattcctaaacatgatggaataagcccatctcagttatctattgctgcattaaaaaaaaaaagccaaaaccttgtgacttaaaacaacaatggttcaataaatggaccatgctcaacgagatactcagattagctgaacgtcattagtaacattacagcaaacacagcatcagattcgggtttttaagtatagcatccaatcaactgaatcaagtccaaatgtagatgagactctcccagtgtggctttcaggcaagaaacagagataaagagagatatttaataatggcgagtgtgtcaaattatcaggaagaggtaacaattctaaatgtgtaagcgcttcataaaataacttcaaaatataaaacaaaaaaagacagaaataaaaaggaagttgacaaattcaccatgataatggaaaaccctaacataattctcttggtaacttatagaatattagaaaaaatagtaagaccataggatatttgaataacacaatatagaatatagaattatgtaattcacagaaatgaaatgctgcaccaatatttgcaaatatacattgttttaaagaaaacatggaaaatttacaaaacgtgactatgtactagcccataaagcaaatttcaacatatttcaaaagactgaaatcacaaaatatgttctcagaccacagtggaattaaactagagattaatatcaacaaaaatgaaaatctctattaggaaaagaaacaatacacttcaaaacaacccattggccagaaggaacaccctaatggaaattaataatattcttaacaaaatgatcatagagatatgacatatcaaaacttacacattgcagtcacacttagacaaaactgtatagcatattggaaaataaaagattaaaaaatcaaagacctaagtatccctgtaagaagtttttaaaaagcaagttaacttttaaaaggtaaaatgaagtaaatattaaagaaatgaggagaaattaatgaaatagaaaatgaacatacaatacagaaaaatcaacaaagccaaaaggttctttgaaaaggctaattcaattgatgattccctctagagactgatcaagaataaaagaatgactaagagaagacagttatcaatattatgagtgaaaaaataaaaaacattactacagatctcaaatatattaaaaaataaatgaggacattgtaaataatgttgtgccaatagacttggaaatattgataagcaaattcctaaaaatatacaacatatcaaaactggcacaagaagaaataaagtatctgaataatctcatatcagctttaaaaatcaaatctgtaatttgccctcctccagagaaagttccaagcctaagtacttttttttaattattattatactttaagttttagggtacatgtgcacattgtgcgggttagttacatatgtatacatgtgccatgctggtgctctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgtggtgtttggttttttgttcttgccatagtttactgagaatgatgatttccaatttcatccgtgtccctacaaaggacatgaactcattttttatggctgcatagtattccatggtgtacacgtgccacattttcttaatccagtctatcattgttggacatttgggttggttccaagtctttgctattgtgaataatgccgcagtaaacatacgtgtgcatgtgcctttatagcagcatgatttatagtcctttgggtatatacccagtaatgggatggctgggtcaaatggtatttctagttccagattcctgaggaatcgccacactgacttccacaatggttgaactagtttacactcccaccaacagtgtaaaagtgttcctatttctccacatcctctccagcacgtgttgtttcctgactttttaatgattgccattctaactggtgtgagatgatatctcattgtggttttgatttgcatttctctgatggccagtgatggtgagcattttttcataagcctaagtaagtacctttaccagtaaaatcttccaaacatttaaggaagaaataacatcagtcgtacacaaactcttcacgaaaatagaaaaagaaggagcttgcttatgagaccaatataattttgttactaaaattcatcaagaaagaaaattggtccatcttcctcatgaacacaaatgctaaaaagcacagcaaatttataagtcaaattcaagaatatataaaaaagataacacatcatggccaagttggaatgcacagttgattttacatttataatcatccatgtaattcatcatattaacaataaaagtaaataatcatatgatcatattaatagaggcaataaaggtatttactgaaacagcatccattatttaggaaaaaaggaaaatttcttagcaaattagaaatataaggaaaggtatttaatctgatacatagtatttaccaaaaaaaattacagaaaatattatatttaatattgaaatattaagagctttttctgtgagactaagacaggacacctgatattaccacttctctttagtatcatgtttgagttcctagtcagtgcaataagtgagagaaaaggaagtttaagtattaaaaataatgaataaaactatcattatatgattgtgtttgcatgaaatctaaaataacctaaagataaactattaaaattaataagtaaattccgcaattttagtagatattaaaaggtcagtaaggccgggcatggtggctcacgcttgtaatcctagcacttttggaggccaaggcgggcagataacttgaggtcaggagtttgagaccagcctggccaacatggtgaaacctcatctctactaaaaatacaaaaattacctgggcatggtggcagacacctataatcccagctacttgggacgctaaggcaggagaatcgcttgaacctgggaggtggaggttgcaatgagccaagatcgcaccagtgcactccagcctgggggacaagagcaaaactctgtctcaaaaaaataaaaataatggtcagtaaaacaaaaaagtattatatttctatataccaatatacatttagaaaaaaatctaatgatgtcacttacaatatcataaaaaacatatcaataacctaaggataaacctaccaaaagatatactttccagaggcaaagctatagaaaattactgaaagaatgtcaagttaacctaaataaatgaggggatattgtatgtttatggattgggagactaaatcttttctaatttatacaaattaacttataaatccaatgcaatcccagttattaaaaatctactaggcttttggggagagaggggacaggaattgacaaggtgatttttaaatgtatagaaaaattcaaaaagccaaaaatagccataacaattttgaagaagaacagcattttatgacttaaactatcagttaataagagttattataaagccacaataattagaagagtgtggtattggcatgaggatagacaaaatagactaatggacaagaaaggagtttccaaaaatagacctacatggctttttgttttataacaaaggtgaaattgcactgtactgtggaaaaaatcaactttcaataaatagggcaggataaattatctgtatttaagttaaaagtgaatataaacactcaaactgtacacaaaaatcaattgcaatgctattataaatataaaataaatggtaaaaaataaagtttctagaagataacctgggagagtatctttatgatcttggagtagactaactttcttagaagggatgcaaaaatctctaaccacaaaggagaagactgataaactggactatgtcaaagttagaatggttgttcatcaaaaggcactatcaatgagcaaagaagcaagccacagattgaaggaagacatttgcaatacatatatccaacaaaaggtttatattcagggtttaaaataactacaaaacaggaaaagaaagactgaaagttaagagaaaaatgaggaaatatttgaacagagattgcacataaaaaggatatctacatcaccaattagactatgaaaaaatgctcattctcaaattcaccagagacatacaaattaaaaccacattgagataattctagcagaacggccagattttactagatgacaataccaatatcagcaagaattttagaacaatgataactctcatacattggttggtgggtgtggtgggaattggcacaaccactttggaaaataatttggtaatacttcctaaactgaatatatgcataccttatgagccaggacttccactcccagatatatacccaacagaattatgtgcgcatatgccccaataaatgtatacaagaatgttcatagcagcactatttgttttagcaccaaaagtaggtaaagattctgtgttccctttgaagttctcctcttaatctctattcacccctgtaacccctgtatggttttcttgcctcagggtgcagtgggtcagatgtgacataatatacctaaggtgatgtgcatttgtagatataaaattaaatgcccccttaggaagaccaaggtatgggcccagagagaaagggtgagaaaatatttgaaagaaagaaactggcactcctcgtggcagctaatgtcttaggaacctctgttgaccagtataccaggatggaaacttgacttttagaaaatcataagagctatacattcacctggtaattttttaaaaaatcaaacggtacagaaatacataaaataaattgtgttcttcccacctattgctcctcaaacataatcaatatttttgtgtgtactttccaggaaaagaagaaagtatacttaaaagagttgatgtacacatatatcctattttttatatttacccaatgggataatactacaaaaccaatctatatctcacttttattctcttcacatcaaacaaggtggtcttcccttcttggcatgttcagatttaccttattctttaatgattgcttgtcaccatacggatgaatcagaatattcttaaacagtccccatatcatggttttttgttttgtttccagtgtttaggcaataatgaatgctacaataaacgttcttatagtactctcttcagatacttccttcagggtaatttcccaatagcaaaaatgtagggtcaagggtatttgattttttaaaaccttaacttttttttttctttgatcatcgggtaggaaactgtgattagcagctgaagacgggtactcccacttccttttttcaattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctgggtgagtaaaagggctcaccatgggccctgggtgggatcgggacagcttctctctccaccgcaggcctggtcctttcttggggctcagcccctgctgagagactctctcctacattaggagactgtatttttgaactttactctgtagctcagggctttctcttgaggctgaagaaaatggccacagctggaaggaattttcaatcttacagagtaggaaaccacaataaccacaacaattaaaatttcatttatttttttctttaaaaagtacttcttaaagtccagagaatgtttcatgtttgtttgttcatattgtcttactcatagaagagcccactctcctctctgcagaggagatgtatttattccttgtatgacaaggccagatcctggtccccagcataagaggcaaggtttctaacgggaaagacaggtctttctcttgtacataattgcaaaccactgcagcaattggctgattaagaacatggggtggaggaggtcgcagaggcgtaggtggacaaagcaaggataaatctaaagcatatgactttctctttgtccctgtgggtgtacgtaagtctctatcaactcatatgtgcgaactggttgatttttactaaaggttaaatattataattaaatatgtttatttatttgttcagcaaatgtgtttagtaatatctatgcacaggtgctgagcaattagagtccataggagacactacgtctatgttctggaaagtcatgacatagaagggctcccagcaaggccaatgtactttcaagcagctatgcaacaagctcccagttaaataattgtccaggcaaagttaccaatgaatgctgtaggcagataataaactgtattcaaaatagctagtaaagacttcatgaaacttagaggtgagtaggagctagaggagcagaaatggagcaggcgtgatataagaaaagaggacctcacagttggaaggtgcatggactataattcctgaagtaggaatacatctcagtgtggccccacacaatgtgggtaatggccaggtcctgagcatgagagggcaaagtttataacatgggctctggggtcaaacaggatctaggttcaaacttcatcttgccacctactggctaccagattcctggtctacaaaatgcagttaatcctagtgcttacctcacaggattattgacatggttatatgaaataacctacgtaaatgcagaccatatagaaaccactcacaaaaatattagcttcatttaaaacaatgcaaagatgaaggaagccaaaatattcaggtgaatggtgaataatttgttgttctcagtaaaacacttaagtttggataagtctccaatagcctcatgtggacagggatgatttgtctctcacacactcctggatttctattgccttgctctggagtatgattggcattccaaaaatctgttgaataaataaatcaacccatatgcagaatacctactcaattgataaacctgccagttttgtgtcctctctctcttcattacccatttctcaaatctctatccttctattcctatattattaacctagttctttaattaattcattatacaacacaaatatatttagtgaatattaaaggaatatcttttatatgccattcaccgttataggtcctggaggatatatggtgaacataaggaaagtcctaggtctcatagagcttgcattatagagaagggaaaataaacaagcagataatgaagataatttggataaatactctgacaaaaattacacattaccatctcttgggctgagcatcaggtctaaataatctgagcatcagttgattgtttaaaaattaggcatgatgataatgagcccttggattcaatgatctcatgaaaagagtatagcctggagtctggtgcccaagggaggcttaattcatgtccatttccttgccctgccttctaatcagtctccctgcttcatattgtcccattaaattctgtccactgacagagtgctccatcaaagtctgaaattctaaccttgtcaatctcctccttgaaaccattccatgactccttatcacttttataataaaattagaaccacttactcaggccctgcatgcttctctggtcttatttcccccaacactcccagttcctgagcaccaatgtcatttctccacttctgtgccctttctaccttgaaaggtagaaatcgcctcttaccacacacaaatgctaacatccacctgcagactcatgttctcactcacagttttgtgaagtatcatctccttcaggtaccttcaaggatccacccatcctgttcaacacatgtacacacaaacacacactctacacacacacatatatcctacacactgggctagtggcccttctgcccccaacataccccatgtgtatttctgttattgcacttacaccctgtgttatattattttaaatcgtgtttctgtttttccactagtcaacttcttgatggcagataccatttttaaaattcattgtagaagtccaaataccatgccatatatatatgtatatatatgtatatttatgtgtatatatatacatttgatgaataattattagagtttttaaatgaattttttaaagggacaagtaatacatgcatgggtaaaaaagggaattatcttcttaaaacaaaataatcatggttctgtgctcatctctggctcttatttttttgcagctcctgtcagtggacagtttggtgagttctcctgtctttggctcttcagcgtctctggttaagagtgtctcttcctaataaatagaaaacatttgtgatggctgcctgagatctccaatatctcctgttttctttccttttttttattatactttaagttttagggtacatgtgcacaacgtgcaggtttgttatatatgtatacatgtgccatgttggtgcgctgcacccactaactcgtcatttaacattaggtatatctcctaatgctatccctcccccctccccccaccccacaacaggccctggagtgtgatgttccccttcctgtgtccaagtgttctcattgttcaattcccacctatgagtgagaacatgcggtgtttggttttttgtccttgcaatagtttgctgagaatgacagtttccagcttcatccatgtccctacaaaggacatgaactcatcattttttatggctgcatagtattccatggtgtatatgtgccacatttccttgatccagtctatcattgttggacatttgggttggttccaagtctttgctactgtgaatagtgccgcagtaaacatacgtgtgcatgtgcctttatagcagcatgatttgtagtccattggttatatacctggtaatgggatggctgggtcaaatggtatttctgcttctagatccctgaggaatcgccacactgaacttccacaatggttgaactagtttacactcccaccaacagtgtaaaagtgttcctatttctccacatcctctccagcacctgttgtttcctgactttttaataattgccattctaactggtgtgatatggtatctcattgtggttttgatttgcatttctctgatggccagtgatgatgagcattttctcatgtgtcttttggctgcataaatgtcttcttttgagaagtgtctgttcatatccttcacccactttttgatggggttgtttgaatttttcttgtaaatttgtttgagttcattgtagattctggatattagccctttgtcaaatgagtagattgcaaaacttttctcccattctgtaggttgcctgttcactctgatggtagtttcttttgctgtgcagaagttctttagtttaattagatcccatttgtcaattttggcttttgttgccattgcttttggtgttttagacatgaagtccttgcccatgcctatgtcctgaatggtattgcctaggttttcttaaagacttaaatgttagacctaaaacaatatctcctgttttcttgctgaggtcagcagggatttcaaagtgatgcctggttttttggcatcgcccaagggccaggatagcttcatggtcaccctctgaccctccctgggggaaggggtgaatgcccaagcagctcccagcctttgctaagccctgcatttactattattgccaacagaccccatttagccaggcaggacatcttcaactccatggcaagtatattgactcaggataggatcctctcaatcagcgagccagaaaaataccctgaaaatatcccactgtgctgatgccagcaggaatgctgcattctctacactttggagtaaaatcctccaggacatccaataactgggtccttacaaaaaagaaaggcacagaaaggggagatggggagaagacaagttatctgcatcccacatttaattagttctggctcttactgccattcctttggctcagagtggataattgagaatccatgaacagcaagaaccctctacaacccctctccttgtccaaatcagtggccccagctgtaactttgtcctggtcacctctggatgtcagtgagtgacttgtcccttccttgctctgccacaattagctgtgatgggattcttctgggcacttgaatcatcatctacaaaatgaagatattaggtaagttgagctctcaaggttttctcagggacaaatcttaagataatatgatttattctcttagggaaagtgcaaaattgtgattttaacataacctttggagtttcttatgagtgtatgaacatgatgaaatggcagcgcagcattgattttctctgggacccacttccatgtaaggctacctaactgtgatatttgatggcgaatcctgctggtgtcaccctcctgaaatcattttgctcattgccatcccctgggcaatttctcccttgggtgaggtgagggccactggctgacagggagctttgagctatcagtgaccctcccagaggacctctttcagatcctccaaacccaggtccttcaggctatgcagcaggaggccctgaggctgggtctgcaggcgcctccacctcagactccttttctctttcctcttcagcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcaggtgagagagcgtgaaagacgcaccaactttagaaatcaattcagcccatgtttctctctagctgttattactgtttacctcagacccttcatgagtggacaattttatttcacactgtggtaagacaaggagagagtaaaaagctcagaatacaaccagacagggaatggggttagctgcttaattttaaacattaaaataaatagaatttttacttgagtggattaatgtctctaaacctgtggttcttaaagtttgatttgagtcagaaagcctgggcagcttatcaaccatacagatactcaggacctacctatgcttattcaatagaaacctgtagaagtggggtccagcaatttatattttttacaagcctctccggtaccagaaagtctgaggattaatttatttgagtggttcctgaatctatgtatagctttttggtttggtttggtttggtttggtttggtttggtttggtttggtttggttttttgagatggagtctcgctctgtcacccaggctggagtgcagtggcgttatctcggctcactgcaacttctgtctcccgggttcaagcaattctcccacctcggtatccctagtaagtaggactacaagagcccgccatcacacctggctaatttttgtattcttagcagagatgggatttcctcatgctgcccaggctaatgttgaactcctgggctcaagtgatctgctcacctaggcctctcaaagcgctgggattacaggtatgagccactgcacccggcctctatgtatagttttaagtcacattatttacttggaataataagtggcaggagaattgttcatacttatgggtagataatgcataggtagataaatatacagagaaagaaagataaaggaagagacatttccttccttgtcctaaagccacctgttttgaagttgaagttacatcattttttaatgtagtggaagcagtgtactagcaaggaataaacaaaaatgtttatactctttgacttaacaatccgtctcttaagaatttgcctactgaaacaatcacagatgtccatccctgaaaatggcagaccttaacatggtttagaaaaagaatacctggccaggcgcggtggcttacgcctgtaatcccagcactttggaaggccaaggcgggtggatcacgaggtcaggagattgagaccatcctggctaacactatgaaaccccgtctctactaaaaatacaaaaaattagccgggcttggtggcgggtgcctgtagtcccagctactcgggaggctgaggcaggagaatggcatgaacccgggagatggagcttgcagtgagccgagatagcaccactgcagtcctgcctgggtgaaagagtgagactccgtctcaaaaaaaaaaaaaaaaaaaaaaaactcattaaagaaattacattactgccagtgaaggaaaaccgcaaacattaaaaatcaggttcaataatgatactaatgatgtaggaaagtgttcatagcatagtaagtgaaaggaaagttatcaaatctacaaatattaatattattccataaaagaaatacgcatgagctccaagtacttgaaagtggaagagaaaactggaaaaacatatgccaaaacatgggtggtgagatggtaggtgattttacctacatttctgcttttcaacttttcttaaggtgtatgtgttcatttttaaatcagaaaaaaagaaatgataattattttaagagttctttttcccaacccatttttttaaaataaaatctacttggaaaaacaatgaaaagaaaggggaaacagtaggatgaaccaaataactctattgtgtttctcatagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaaggtaaagccttcattattttgtgaagtgagttggtcaaaaggagattccttggggtcatagagatagaacaggaggaaaagggtggactggaataccactaaaccacaggacacattcctgcaaggagcagaggaagtatagtagtgttttgggctgaaggaagctagggatcaatggcattcctttctttgcctgcttttggatgtgctgctgcttgaagtgtgcttttctccaaagcagttccagcctcattgctctgggactgttgtgattcttctctctagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagagtaagtgttggtggaacctgagatttgctgcagagagggctggaaaagtgggacagggctgcatatcagcgtgggtcaccagtctctgtagaaaaaactcgtacctgtgagaatgggagttgtgcaagcaaagagacctctactcttgtgaacatcttagaagagcttagacccaggaaaatccaagaaaagaaaggtctaattttttttctttcaatgccattaaatacaattctttcttttctctcgcagggttctcttccctgacatcatttttttttcttctaggcccatagggataagccatgggctgtggcatagctctctgactctggggtacagaggtatctgttgtcccaattaacattacttattgacaataaccaaagtgaaaatttctgtaggatacaaagacaggttgcaacattatagttactccaaatatgtgactctggaggtttaccattccctagttatgagtacaaatatgcaccccagattacatcacctcccttactagtatacagcaccatccttccttcaaagctattatggtagttacagtgatgagggaaaaacagcttctgtagagccctgtgtcatccctccactcatggcaaactccgggctcacttataaggaggcaaggtgatcatcaccagactaggagtcaggacaccaactctggccctggctggccctgaaaacagcctacacaggcaggtctcctagtctctccttgactcagttttctcacctgtaaataaagaaggtcagtctgggccaagggagagagtaggagcagaagaaaaagctctagaagactatgctaatctttaaggaaaaactagcaatggcaaataaatccctgaggccaatgcaagtgaaggagaaataaacagggataggaaagaagactcagaataattgggcacttcaggtgcaacattccatagtcatagggcagaaggaaggagcaagaagcaggtgcaggtaagggtgtgtggttctgatggcagcaagttaagggtggagactggagactgggcatttgcactggccatgccttgtaatctacagtaagaggcaaaagcaattcttgactaattttttctcttgctcagtccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactggtaagccctgcattcctgccaatcacccacccctggccaagagtcctgcctcaccctgcccttcggaagtcagcatataccttccagtatcctcagtttctttcttgggaaaacctaatgtcctcctccactctccggctcactgaaccagctgtctgcctcttgagtctcgttgcattgcagtctaggtgccctcatacccctgcctgatggtgcagtggctttctatcccctggttcccaatttctgagaagccaagtgcttttcttgtgctttccacttgtcctgtggctccccagatgactgattttcattcactatattattctcagtagacacagactcaatttccaggagcacagaggtatctcctgttctgttaatatcagacattaatcaataaaccaaaggcaaagacatgtaagacacaaagacaagtcgctggatcatagttaacccagcatgtccttcttgctcaagccttttttagagttgatgggcagtaggtaagaaaggcacgggcaatggtgggctgggggcaggccaggagatagcttcacctctacttgcttggcttaatgccctcagagctattcaggtagctgccaaatagttatgacatcaaaaaggtttcctttgagctttggatctcagtttcgaaccatccatgcatggctgaatgccaggtccaatgttgaaggagacagtgtgatttgggtctatactggtgacagagagtccagtcttggttggtcctggaagcggcatcagtttcctttcctgtaaaacaataataccagcttggaagacaagcaagaatccagtccctcccacatggatgtgtgagattataaaggagaggaccagggaacccagcgggagacatcaaatgacgtagaaagagaacagtgtccctgacattcagtggcccaaagaaagtggagacagtgacatcatgatcaaacatgctcagagatgtttaaagtcctattcaatgactcacttcttcacctaataaatgctgattgcatatattccatggaccagactgtactgacatctaaagatgcatctacgactacactaacctggccttccccacacagttcgtaggggctaatagcaaatgcagtcaagtaagagattaaacatcaacctgaggatagaagcacctggtggctgcaggagcagatggaaaggcatgccaatctgagttgggaagtgagaaaaaatttcttggaagaactcatgtgtgagttgagacctgaggatgagtgggaacatttcaggagaagaggattgtggtgagggagggaaggcatgttccaggaactggaggggcagtcggttcttgacgactgcagcacagactgaacagtggagaaaggtaggataaggttggagaggaaggtatgtttagaccatatttagaagcagagtaagggcttgggccatattttgcagggcaatctgggctccatgaatgctttaaatcttggggaaaaccactccagcagcacagtgagaaatgagtcatagagcagccagtttggggggcagccaggagtaaaagagagggttcatcaagagagcgtccagttggagcaaaccccaggccagtcccagtagaggagttgggacttgagaaggaaggactccggttgaagcaagaggcactgtgagagtgtgccccaatgtcaccaagggcataatgtgttctaagcagaagagagggagctggtttggataaggcaaagctaagagatgatgacagataaaaactgagtcacatccagtgaatttagccacaaagtactctttggcagaagacagactagaatcagaatacctgggtttgactgctgcctcttcacttactagctgtgtgactcacccactcggggcctcagcatgttcatctgtgaaagaggggcaacaataatacccacctcaatgaattgcttagatgattaaattagagtctctctatatatcgatatttacaaattacatccaacaaatatacaaacaccagaacttacttaaagacactataatgtcattataacaaacatctattttattatttttatctttatcatcataattatattcagaaacatgaaaatccactttagtagattgttggggattaaaaccaagttgtaatggacaaaacatgcatatgagatatgagataaagaagtagagatgttaaaggtaggtcacttcttccagaagactgactacagaaaggtggagaaaccgactgtgaggaactgcaaatgcaaatagggttgtttttctattgtctgatggttttttttttttttaaacatggagagggttaaacacatgcaaatggtgtttgcaagaagccagtagaggtaaaaaccttttatctaggacagaggcaggtgagcacaggatgaaaagacagaagaaaatccccccaggcaggccaaggagggctcctccatagcctcagggcccaggtcagagtgaggagctgatgcaggtaagggtgtggttctgctggtggaaagacaagggaattctttgagagcaacatctctgcacaacagaggcaggtcctacaacaaggggagctgggagaggagaaaagacaagaggtctggtggaaaaggaaaagacagggaatgactaggatggaggacaggagagctggtgagagtagcctgggaagtggctgggtcaccctgcaggtgggtagagcctgtggactggagactgaacaactgcactggtgaaacattgaatctgtgaaccaaaaactatctgagacaggtctcaatcaatttggatagtatattttgccatggctaaagacatgtgccccagattcagctccctgccttctccaaagatgattttgagggtttcaatatttaaaggtgaaagggaagatatggagaaaaaggaagaaatttttttaaaagtatgtgtaaataacagacaaacagttgcattcttttgagtctttgatcaacctttagcagaatacacaatttacatgtgagagaggggcagaggaatagtcacttctgtcttcctttagcccagtgagtctgcatttttaagtcagggaaataatcagatatgcatttgtctcctgtaagcagcaatgacttaaagttctgtcttttgtcctgcacttgtgaaaatcagctatcaatttacactgttagggtaaaacagaaccatttaaaacagaaccattttagggtaaagatcttggggcccacaaataatatttcagtggacaaattttgagggaggtatgtagcttttagaaaagtctttgaagttatcttattaaggaataaaataaaaagcaggtttgcctgaaatagttcccagcttgacttttccctttggcttagtgatttggggttcccaagatttattttccttttatgaaaactacagcaggaggcagaaacaaatcttgactaattttttctctctctcagttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactggtaagccctgggttcctgccaatcacccacccctggccaagagtcctctcttacccaacccttcagaagtcagcatgtaccttctagtatcctctgtttctttcttgaaacaacctaatatcctcctccactctctagctcactgaaccagctgtctgccccttgagcctcatcccattgcagtctgggtgccttcccacccctgcctaatgatgtagcagctttcttttccctgctcctcaaattctgagcagccaattgcttttcttgtgctctccacttgtcctgtagatctgccagatgcctgatttttgtttactaaattattcttagtagatatagactcagactcagttctcaggagcacagaaatgtcccctgtccagttaacatcagacatcaatgaataaccagatgcaaagtcatgtaagacacaaagacaagtcgctggatcacagttaacccaacatgtctcccttgctcaagccttttttagggttgattgggcagtaggtaagaaaggcacagacagcagtgggctgagggcaggtcaggagacagcttaacctctacttgcttggcttaatgccctcacggctactcaggtaactgtcaaatagttatgacatcaaaaaggttttctttgagctttggatctcagttttgaaccatccatgtgtggctaaatggccaggttcaatgttgaaggagacagtgtgatttgggcctatactggagacagagagtccagtcttggttggtcccggaagcggcctcagtttcctttcctgtaaaacaataataccaccttggaagacaagcaagaatccagtccctcccacatggatgtgtgtgattataaaggagagggccagggaacccagggggagatatcaaatgatgtagaaaaagaacagtactcctaacattcagaggcccaaggaaagtggagacagggacatcatgatcaaacacactcagagatgtttaaagtcctattaaatgacccacttcttcacctactaaatgctgattctatatatacacctagatgtagtgacatctaaggatgcatctaagactacactaacctggccctgcccacacagttcacaggggctaatagcaaatgcagtcaagtaatagagaaaacatcaacctaagtttagaagtacctggtggctgcaggagcagatgaaaggcatgccaatctgagttgggaagtgagaaaacaattcttggaatttgagatgatatcgggggaaattcacccccaatattttacataggttcttttctattttccctaagtgtcagctggtctcagaaataaagggacagagtacaaaagagaacaattttaaagctgggtgtccgggggagacatcacatgtcggcaggttccatgatgccccttaagccataaaaccagcaagtttttattagtgattttcaaaagtggagggagtgtactaatagggtgtggctcacagagatcacatgcttcacaaagtaataaaatatcacaaggcaaatggaggcagggtgagctcacaggaccacaggaccggggcgaaattaaaattgctaatgaagcttcgggcacgcattgtcattgataacatcttatcaggagacagggttttgagagcagacaaccagtctgaccaaaatttattaggcaggaatttcctcgtcctaataagcctgggagcactacaggagaccagagcttatttcatccctcagcaacgatcataaaagacagccatccccaaagcggccatttcagaggcctccccttagggacatattctctttctcagggatgttccttgctgagaaaaagaattcagtgatatctctcctatttgatttagaaagaagaaaaatatgactctgttccacccagctcacaggcagccagagtttaaggttatctcccttgttccctgaacattgctgttatcctgttcttttttcaaggtgcccagatttcatattgtttaaacaatttgtgcagttaacacaattatcacagggtcctgaggtgacattcatcctcagcttacaaaaatgatgggattaagagattaaagtaaagacaggcataggaaatcacaagggtattgactgtggaagtgataagtgtccatgaaatcttcacaatttatgttcagagattgcagtaaagacaggcataagaaattataaaagtattaatttggggaactaataaatgtccatgaaatcttcaaaatttatgttcttctgccatggcttcagttggtccctccattcggggtccctgacttcccgcaacaagatgagacctgatggagaagaggattgtggtgagggagggaggacactttcaaggaactggagagtggtcagttcttgatgactgaaccatagacagaacagtggagaaccacaagataaggttggggaagacaacatcattagaacctacttagaagcagagtaagggcttgggccatattctgcagggcaatctgggctccatgaaggttttaaatgttggggaaaaccactccagcagtacagtggggatcaggtcatagagcaacctgtttgaggagcagccaggcgtgaaggagggagcccaacaagggagtgtccagttggacagaacccccagtctagtcccagtagaggaaatgggacatgagaaggaaggactctggccaagggaaaaggcactcactgtgagagtgtgccccactgtcaccaagggtagaacatgttctaagcagatgatagtgagccagtttggataaggcaaagctaagagatgatgaaagataaaaactgagtcatggccaggagaggtggctcatgcctgtaattccagcactttgggaggctgaggcaggtggatcacctgaggtcaggagtttgagaccagcctggccaacatagtgaaatcctgtgtctactaaaaatacaaaaattagccaggtgtggtggcggtcgcctgtaacgccagctactcaggaggctgatgcaggagaattgcttgaattcgggaggcaaagtttgcagtgagctgagatcatgccactgaattccaggctgggtgacacagtgagactccatctcaaaaaaaaaaaaaaaaaaaaaaaaaactgagtcacatccagtgaatttagccacaaagtaccctttggcagaagaacacagactagaaccagaatacctgggtttgactgctgcctcttcacttactagctgtgtgactcaaccactcggggcctcagtattttcatctgtgacatagggacaacaataatacctacctcattgaattgttttgatgattaacttagtgtctttatacatatagatattcacaaattacatctgacaaatatacacacaccagaacttaaaggcactataatctcattataacaaatatcttttttatatttatcattatcatcattactacattcataaacatgaaaaatcagctttagtagattattgggggtaaaaactgagttgtaatggacagaatatgcatatgagatatgagataaagaagtagagatgataaatgtaggtcacttcttccagaagtctgtccacagaaaagtggaggaaccaactgtgaggaacttcaaatacaaataaagttgtttttgaattgtctgatagtttttcttatatggagatagttaaacacaccaaaatgtagtttggaagaagccaaaagaggtaaggactttatgtctaggacagaggcagatgtgcacaaggtcaagagacataggaaaatcccccttgggcaggccaggcatggctcttccatggttgcagggaagcctgcatggttgcaggaagaagtgaggagcggtgcaagtgagtctggtggtggcaagacaaggaattttttccttgaaagcatcatctcctctgcaaaaaggaggcaggtcacactacaagaggagccatgagagaagaagagagtattggtctcctggaaagatgaacagatagggaaagaccagcatggagggctggtcacagaaacctgagaagttgcttggctgccctccaggtaggtgaagtctagagatcctgtactggagactgggcatctgcactggccaagtgttgaaatctacagtaagaggcaaaagcaactcttgattcaatctttctcttcctcagtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccctaatcaacttaatccccttcttggcttcctcctcaactaactagctggggttttccgtactcataagtcctggctcagccagacccctaaaacagctcagtagattccccagcttttaccaaatgaatttatttattgtattttctcctcattccttgtatgttccaacagtacgccaatttttcttgatgcacggagcgtgtcctacttctctactgacatttacatattaacttagctacaagcacagtcttatagataaatattggtcaagaccttaaattctccaaaggatttccaatcttatggtagatttggagaaagctgctggtgaacaaagggggaaatggctccctaggaaccaactcctcaaacttctggagtttttatgatcccttgttttctaacctgctaaaatcagtatcattttattgtattattttaaaaaaactattgttgaagtatgacatacattcaagaaacgtgtgcaaattgtatgtgtacgatttggtgtctttttaggagctaagttgcttctgtttttacttgaatctttgtttatagaaactgggggaaagtttactttcttttcagagaagccaaatggtatgatagaaaaatcttgagcctgatgtgtcagacatgcccctagcataacttgttgagtaaagaggttatttttaaaatgtgaatgttctgagactactccaaagtcagagccaaatctactaggaagcttctagacttcactcattctgcatcccattactatctttttatccatgttttactttcttctcatattcagcagcatcttaagcctctttattttctgtttcttgactgtcacccttaatgccagtagaatgtaagcttcatgagaacagaactgcatccatcttggtcttcacaacatccctgtgcctactcagtgtttggcacacagtaggtcctcagtcaacatttgtaatttagtggacagatgatatgacaagatgataagaggggatttaaaaaaatcatctagcaaagcccaagaggaaaaaaaacaaagctattttagaaatgaaataccaatttgaagcagtaagaatagattggatatctttgaaaaccattaattgaatgaagaaccaatttgagaaaacaatacagaatgcaaagtagaaagatacagaaataaaggcaaaaattataatatggaaatcagacaatggatttgtctgtatccagttatgtggataattaaaatggagaccctcagaaaattgaaccgaagagtaaaatgaaactcaaaaatgtagtagaaattgttgggaagtaaagaaaacttgaatatgtagatcagaacatatatgttgatgacgttattgactttgaggttaaaaatatatatatgtgcctatgattatggggaaaaaagcagtcgtctcagaaagaaaaacatcaagttagtcttagactttgcagtgcactcagtaccaaagagagaggaggtccagacttggacctgcgagggaagaataataaccgaaaattttatatcaattcaaaaagacattgtcaaaaatacagggattcaggaaactgagaatgcactaagccttctggaaaaaacacctaatgacaaaatctagcccaacaagatgtaaatgaatataaaggactcataatgaggaaaccgcattatgactggctctcaaccctggctgcatattagactcgtcaaagacctttgtaaaaggtcacacattgactcgtcaaagcccctctccagactaattcaattcagaatctcacagatggggccacagaatcagtattttttgacacaacctcaagtgagaatattgtgtagacaagattggaaaccactgatttagatatagaaacaaaggctaatcaactgtgagaattatggtcacagaatagaaagtaactattatgaacactgaaaatgtaaaaaaaatgtaacaaagaaaaatagttagaggaaggagaggaagtaaaggaacaatcattttctcatgattattattatttcagagtaaattgtgagttatttcacaattcaaaaagaatggactgttttaaaaaattagtaatagatttcaaaatgtccattttgtaaatcgtttctgaatactttgtcaacagttactcatcattaatggcttatacttcactaaaattccatggaaaaccaactagtagcctgtagagtcacataggagagaacaagtgaattctttgggtggcgcaagcatagatgttaggactgacaaaaaaaaaataataaaaataaacctgtgcattgatatgatcacaaatgatcagggaaagaggaaacagaaactctcatacgccattattacaagtgtaaattggttcaaccttttcgtcttaattgacacattgtaattgtatatatttatggaagcacagtttgatattttgatatacatacatggtatataacgatcaaattaggatatttaatgtacccatcatctcatgcatttatcatttctttggaataaaaacattcaaaagcctctcttctagcttttttgtaatatattataactgaccattaaccatcatcaccaatagaacagaatttattcctcctgtcaaattataactttatacccattgaccaacttctccctatcctcctcttccctctcccctccccagtctctgataaccacagttctattctctgcttctatagtatcaactttgtatttttttagattcaaaatatgagtgaaatcatgcagtatcagtctctctgtgcctggataatttcattaaatatgatatcctccaggtctttttatattgctgcaaatcacaggatttcattattttttatggctgaatactattccattgtgcatatattccacattttatttatctattcatctgctgggggacacttagattgcttctatatcttggctattgtgaacagggctgcaataaacttgagagtgcagatatctctttaacatagcgactttatttcctttgaatatccacccagcagtgaaattgatggataatatggtagctctatttttattttattgagaaacttccatgctgtttcttgtggtggctgtactaatttacaatgccaccagcaatgtaagggttccttcctctccacaacttaaccagcacttgttttcttctgactttttgataacagtcattctaactggagtgaggttatacttcattggcgttttaattgtatttccccaataattagtgatattgaccatttttttcatgtacctgttgtccatttttatgtcttctttagagaaatgtctgttaaagtcttttgcccattttttaatcagcttgtttggttttttcctgttaagctctttatatattctggatgttaacaccttgtcagacataaactttgcaaatattttctcccattctataagttgtctttttactctgttaattgtttcctttgctgtgcaaattcttttcagcttgatgtaatcccatttgtctaatatttgcttttgttgcctgtacttttgtattttaaaaggtccagtcttttagaagaacaatttgacattatatgttattacttaaaatgtttgtatacttcatcccagaaattccatgtctaagaatttatcctaagaaatgcatgtgtaaatatacaaaaatatatctacagaattacttaatgcagcatcacttgacatttaagaaacaacaacatcccaaacatccattaatgggaaaatgcttaaatgtattatagcatatctatacaatggaatactttgtcattgttaagaataatcaggtaagtggggcatggtggctctcgcctgtaatcccagcactttgggaggccgaggcgggcagatcacctgaggttgggagttcaagaccagcctgatggagaaaccctgtctctactgaaaatacaaaattagccgggtatggtcgtgcatgcctgtaatcccagctattcaggaggctgaggcaggagaatcgcttcaacccggatggcggaggttgtgctgagccaagatcgcgccattgcactccagcctgggcaacaagagtgaaactctgactcaaaataaaataaaataaaatcaggtaatatatttccaaaattatcaagttgtaaatgtaaaagttatactttattgtgtgtaaattatgctttaataaagatgagttttaaaagttagtgatgtaaatttttaagtaataccacagaaagatgcccataatatatagctaaggggaaaaagcaggttgtagaccagtatgttattgtgatcccatgcacgtgtgtgattttaatgtatttatttatgtgtctatgagtgtacttatacatagaaaagatctagaaagtgtcaccaaatactcaacagaagtaatttctgaaaaaataaagaaaatggtaaaactttttatttttacttagataattctgtaaagtttgattttattaaatgaatagctgggtttttcatttttaaaaaaatttcagtagttttggggaccaggtggtgtttggttacatgagtaacttctttagcagtaatttccgagattttggtgcactcgttgccagagcagtgtacactgaacccagtgtgtagtactttatccatcaccccactctcactcttccactgaatccccagaatctattatattatgcttaggcctttgcgtcctcatagcttagctcccactgataagtgagaacatacaatgtttggttttccattcctgagttacttagaataatggtctccaactccatctaggttgctgtgaatgccattattttgttcctttttatggctgagtagtattccatagtgtacacacacacacacacacgtgcgtatgtatcacattttctttatccaccccttaattgatgggcatttgggctggttccatagttttgcaatcatgagttgtgctgctataaacacgtttgtgcaagtgtctttttcatataatgacttcttttcctctgggtagatacccagtagtgggattgctggatgaaatggtagttctacttttagttctttaaggaatctccatactgttttcatagtggttgtaatagtttacattcccaccagcagtgtaaaactgttccctttacaccacattcatgccaacatctattattttttgtttttttaattatgaccattcttgcaggagtaaggtggtatcgcattgtggttttgatttgaatttccttgatagtgatgagcacgtttacatgtttgctggcaatttgtgtatcttcttttgaaaatattctattcatgtcctttgcccactttttgatgtgattgttttttcctgatgatttgtttgagtactttgttgattctggatactggtcccatgtcagatgcatagtctgtgaatattttctcccactctgtgggttgtctgtttactctgctgattatttcttttgctgtgcagaagcttttaaatttaattcagacccatctatttattattgtttttgttgcatttgctttgggttcttggtcatgaactctgcctaagccaaccaatgtctagaagagttttttaaagtatattccagggtttatatggttttaggtctcagatttatgtctttgatccatcttgagttgatttttgtgtaaggtgagagatgaggatccagtttcattcttctacatgtggcttgtcaatgatgccagcaccatttgttgcatagggtgttctttcctcactttacatttttgtttcctttatcaaagatcagttggctgtaagtatttggctttatttctgtgttctctccttccattggtctacctgtctgtttttataccagtaccatgctgttctggtaactatagccttgtagtatcgttcaaagtcaggtaatgtgatgcctccagatttgttctttttgcttagtcttgctttggctatgtaggctcttttttttgttccatatgaatattaggattgttttttctagttctgtgaagaattatggtggtattttgatgggaattgcattgaagttatagattgcttttggtagatggccattttcacaatattgattctacccatccatgagaatgggatgtgtttccatttgattgtgtcatctgcgatttcttacaccagtgttttgtagtttttcttatagatatctttcacttacttgtgaaggtgtatttctaagtattttatttttgtaggtgtcataaacaagtttgaattttttatttgattctcagcttggtcactattggtgtatagcagtgttactgatttgtgtacattgattttgtatcctgaaactttactgaactcatttatcagatctaggagctttttggatgagtctttagggtttcctaggtatacaatcatgtcatcagtgaacagcaacaatttgacttcttcctctttaccaatttggatgtcctttatttctttctcttgtctgattgttctggctaggacaaagagctgtttctaattttaaaaatacatgtgtccctaactcattttctctctcagttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttataggtaagttgacctaaccagcagcacaaaaataaaaagaccatctcccctaactttaccagtagccaagatcagaggtacagtttctagagtcatttgctgtgtgacatcctgtcaggcttggtgcctacacagcctccatctctgagttttgtatcctacacgttcaggaacttgcaccttcccttcccttgctgtacttttcctgctagcagcagtccagccatcacgaccaaaattcccctaacataggagtaaaggctttcaaaatacaaactatattctggccaacagtgatagtaagaaagaaagttataaagttctgtgtgcttcaccttggaagagatttagttgtggttttctctgtctgccaatcaataaaaaggccaacacaattctcttattggctcacacatttctctctagcctctcctgcccctgtcccagagtgggttgggttcccacccaagacccttgttagaagacataattcttctgcctccttacctgctcctgttccattcagcaacatcaagatcttccatgcatccttgtcacaggcagactcctagttatgcccactctcagtgaaggctttggcactgtactttcagtctttctccatactccataatctgccatcatttcatgactctcgtggtcacatgtataatccccttaacaccatggcctgtcctctccacaccagtcagccactcccacatacatacactacttcatctccaaaaggacaattttaagcccttattatctgacaaccaccccctggccttctgcttgcgtcagctcctcctgtcactattgttctcagacctcaacagaactcccaggtcattaatacctcccactaattccctactccactagacaataaccccctccactcccaccaccaaattgagtgtctagctctgtatccacccaataactcatctgtccttttcctaaaatatagaggagaggacttccctccccataggtgaacatctccatctggtctccagatttcatcattttgtgcattctcagaagctatgtaactgattatccctttctcttctgtggcccccaacatctctgtctctgtaggatcctttgcactggcacgtaacatggtatatctctcccatatccaaggaaaaccctctcttggtcccacttatacctccatacactaccccttcatggctaaacttccaaaaacagtcagttacccagactgtctccatgtcctcactatccactaggctctaatctactaggtttttccaacctctccaccaaaatgtttctcacaaaggtcaccgatgaccttcaaggctttaaatccaatggccatttttcaatcctcatcttccttgacatctcagatatattacatgttgtttaccatttcttccttcttgaaaccctcccttcagtgaatctatcttcttctggctctcttctctccctggccacttcttctcagtcttctttactggctcctccttttatagaaaacctttaagcactggcatgttccagaactttgacttatgccctcttctcttatctaaatcctttgtctggatgatcctgggtatgtcatgtataaatggccttgtcatctataaataatgattcctaaacttctatctctaaaagggacctcccacttgagcatctgcacatgacataccttcactcaaatatctcaaaagcacatcaatctgagcatttctaaaactgaactgctgacattcccttcctctttcaagggttcctacctctgtgaaacacatctcttctcaacagatacacaaagcaggaacagaggagtcttcctcaacatttctcttcctcacccctcacagccagttaatcattaagtcctgttgatttgacttcctaaatatttcttgggtctctatctctaccacctctatctagacaagtccaccatcattttgactactgcagtgccactcatctatccctcaattccacttccattccaccacagtccatttcatgcacagaggtcaaaatggtcttttaaaagggacaaatttgatcatctcacagccctgcatagatagacttatagacttcccattgctctgtgaagaaggatcaaaatcctttcatggcttatgaagtccagcctagatctccagtctcctatttcttggtagtttgcagaatcttctcagtgtgatgctactttatttcaataattcaaatgtgccagtcttattcccaactcagggcgtttgcacatactgtttgcctgcctggtgcactctccacctccatcatcaactggttaatttcaatgttaatttcaaagatcattttgtgaggaagctttccttgactaacacatacatttcatagtaccctgtcctttatcaattatcaaagttttaattgtaatttactgtatttttatttaattgctgcctctcatccttctagattgtaggctctatgagagcagtaactatgtctttctcatcactgattccctagcatgtcatgccattcttgggacttattaaatgctcaattaatttttatttttgctcaatttttaaaaaatttttgttcaattaatttttgatggataaatgaatgtaaaaatgagcaaataacttgacaatactcattctcttgtgggccctatttctgatgcagcccagatgcaattacatccctggtgatgtaagcagcaagtctctcctgttcttcattttctgttgaactgatttctcctctctccaactgtctttttacctctaagacacctgagtttcagtttaatctttgttttcacattcttcaaacacatttgagtttgtatattccactattccaagctgtttatagcactacacaaatgttgttctttctggagatctgaaaatattgctgagttttgagtaatgtcacaagggcattaaaaactgagaaaaacattcttccatttgaaatgtctttagcatgaaggaatatattttagcagaagcagctgatacataacgtttttcctccctcagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacataagctatgtgtacagcccttcaggagacacactcagcgatctttaaagcaagggacacaggtgaccagggcagagagtggggagcaggatgacatggaatggaaatggacatccatcacccaaattcctctattctcgaagctgttctttgatctctttcaattaagtgtaataacccaaggaaagctgcttctagtgagctctgaatctttttggtgatgacctcctacaagccaaactttgaaacctctgtttagagagaactggtgtttagcaaaagtatgctaaggggtgttgagatgaatcttctagacttggatctgaagataactagctgtatgacattggccaagcacctcttcccatactgacctcaatttccacacccacaaagtgggaaaatcagactagatgaaaatcatgatcatcctttgtcctagaattctatgattttggtagacagggaatatggattatgcagacgtacaggttcctagaaggagatatgcaaaagtaaaagcaggttgtacctgcccctggaatatatcctggagaaacacgagaccatacaatggtatgcaatcaccattccagtcatgtaaagcaaaatatacactgatgctcttattccctttggcaaggtgcctgggtatcataaggaatagacagagtcacataagcaggttgatctgggcatgctaacccatgatccagcatctcacaaagtagccagtgcaaccatctcattgttatccaggaggtgatgacttcagatttgggttttcccattcagtcagctcgttcttcttcccccaccagcagcaccaacctcatccaattttcctgagatttgcaggggctctccccacacagtttacacacctatcccttagagccagcacacaggcatgtaccacggaccgagggctgctccatctttcctcacaatacagcaagccaacacatcatacctcctacattctatacttatgatttcatgattttctgctcatcctcactccctcatttctataattctctgtcgcaaatgcatgttatttctgctgctgttatcacagctaaagggtttcttgcccagcctgaatgaattgtgtctgaatcctgaaactaggacccaggtcatagagaccaggagctgccagaaaaggaaatattatttcttattatcatcataaccagtgtcatcatcatcaacactcactgagccttcaccaggttccaggctctgtgctaaatgtttaataggcaacatctcatttaattattaagataaacctgtgaggataaattttaagccatcgtatcccctatttgcggaaaagagactgaggtttagagaagtgaagtaactagcttgcagacacacagctagccagggtaaagccaggttgaagcacagtcctctctaactcttcacattagtctgatacatgatgacattttctcatccgttgtggccacttttaacacaacattttagtttttagtaatttgttattctgaaagaacacatgaatgtttgtgatgaaaaaaatcaaataatacaaaagggccaatattgaaaagtaaaggtctctttctacctgctcatatcacttcttacgcacatattctccagacataaccactgttaattgtttcatgtgtatgcttctagaaataatctacaaacctaaaggtagataatttttagaaagctagaataatattacacatatagttatgccagttgcattttttaacttaaaatacatcctgacttttgtttaagaaatgcatcttggatatcattcatgtttcattacccaatccagtaggttgtctctaatttttagctcttgtaaaaatgctacaatagaaattcttgtagaaatatattggcatattttatgtcagtatccctaaaggagatggccctagaagtaggacttgaactcctgggctcaagtaatcctcctgcctcatactcccaaatcgct

SEQ ID NO: 16467 - DNA, 78157 bp, Human; identical to SEQ ID NO: 16466

SEQ ID NO: 16468 - DNA, 56326 bp, Human
  misc_feature (1)...(56326): n = A,T,C or G
gaggggattggtgtggggaaagaaagtgggatttgttatgctcaacctaaggctctttaataacatgaaattacatttagttgaatagtaatctcagctgacttgtgtgggaggcaaagaaaaaaatcagttggaaaaggggtggagatatatgagctatccaaatgctagcaggggatggaattggaagggaacactgattttggtaagtgtactaaagcacaccaagccagaatgtgggtctccttcatcttccattaagaaatttctgtctcagtgtagttagaaggatcgtgcgtcagctgctgagggcagagagtcccatttggcagacagagaggaagggaatcagcagatattcgattaggtgctggggactgttctgggtagattatgtatgttacttcattggtgtatctcatcctataaagcaggtggtatccttcccatttcacagaggcatagtgcgtctccaggctgttaaacagcatggcctaagctacatagctccaaggtggtgtggctagaatttgagacttgattggtcagtttccacagcctgcccaataatgcagaattgttgtgggttgccaaagctttcagttaccccctgaaatcctgagggtgtcactcatgtgcacagaggattgataggaatacaactctgatgggcctttagaatgactcaaccttcctgaacttgagcatttttactggaggaggtcaataaaaaaaaaaagaaataaaacctcatcttcccctggccctgagccctttggtgaaggaagacagcacccggtgaagggctcagaggtattagtgtggctgagattcgacacccactctgccatcctctgctctcctctagaggaagttgcctcttggggagctgagttcctgaaactaagcaaatgacaagtgctcctccagccgtgagatgagccagaggatggaatgccacaggccccacttcgtctcccagcccttcatctttcttccatgtccaaaggcggctccccagaggccaagggctcagctcttgtgttctctgagactgtggcacagctcaccctggcttccttagtaggaagcttttaagaactgctctgtagaaagaacaaaccctaatctagctccagcaaagagccaggatcatgctgaacttcctgtgagccttcgtgggggatcgaggctggagaaagtgctgcttcattctgaggtatctgtgaggtggggaaggggcaggaaaatttgtcatttcggcttcctaatctgagaatggtagctccagggcccccctgtagccacagccttaggcggatcaaaaatgagactaatacaggtcctggtaatactgggggtgaccaaggcgaaagaatcgatttttaagttaagttttgaggtgtgactgtatcagagggaaagaaaccatgccaattgaacgactcacagccctgtcgttcctgacttgcttattttcttggctttgccagaacttcttcagagaccaaggcaggcagctctggcgactggagagaggcggggtagaaggtgtttgtgtgggtctgagggctgaggtaccctctagccagactttcctgtcctccgaatccagcagggaacagcgtcacctctgcctctgtgaggcttctgatctgagggggcacctcaagtcattttagtttgtttgttttcatcttagttgaaagatgataggccacaggagggcagggtcaactgtgttgaggcaagctggcttttgtgtcggcccttaggggctgaggtgaaaggctttgacacggagccagggtagctttggcagcttctcccctcctggtcagaacacttccactttcagttgtgaaaaaaaaaattaaaaccaggaagtgaagtccccgagcacgttagaaagcctgacatggcctgactcgggacagctcagagcagggcagaactggggacactctgggccggccttctgcctgcatggacgctctgaagccaccctgtctctggaggaaccacgagcgagggaagaaggacagggactcgtgtggcaggaagaactcagagccgggaagcccccattcactagaagcactgagagatgcggccccctcgcagggtaaggggaccatcgagggggtgttattcagcaagggggtcttgtgagggtgtgacagaggccaagggggcatcctgacccccgactttctttaagcgacttagaatcaagggccggctgagttccacgggcacatcatgctgtctccctcctggtctcggtcatgccttcagaccctgtgtcaggaggagcaacgggaaggaaggatgtggggcatgcatggggctcactttccttctctcgactctcttggggaaggtgaaccaaaacagagacctctttttgtgggtctgagcatccagcatagctcccctgaggtgggctgggggtttgccctcaattttatgttgggtaagactgatgaatgagaccaatggggtgggagagacagatgaatggagctgagtgtattttaggaagtaaggccacaggttaagtctcaggtgctgcttaattcctaagtacttccttcccaatgcccactccctgagggtcctaaggtgaatctcaaagaccctcagggagtaagcactggaaagggactctaccactggagaccctcagggaataagcactggaaagggactctaccaccggagaccctcagggaataagcactggaaagggactctaccaccggagaccctcagggaataagcactggaaagggactctaccaccggggcttggtaccttctgagatatcagcctttttttggtggtctgaaaggtagaattgaatctatagctccaatgtgtaggtgattagtattctatatcagaggcagagtcttaaaaaataaagttaaggccgggcgcagtgactcacacctgtaatcccagaactctgggagtctgaggtgggtggatcacctgaagtcaggagttagaaaccagcctggccaacatggcgaaaccccatctctactgaaaatacaaaaattagcttggcgtggtggcgtacgcctgtaatcccagcaactcaggaggcaggacaattgcttgaacctaggaggcggaggttgcagtgagccgagatggcaccactgcactccagtttggatgacagagcaagactctggctcaaaaacaacacacaaacaaacaaataaaaaaacattgaaaactgacttagttttcttttaaaaaaggagtaattggttttgtttatttctcccttcatattctgatatggagtcactctgtggtagtcccctccgattgatcagtattcaaggttaaacacagaacatgtcttgaaagaggcatggtgtaaaattttatagccatcttttgtgtatttggcataataaaaggaacaaaaacctaaataaaacaagaagtgtaagtgcaaatgcttataggacaggcaagtaatatagagaagtaaagtagatggtgtgtaataagatgctaatggtggaaactttagcaaaattcagagcaggcataccccagataaatgcattcaaatttaattattaaaaaagagaaaacactttttaatccagaccaaacagaatatttcagcctagcctgacctaaaatagtctctcccaggctatattgtaattttttgagggcaaagacaccaacaacaacatcagcgtgtcattgcatacctaaccatccacctatagtgagaccacagatactacatggaggctggagatggaggaaggagagagaaatgaatggagagagggaagatgaagccagggaagtaccagtacacagtaggtactcttatatttaatcaagacaatcttcttcttcttgtttttttttttttttttttttttttttttttggaggagcctcactctgtcacctagactcccaggcttgagtgcagtggcaacatcttggctcactgcaacctctgcctccccagttcaagcaattctcctgcctcagcctcctgagtagctgggattacaggcatgcaccaccatgcccaaataatttttgtacttttagtagagacagggtttcaccatattggccaggctggtctcaaactcctgacctcaagttatctgcctgcctaggcctcccaaagtgctgggattacaggtgtgagccactgcacctggcctataggatttgccagcttcttagaaaccaggaatacagtgtctgctcctgtctgtctctcatatgcctcctcagcagatgagcagaccctcagctggagtgcagtcagaggtgactcttgtgcctggcagcatcaagcaagggtgacgtaaccccagcagccatgagtccagccatcactgcttatcacattctgctggaaatgcatctgggtctatttctcccctctatgtctgtacatcctgaggtcggaaagggactctctcaccaacttgtcctccctggcgcagggcctgacacttcctaggttctcaactcattgtttgaataaatacatgagatctggagtttggaaggtcagacagcccgtgcaatgctgtggtcaggccacactattagccttctttggggaagctggtggatctcccagtcttcatgggccattctattctaagagttgtgaggttgcgagtggctcaagttgaggatttgaggtctggggtaaagctaggtcagagacaggccatggttccctacaactagaagtgctctgtttaaatagaaatgagggcttgttggccgggcgcagtggctcatgccagtaatcccaacactttgggaggccgaggcaggcagatcacttgaaatcaggagtttgagaccagcctggccaacatggtgaaaccccatctctgctaaaaatacaaaagctagctgggcgtggtggcagctgcctgtaatcccagctactcgggaggctgaggcaggagaatcgcttgaacccaggaggcggaggttgcagtgagctgagatctcgccactgcactccagcctgggtgacaagagtgaaactccatctcaaaaaaaagaaaaaaaaaaaaaagagatgagggcttgttaaaacctttgcacagaagtggaggggcagtaatcgttcaagaccgtggtcatctcttttcttttgggacatctcgtaatagaacatctgatattggcaaggatgtgaaaactgaggaaaagggaaggaaaggggagctagatttgattgaggacttcccatgtgcctgacagcataccaactgttctacacacagcatctcctttaagtagcgattttcacctgctccttctgtgtacagtggcggggaactgatgctcagtgactctaagtaactgtccccagggctacacatgtagtaagtgaggagctgttgctctggtacctggaagggcacgaccttgaaagtttgcccctggcaatgacaccgttgacaagaaagcttgttgcctgcactttgaaactgttgacccttgaccactggttgggacaggcagtgcaagggctgattctgcagaaaactaaggcaagaagtctgctttcccaacctcttgcctcaccctggcacaggtgacagggtcctagcactttgtccggcctatctttttacagacccccttatcagatccagtggacttctgacactgcttcttcttaccccagttctgtcataatatacttggtcagcagcaggcctgggatgccctttgggggtgttactgacacaagttgtcccggggtcgggatttggactgtgactcacttgaagcccagtggtggatcaaggttgactctatcgacctgagctcctgtgggatttgtcacttctggggtcacatcctgtgggtgactcaactatcctatgctatcttaatggactgacttaagaggctcttggtatttgacttaacatgagatctcctgataaatgctactcagctcaactggccaatgtctggccccacccaggctctctggagtatgtgaaggcaatggctccagaggtgcagtgtctacactgggccccacacaccatctcattcatccttggagactttttcttccccctgccaccccccgccccccaaccttttaactaaagatggaccctccacctccagcagaaatacctcttcaccatttccctcccctaaatgtcccacttgtcccactttagtgcctctagcacatctggccattccccttctccacttccatttggctccatccaacctaatgagatgattggtctctccgtgaagaaagtagatagagagacacagacaacagttgagaaagatggtttggtggcaggcccactggttggaatcatagttgagatcttactagacatcagcttgattggtagaattgtcatccttttttgttttgtttcttaagacagggtcacactcttgtcactctgcacatccaggctcccaggctggagtgcagtggcgggatcatggatcactacaacctcaacctcccaggctcaacaatcctcctacctcattctcctgagtacctgggactacaggcatgcccaactaaattttttatttttgtaaagatggggtcccactatgttgctcaggctggtctcaaactcctggcctcaaacgatcctccagcctcagcctcccaaagtgcagagattacagggatgggccatcatgtctggccagatcatcatccttgcccctggaaagagacaattggcaataaagccagggggtcaaggatcacacatctttgaggttctagtgttccatacagccgtcttaatgtgctccagtctgcactgacctcttcctccttcaaaaccatgagctcactgcacacactgaagcattctgtaagagtttctaggactagatagacccataagtacccagatggcaggaactatatcggccaagtgttcatccctcagcacatggcacagtgctgaacacacaggtccacagtttttgtttactttactgaaaataaacgtataggctgggtacagtggctcacacttgtaatcccagcactttgggaggccaaggcaggtagatcacttgaagtcagagttcgagaccagcctggccaacatggtgaaaccccctctactaaaaatacaaaaattagccggatgtgatgatgcatgcttgttgtaatcccagctactcgggaggctgaggcaggagaatcgcttgagccctggaggcggaggttgcagtgagccaagatcgtaccactgcactccagcctgggtgacagagtgagactgtctcaaaaaaaaaaaaaaaaaaagaggccgggtgcggtggctcacacctgtaatcccagcactttgggaggtcgaggtgggtggatcacgaggtcaggagtttgagaccagactggccaatatggtgaaacctagtctctaccaaaaatacaaaaattagctgggcgtggtggcacgtgcctgtagtcccagctactcaggaggctgagacaaaagaatcgcttgactccgtctcaaaaaaaataaaaagtaaatgtgtaaataagttaaaagtgcagagagtaaatgtatcccttgccacacagacacttctccagcccaccaggtgctgccaaagctgaggtgcatcccatagagcactggtctcaaaagcatcatggctgcctggggaattggctttatcttctactggaccagaagttctgagcatgctttcctgtgctaaacacactgcctggcacacagtaggtgcttgaatacccaaatggatacattatgagggaacccgccctcacttaggtcggactgcttagcgttgcccttctcatggcatgaagcccctggctgtggcattcctgaggaagactccgccgaccctgtcctgctgtgtgcatagaagcatgttctgttccttgtgggattgaacactgcaaactttccttcagcagactctcctcgctagttgcctttctctcaaattgtgccaatggtgagtaaaaggtgaaggtggcttggtaacagcagcttcccactgtgtctcaggtgccatgctaggtgcagtggaatccacaggtgaggatggtcactatgtgcatgagtgctcacagcactgggaggcctattgacacacagatccatgagtcccaggaagcctcactgggacccaaacccgaggaaagggcttattctgctccacctcttctatctcttctgagctctggctcctgtagcttttcctgtgcaattcagcagcaaagattttaccagtggagctgcatcgaacgccctaatgatttatttatggtatgcttgcctgtggcccaggacacctgtctgaagcctagactcttaaccctttctctgccagctgtcttacacattgggactgttagatgctgtctagcaattgggcttggaagagagatatgagaggttattatcacttatcttttaaaaaattacgtaagcaatcgaattgaatctttccatggtgtggaaactactacttagctaccacctggtgttttaacagggctccctttggtaatgctgtctccctgctctgtccaccacctctcggcggagatgataagaaggaccttccccactgggtgccatggctcatgcctgtaatcccagaactttaggaggctgaggcaggtggatcgcttcagcccaggagttcaagcccaggctgggcaacttagggagaccccatctctacaaaaaacttaaaaacaaaaaacaaaaaacaaaagccgagtgtggttgtgcacacctgtagtctcagatacttgtaaggctgaggtgggaggatcacttaagcctgggaagttaacactgcagtgagctgagcatgttaggatggggctgcgatagcgccactgcattccagcctgagcaacaaagcgagactctgtcccaaaataaatatataaataaataaaataaggcccttcccatctgcctggggccatggctattataagacaatggcttgagcaactggtgaatggctgggaagttatcagcaggctgtaggtcaggatctcaggccatccttccttcttagctacttggaatgaatattgaaagacacagtttcagggcccctcggccctgtgactcagccttcacctttgctctggtttcttatcggttagagaaatggatgaaaaaggtttccacccacagagctgctgtccagctggattactcagtggctgagaagcattttacacaacatgagggcttggaagaggctgtgtgtcaaatgtagttttggtagcgggagagccacacttgtagaaacaaagctgaggtgtacacttaggtgcattcacatgaaatgccaccaaccaaggtggtagaactttctaaattagctgcctgtgttggaggtgggattatatggagctgttcattttattcttttttttttgtaagtgtgcatatttcagattaaacagtacacatcaagtgttaccttcccactgagactacgctacgcctccctaattaaaactcatccaccaggcgcggtggttcatgcctgtaatcccagcactttgggaggcttgaggcaggtggatcacttgagaccaggagctcaagaccagcctggacaacatggcgaaatcctgtctctactaaaaatacaaaaattagccaggcacacacctgtaatcccagctacttgggaggctgaggcatgagaatcgcttgaacccaggaggcagaggttgcagtgagccgagatcacaccactgcattccagcctgggcaacagagcaagactctgtctcagaaaaaaaaacaaaaaacaaaaatctcatccccctgctgtacccccagttctctttccctactcttgttgtttttgttgttccgtagtcctaagtaacctagttattgctcaggcttgttgtcaaactccccaatataatgcaatctcacgagggcagggttttccctgctatatccccagcacctggaacaatgcaacatatacagccaagcccttcaatagcttttggctgaatgatggagtagacaagactttcaagaaatccagtcatgatttctcctcttccatctgacttttgcttgttgtttcgtttgttttgttttgttgttttgtttttgagacagagtcttgctctgttgccctggctggagcgcagtagcacaattacagctcactgcagccttgacctccctggctcaagcgatcctcccacctcaggctcccaggtagtggggactaccggcatgcaccgccaagcgaggctaatttttgtattttttgtagagacaggtcctcaccgtgttccccagactcaaactcctggtctcaaactcctgggctcaagcaatatatccacctcagccttccaaagtactgggattataggtgtgagacactgcacccgacctccatctctctttttctatgaggattgtcttttcagaaacacaaatgcgtatataattcattgtaattgagaagataatgtacacactgtccaaatatttttttctttctccctggcagtacatcatgagctcttttcatatcattacctacagatcgactttcttttttaaaatacctgcccagaattccattgtgtggaagtactgtaatttgtttcattcttctcctatcaaggaaggctttcctaggcttttggattagaaacaattctacagctttaaaggtgataaatataatagttaatacatgaacctgcgtgccagccatggttctaagcactttatatatccattaactcttttaatcatggtgacagccttagaaaggagatgccattactgccattttatagatgagaaaccacagagaattaagttatctgccccaggtcacaaagaaaatgaccaagaagagcttgagcccaactagtctgagccaacattcttaacctgtactttacatgtcatttgtgatgtagtttattgatctgatgtctttctatgagataagctgatggtagaattactaggtgaaagggcatacattttatgatgtgtagagggcaatagggacttctttaagagacagcgtcaaatgtacatttccacaattcacgttgcatttctcaccgtttcatcactggaatctgatgcacgaggaaaaggcatgtcatttaaatctgcattcttaagaactataagcaaagttgaatgtctttccctaattgtaaataacttgcttgttttgctgtgaactttcagcaagctctgcccttgctttattgggttatattttgtttttcattgttgtctgagtttcttattaaagaaattaactcttagcctatctgagggggttgatactttttcctcaacgtgtctttgtctctggtatcttttctgcgggaaaatttttatttttatataatcaaacttgccaacatttctgtttatagattttaggtgttatgtctgtcttgagtcttccccatgccaaattataagagaaaatctctccatactttttcaccccaaccattcttattgttttcattgttttatacttaagtctttgacctatcttcagcttatttttgttgtaggagtaagagagtagacagcttaatgtattctctctgaatggctagccagttgtctcagtacgtttattttaagtgaaaaaatacctattttgatttgaaatgcaatttagtacatgataatagcatctactgggcatgtttcaggatgattttattaaataggtttgtctattcatgaccaatagaaaactcctatagctcttttttttttttttttttttttttttttttgaggcagagtctggctctgttgcccatgctggagtgcagtggtgcaatctcggctcactgcgatctccacctcctgggttcaagcaattctcctgcctcagcctccctagtagctgggattataagcgcacgccaccatgccaagctaatttttgtattttgagtagagacagggtttcaccatgttggccaggctggtcttgaactcctgacctcaagtgacccgcccgcctcggccttccaaagtgctgggattacaggcataagccactgtgtctggccagaaaactcctatagctctatagtaagtatttaaatttggtaatgattgctggtctgccacctacccaattcctgctatttttcaaaattgtttcactctttgttaagttttatttttttctggatgtactttagaattagcattttagttcctaagaaagccttcattagggttgcattaaatgtatagatacctttaaggtgacaggaaccttgaatatttcaggtatgtctttccatttttctagccttcttaggtacttcagatctaaacttttaaaatataggttttacgcatttattcttatatacactattgtgaatagcatctttttcatgacttctaaatcagttatttgtataaaatataggaaagctattaactctctgcataccaattttagtaactggccacctccaaattatctcagtaattataaaactgaaacatactagttacctcttatttccttagagggtttttagaatttctcctctcagctctttttttaaattttgttttgttttttaattgggagatatgaccacagatttttatgtcagatctgaatgttgaccccttggattttgaatcattttaaatagcttgggtagctgagaatagcttcccttgggggacaatctactgggctttttccatatgatgcttttctttgactgagttttgtgaagcaagatcattgtctcaaatcacctcatctgtcatatccctagtagaagaaaactacttatgatacagaaaagcaaactagtttaagaaatgattttttaaaagcccttcatcccagggctctgaggaaattgggtgaaggatcttgcaacagaacacacacctggttcacgttcatagcatataaaggaaaaggttatcagctctttccaggtatgctcatgatgctaatggtttgtaatttcatactggccttttgtcattacttttgggtttgtctagaaatactgactctgtagtcaaggactgagagagaggtttcctaggttgagggtggcaggaatgtaggaaaaatgattttagaagctgggttagaaatggaaatcccagctcaaaaagcaaaactttcatatacagcctcgtaaataacacacagttccctttggagtcattataagttgtaaagacttttgacatagtctctaggagagagtaggtaattcctagtatggaagaatgtgttaactaattgggtgtaagaacttgaggatgctggtctcctttttaattagctttctatcaccataggatgagcccatacatgcaaaagaacacagaaatcaattaaatacaaattaatgaaggcagatttttttaaagcttataattgcaatttatgtcttattattgcacaaaaaaataatagttctccaggcctaaaagcaaaggtaacagaatgatttatttgttcctttttttttttttttttttggagacagagtcttgctctgtcacccaggctggagtgcagtggtgtgatctcagctcactgcaacttccgcctcccaggttcaaggaattcttgtgccagagcctcccgagtagctgggattacaggcatgcgccaccaagcccagctaactttttgtatttttggtagagatggggtttcgccatgttggccaggctggtctcgaactcctggcctcaagtgatctgccctccttggcctcccaacgtgctgggattacaggcgtgagtcaccgctcctagtccagtatgatttatttcttggctggactttctacctacttatcccatgtagataacttcattccaactcttctaagcctggaggagtagaaggatcttgaatagtccttaatgtgtgtcagaaatacacccctgtcaccagccaccatccctatccaataccttaccaaagtattgattagggagcaatcctctccagattggcctgaatgacttcttatgatctaagatttgggggtttaagggtggggtctttgtactgcagggaaaatgagttaactgagagtatatggaataaacaattgtgacctggaaaactgttcatttgctcaacaaccacttgttgaaagttttttatgtgccaggcatggtgggggcatcagagacacagcagtaaacaaaattaaaatctctgttccaaagagaacatcagctcagttggcacaatgagtgataaggagctaggactatttcccagtgaacagtgtcatggagaagagaacaaagtccatgacactgactggaaaggtaaagacaatattcaataaggtgatcagaaacagtgagcctccgaggaagtgacatttgaggtgaggcctgacctatcagcaatacacaaccatttcagatctggggaaatgttccaggcaaagagaagagcaaatacagaggcttccagatgggaacagacttcgaatagggtttgagtgggatatatacataggaaaaatacaatcttttaaaagatagagactatcaaaagaaaatgatttttagccaatagggatagtatgaaagattcatagcaataaacatagttgaccaaaaatttaaatattagagtagaaggagccatttaggacatttatccaaagaaaaggagactaaatgaagacatgctgccccaagtccacaaaaggaaaaaaatccgaagctgaatatggggtgatcataacctagacaccaagaatggtccaggaagcatgcacagaggtgtgaaggcagaaggcgtccttcagctaacttgggaataaaacatgttaggagccaggagatgagtgactgtggctccagtcatccatccacaggagaggggaaggccctggagtggatcaaggacaaggatggtggacaaatgggcatcctggggtctgaggccaaggcatgtcaccatcaccacgtcaaaaagtggagtaagccttttgacatgggacatcctggtgtgtactggggcttgttcagctatttgtatattacgtgaaacaggaaatcccagacacagcatgacagagccctctttcctcttttctttaccactattgtgcttttccctaccgtaaccaggagtgatgttaaaaggaagaggaaatgccagtcacgcccactgcttacaggggattctgtggagtgactaaaccagagctgtagtttgagtcacacaggacgtgtgacaaaaggagggtgacttttttcccccttgtttctttgaacttacttggaagtgttaacagattctaatggttagaatggtaaacagagcttcctactcctgtcgtggtttgacccaggagtctcaccttctctcaggcccttagtttcttccacttaaacagtgagagagttacatgatatggttgcaaatcctctcagcgctaatcttgtaaggttaaaaatgtttgagtgtattgggcattaaaaaggagactatacaccaggcacagtggctcacgcctgtaatcccagcactttgggaggctgaggtaggaagatcacttgagcccagcagttcagaaccagcctgggcaacatagtgagacaccatatctaaaataaaattgttaattgtaaaaaaataaaaataaaaaagagattatcaagatagtaaaaagacaacctacagaatggaagaaaatattgcaaatcatatctctgataagtgttgtgtgtatatatatatatgacctaatttttaaatgggcaaaagacttgagtagacatttcttcaaaaaagaaatacaaatggccaagaagcacataaaaaaatgctcaacatccttagtcattagagaaatgcaaatcaaacccacaatgaggtaccatttcacacctactagaatggctatttaaacagacaaagagaaagtagcagtgttagggagaagggaaagaaattggaaccctcttacattgctggttggatataaaatggtgcagctactgtggaaaacactttggtggttccgcaaaaagttaaatataaaattcgcattgactcagcaatttctctcctaggtctacaccctaaagaactggaaaaagatattcaaacaaaaactgtatagaaatgctcgtaatagctttgttcacaatatcaaaagtagaaacaacccagatattcatcaactggtagatagataaatagatagatagatagatagatagatagatagatagatagatagagtgtagtctatccatacaatgggataacattgagccataaaaagaaacgaagtacagacatactaccccatcaatgaatcttaaaaattatactatgtaaaagaagtcagacacaaaaagtcacatatatggtttcatttatatgaaatatttagaatagataaatccatagcaacagaaagcagcctaatcctttctctagaggctgggcattgaagggtttgttaatgggttcagggtttcgtattttatggtgatgaaaatgttttggaactaaatagatgtaatggttgcacaacattgtgaatgtactaaatactgcccgattgtacattttaaagtggttaattctacattatgtaaattgtatctcaatttttttaaaaattgaggaagggccaggtgcaatggctcatgcctgtaatcccagcactttgggaggccaaggcgggcggatcacctgaggtcaggagtttgagaccagcctggccaacatggtgaaaccctcgtctctactaaaaatgcaaagttagttgcgcatggtggcaggcacctgctactcaggaggctgagacaggagaatcgcctgaacctgggaggcagaggttgcaatcagccgagatcataccactgcactccagctgggcagcagagccagactgtgcctcaaaaaaaaaaaaaattgaggaaggaaccatgtgaaattctgtgcacctcctacttgagttggatacctggtcagtggtagcaaactaagcaagctatttccattgacaaatacaaataaatccttccttcattgtcttcctcaaataaaatcccttgccaatataggcaaggtattttcattctcatgaaactgtggctttgaaatgtgtaaatatctcccttgtttgtaatgaagtggtcagtctcgttctgtttgtgggcaatatgattgaagtctgtctcaaaggagtagtcaaacattaacagaccgtgatccaaattaaactatgaaatgtgttcttgtttatcccatgccagactcttaaaaacggttgttagttaaaattgaggtttcaaaaaatgcagtcttctggattatctagggagggggcagaattctgacaatctgtgacccatagtattgttactatatggtaacaatcacctgagattgacagcaggtgcccccttgagacgccatagattctctgtcccttttctcccatatgtattaccagtcaggttattcactcttcttcctgaccccacccccatatcaccacaactgaacagaaattcaacttttagactctgattcaaagacattgtttgcaaagtctcctattaaaatataaatgtgccatctggaagaagagggcagaaatccttagtgcaaccatttttttccatagtcgaacaggagggtgttggtaaggatctcttaatttgtgggtgggattgaggcagagggaaaaagcccagataaaatatcaccagcttggggtggtcgtggtggctcacacctgtaatcccagcacttcgggaggccaaggtgggaggaccacttgagcccaggagtttgaaaccagcctgggcagcatggtgaggctgtgtctttacaaaaaattaaagaattggccaggtacggtggctcacacctgtaatcccagcactttgggaggccaaggtgggaggaccgcttgagcccaggagtttgaaaccagcctgggcagcatggtgaggctgtgtctttacaaaaaattaaagaattggccaggtacggtggctcacacctgtaatcccagcattttgggaggccaaggcaggcggatcacgaggtcaggagatcgagaccatcctggccaacatagtgaaaccccgtctctactaaaaatacaaaaaagtaggccggcatggtggcaggcacctgtagtcccagctacttgggaggctgaggcaggagaatggcgtgaacccgggaggtggagcttgcagtgagtcgagattgtaccactgcactccagcctgggtgacagagcgagattctgtctcaaaaaaaaaaaaaaaaattaaagaattaactgggtgtggtggcacacacctgtagtcccagttattcaggagcctgaggtgggaggttcacttgagcccacgaggttgaggctgcagtgagccagagttgtgccactgcactccagcctgggcaacagagtaagaccgtgtctcaaatatatatatatatatatccagtcttgtcacaatatcccagcctgaagggagtggctggtggcagactggatgggagagcacaaaacaggcacgggcttctcctcccctttggtactgccacctgctttttcaatttcacagtcttccctgaggcagtcctcccttctctgcctgggctttatggctagtttttgaatgcttttgcctcctggagtacctcatcatacaagtccaagtaaggctgaattccaaaaatcccaactctcagaatcctgccaggtggtcacaatagcacccttgtttttatgtaacctagcacccatgggacctggcttttatttttgtttttacttatttttctccccctaaatgcaatatggaaagaaccaaggagttgaggactattatcccagtttctggaagttcagttttctcctctaaaatggaaagggactctccaaaatcaggtaataactaatcgagaggcagaaagatagtaagagtggcccagggtttcttgtgactgttcctgcccccacacaaaattcctgcaccttgtggcctttcttagactagagtgaagtgtgtttccattgttaaagatggttccaggtggcagctaatggcagctgtccaaagctctaagggcaactgtgatcttgatctgatccaacttttaattgagcttgctttgttcttttgattttcagtgggcatgtgtggcctcatctctgagctattgtttcatcaggcattgcagtaaactttgaagaatgcaaattctgaacttcatttgctgtcacctggaaggtgctagacaaattcaatccccttgaattctgtgactagaacctataagaaaaaatgaattgtcgttttgtaggttttcatagagaagtagcaatagggaatgatgggtgaatttggacaagtcactttatcccaaagcgtccatttgctcttctgtgaaatactactttatagtgttgtttggcctaaattaaacaaaccatgcaaaaagcccagccctgtgcctggcatacagtgagtgctcatgtgtttgctgctattatattctcctaatccagtttgaaagctgtgaggcagcaactttccaggaaaagatggcttcagccaagggtatgttcctaggacctaccctaaagttagtctctcctattagagtagtttgaagctgaacttggctgaaaactataagaaaggctggtttaggggaagcctttgttacttttagtttcttgagatctcttcttgacctaactcttcaatgctcaccacgtgtcatccattctccagcactgtttctgtgtacctgactgacagtttgcctcacagtaaaatgattcctctgggctccctaggtgaaaggatgttgggcatagcaagttgtaatgctgttgatctcagaaatccttccgatgctccaaaaaataaagcaatgagcaagacatgtctagccagcaggaaatatccttcatacaaaatggttaatttctaaaacctgtggcatcaccttgacagatctcttctgtttggtttatacgggggaatccaactggaagagtccttcctgacccttggtctgcctgggcagaggaggtactgtcctctgaccatcagattatgttgggtctagcaggctgccttcttccaggctttgtgcaccaacattaaaaaggcagtcatttctcaaaattgtttgggaaatgattaacttgtttcctttgatcctccctgctctgtgtgaggacagtcaagtagcaggggtggagaatgtgttctattattttcaacagtgctaagtaaacactgggggaaattctgccactagagaggtacaactgtgtttgagggtttgaaggcgtgcgcgcgtgtgtgtgtgtatgtgtgtgtgtgtgtccttctgaaaacatagagctattgagtacaaaaatatggccatttcctctaaattttctttcccctgttttttttttaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacaatcagtctgtgggaattgaggtaatttaccagtcatccttttagtttgtcaaccttcctcaaactcaaactgtaactccaaacctagggatagctcatgaaggggattgggtgcagcatgggaaagtaaagctttcatgttaccaatcaacaggcaatatacaaatttaaacttctattactggcacattttcttttgtaataaggacagttgtatgatgtcagtaatctagattggagttggcaaacatagccatgaacaaaatccatctttttttgtgcatctggcaagtaaagaatagtttttaccttttttaagggatgagttaaaaacaaaaatgggaaagatgaggcatgtcccacaaagcctaaagtgtttgctgtctagccctttgcagaagtagtttgacaacccatgatctaaataatagtgtcagaactttggggacaggatgacattttcattgagatacccagtgtctgagaacaattaagccatttcctccagttaaattctagtttgagttaaatttatttttcttaacactataaaaattgaattaggctcactcccccgactttcagcaaattccccagcttcctgtatctatgagcaaattgaaagttccaagaatgttctcttcgtttatccttccttctgcgcccatgaatatcttcatctgttttcatcttctaccctcttcagagaaaaaagcattcctgttccttcacaaggctaatttcttctgttgtttttacagtcttctctttccaggatagaaggaatcttactccaagctacctctactctccagctcctctcccacctgtgggtacatctgcatgttcaatgtcttcactgacatcttcccgtcctgctgcattccaccaccacctctcatgcctttcctttcccaccagagttctttgagagtagtttgcttatcgatttcctcttctgaacttcaacccactgagatctgaccttttaccactaccatctcctccaaagtgctctgaatcactcataacctaacttctaaattcagtgacttctctttcagctttcctctcaattgacttgagacttctttcttgaaactcctcctttcgccttttataatatcattccatgagatttcttcctaatttcaaaacaatctttctttgttctttcctctcttcataatagggttttattctcagcatctcttgattcctctgcagcaggggttggcaaacatatgctgtaaaggccaggcagtaaatggcatagaatttgcagaccacatgggctcttttgcaacgactcaatgctgctgttgtagaataagagtacagtaccagacaacatgtaaacaaatgagcatgactgtgttccgataaaagtttacttacaaaggcaggtggtaggccagattcagcctgcagattatagtctaccaaaccctcatctaaattctcacagctaagaaaatacctcctcttttatgacttgaaaatgtgcctaagtctgtgacactgaaatctgattttctattctgacctcagtgatgcttaagtaacttaagctctccatgtcttttcatgcatgttttctcccttcacacacacacacacacacacccctcctttcctattctatttcagttaaatgtatctcttcttacccagttgccaaagttaatagtctgaaacatcttggattcttccttcttccttgactaggcacttaaacagacagcaagaccctgtcttccttcactagacaaggaactttatttttgctattttctgtcttaacgtgatggcccatgtaaattttccctgatgtcctagactaagtcagatctcttgttacatcctcgtgtgttttcctgtacttttatagctctcactttggatactaatttacattgttgaatgcttatttaattgttgcctgttcttctctacacgaaacttcatgagagttggaccactggaccacacccgcagcacctgttgtagctccagggtccatcccagggccctgatcctgtagatccagctgacatttcagatagattcctagctactccctttttctttttttttttttttttagaggaagtctcgctcttgtcccccaggttggagtgcaaatggtgtgatcttggctcactgcaacctccgcttcccaggttcaagcgattctcctgcctcagcctctcgagtagctgggattacaggtgcctgccaccacacccagctaatttttgtatttttaatagagagagggtttcaccatgttggccaggttggtctcgaactcctgacctcagatgatccacctgccttggcctctcaaagtgctgaaattacaggcgtgagccacagcgcccagccagctaaccccctttttcttgaatacgccgtcctctagctgcccacccaactctgcgctgcgttttcttacctccatgcctttgctcaggctgttcctccactctggaattttcttttttctcctttaccctacccaaatcatatcttttgccaaatgcctacttgtcttcaaagtctgtattgaaataccatttcttctctgtaatctttctgcttaatacagaactggttgcttcatccccaccactaatccatttcctccaaattcattatagcatgtacatcatagtattatatttgcattttttccttatgacctacccatactccaacaaccgtagtgtgtgaggtgcttaagggcagctattttgtcttaactcacatctacagtatgtacagagtacctagaacacatagtatgcattcagtagaagtttaaactcgataagataaaaaagatataaaactatacatatcatctctcctccatatatatacacacatggatgccaggagggttaccaaaaacataacagtggcaatctctgggtgggattacagatccacttttcttttttttttttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacagatccacttttcttaagcctttattacacttttgtattttcttttttttttttctgagacggagtctcactccgttgcccaggctggagtgcagtggcgcgatcttgcctcactgcaacctctgcctccccggttcaagccattctcctgtctcaacctcccaagtagctgggactacaggcatctgccgccatgcctggctaatttttgtatttttagtagagacggggtttcatcctgttggtcaggctggtctcgaactcctgacctcaggtgatccacccgcctcagcctcccaaagtgctgggattacaggcgtgagccaccgagcccagccactttcctattttctaaaatgtctacgatgtaaacatactatgatttggggatttttaaaaatcaattgactagcgaagagaacattcccgtgacctcaaaatcggcatttatggtctctttaattcaattcataaaggttttggaaagagtgaggggagacttgaacttggcctaaacttggtcttgtgtcttagggaggagcacggaagggggtttcccagaagaacaatgacctaacaagttgctgcttctcagatgccaagactatgtatgaggttttccaaagaggactcgctgtgtctggtaagcctggtggtctgtccttgcctgaagaagacaaggtgaggtctgtggcccatctctctttctctgtctcacttctaaaaccccagctatttagatgcagtgatccaagtagaatcgcaacatgcaaaatagaggcaacattagaacatagtattaggatgggcgttggaaccagtgtcagacggacttaggtttgaaacctggttcttccatttccagcttcataaccttgtgcagaccactttgcttctctgaatctgtttctcaacacaagaagaacgtccctgccaaaactgttgttaaagggtcaaggagataataatataggacagtatctttaactcactagtacctcatatttgtttagaaacatgcctttcattaatgtaattccctgcatttacagatagacaatctgagccaggactagcagtccaggattcctgatgtcttaccttgtccttaactctgataccatcctactgaccaaagttagcacttctttggacttttttagagactaccaaatgggctttgacacgttcatttggaatacatcaagccttaatatttatatcttatatcattgaacataatgcctggcacacacacgtttacttttaaaagctgctggcttatagctctttctgtgcctttggtcttttgggtgacattctggccgtgtaacttttatccgtcccttgacttctgcatgttaactaagactaagagcatattcatagccaactcctgtcaagtgttaactatacaatagctactgcacatatattacttcatcttccctaaaccatagagagtggttactatcactgccatttttaaagatgaggacccagactcacagcttcaagaccattaccaaggtcatagaactagaaaatgtcagagctgataggaaaatctaagtgtgtctgtttgacttggttgttctattttaggttagctcgtaagtgttttataaaagtagtcactcctccagacaatgaaagatttattgtcaagaaaacatctatctgaagagtccgatggggcctgtacttagtatatctggctccaaatcagcatttacttatagacttcatgcaaataacaaataaaaacaaaccaaacatcagtttctttacttctctggcaatttaagatagtatatgtctaatacagtataatttcctttggggttttttccttttttttcagagacgggatcttgctctgtcacccaggctagagtgcagtggtgtgatagaatatagctcactacaactttaaattcttggactcaagcaatcctctcacctcagcttcccaagtagctaggactacaggcatgtgctgccacacctggctaatttttttttcctttttttcttttcttttttttttttttttttttnnnnnnnnnnnnnnnnnnnnataattggacagctaaaaactcccatcctcaattcgagcaacggcacccttttttttcagagaggggattttgctctgtcacccaggctagagtgcagtggtgtgatagaatatagctcactacaactttaaattcttgggactcaagcaatctcttcacctcagcttcccaagtggctaggactacaggcatgtgctgccacacctggctaatttttttttcctttttttcttttcttttttttttttttttttttgagatggagtctcgctctgttgcccaggctggagtgcagtggtgcaatcttggctcacgagcaacctctgcctcccaggttcaagcaattctctgcctcagcctcccgagtagctgggattacaggcacctgccaccatgcttggctgatttttgtatttttagtagagatggggtttcaccatcttggccaggctggtcctaaactcctgacctggtgatccacccaccttgacctcccaaagtgctgggattacaggtgtgagccaccatgcccggcctacacctggttaatttttttaattttttgtagagacaaggtctcactatgttgtccaagctagtctcaaactgacttcaagagataaccccctccccgactccagcctcccaaagtactgggattacaggagtgggccactatgctcagctctagtgattttctgtttttagaagttttctttattgaggatgtgttgttattgtgactaaaacaagccatttagcaagtgatatgtggcacatgagagatataatttaggatttttttttaaatactaaatcctaaaccaataccgttgaaatagcttctcatggaagcaggcgtgagaaatctggtgtggctacttacatagaaaaatgatagccaggcatggtggtggtgcctgtaatcccagccacttgggaggctgaggcaggagaatcgcttgaacctgggaagtggaggttgcagtgagccgagatcgcgccactgcacttcagcctgggtaacagagggacactccatctcaaaaaaataaaaaaagaaaaatgacacttctggtcctatctggggttgcatacattagccttagctagtagtttgtttatcttgagactcacttggggctactgtttaaaatatatatcttctggttacaccttaggttcactgaattaaatttccagataatgaaacctaaaaatcctcaggaagctttgtatttttagcaacacttccaggggattctgtataccagagttggaattctacttagtttagagggacaactttgccaagaatttgttaatggatgggctctttgtagatggccacagcttagaacagaacaggtctgagttgactaagttaatgaaaggctaggctgttgcctggtcaggcatttggctagtaggctgaagctgatcaagtcacagagtttaatgagacctgagttgttgcccctttgggctaattatttgacttattccttagacaccagcctctgctagcatttttatcaatcaagaggtgataagatgcagtataattccttcctggaactctctctctcctttctttctttctttttctttctttctctctctttctttctttctttctttctttctttctttctttctttctttcttccttccttccttcctttctttctttctttttctttctttccttctttctttctttccttttctttctttctttccttctttccttcctcccaccttctctttctttctctctctctctctctctctccttctgtctttctttcttcagggtctggctctgttgcccaggctggagtgcagtggcacgatctaagctcactgcaacctccacctcctgggctcaagccattcttccacctcagtctcccaaatagctgggactacaggctcatgccaccacccatagctaatttttttatattttttatagagatggagttttgccatgttgcccaggctggtcttgaactcttgagctcaagtgatctgccaacctctgcctcccaaactgctgggattacaggcatgagccactgtgcccagcccccagtatactttcttagacattcatcagctctaccacttgctgagtgagcttaaccaagctgtctcagtccttcataattcttagtacaatacaaatgataatagctgggaagatgagttaatgtgcctggcatggagtaagcatttaataaatggtagctatcattagtgattaatgttagtacaaatgatctcaatgttagaccacccaagacacacaccctgggggagcaagtggcttccactctgacaaagccatgcttcagggaaagttagtctgagacgttacttctaaggctttcatgcagctgtttcaattggaagcaaaagtactaatgttttctgtacacagcctcctcattcatttttatatctctttaatcagagtgggtatctcttccctgctttccttccttttttttccatctcttagtctagaagtccacttacttgcctccgaattcctagtaactctctttctgaataattccttttggcaagacctgaattcctcttagcagtttgactagatcctctctatacattttcctgcccttctacttgtctacttataacaacctccttctggcttagacgtgagggcttctaagccacttagtgtgttcttcagcctaataccactacttccttgacttagctttaaaagctgagatgccatttattcttgtaaatggatgttcccaaacttattttaagtaaggctgagtagtttagatattcagaagtttaattcttttattgtcaaatgcaagatgtaaattggaaaaatactgaagacaaatgcatgagtgtgtgcacacctctgtgtgtgtttccgtgtttttttacaagccttgatatcttagaagatactctcatacaaatgggcaaagtacatgaacaaacaagtcatgaaagtaaataaaacctaacaaggaaaaaggtcccactttactagctgttaaagaaacttagactatagtaataacttttcaaacctatcaaacctgaaaatattttcgttttgttttgttttgagactgagttttgctcttgttgcccaggctggagtgcaatggcacgatctcaactcatcgcaacttccacctcccgggtgaagcaattctcctgcctcagcctccccagtagctggaattacaggcatgtgctgctgcacccagctaattttgtatttttagtagagacggggtttctccatgttgggcaggctggtcttgaactcccaacctcaggtgatctgcccgccttggcctcccaaagtgctgggattacaggcatgagccactgcgcccagccttgaagaaagtttttaaagacactatttagcagtctaggagagtgtgttaaaacttgatatgataggagaaaagtgaattgtcacatctgctccagtaagcagtgtggtctaggtatcaaaagcctgactgttctgagcccctattcccttcccttattatattttaggggctctattctaaggaaatggtctaaatttaaaaggatcaatttgaaaatatttagcgtaatttaaagtgtcaagcttgaaaacaatctaaatacccacgatgaaataaagtcaactataatagaacccttcatcgactggccattgaaaccactacagagaagagataatgacatgaaaatacttaggtcagattgggagaggaagcaaggtatcaaagtattatattcattctatacatggggaatgaacataactgtcaaactatgcaaaagggccatgggataatatatcagtgttaataatggtatttgggtgatgagattgatgattcatattttaacttttttatatctttatgagcatagtttttattgtagggaagttcaatccaagattgttcaatacaggctgtttgtgtttacttgtaggctttcacttggtcatgttttgtgggctaaccccatatggatggctttctctgaatgtctacattatcatggaggttacatattcaacactgaaccactcctgttttgtgtagcatttcctaaatgtttcaactatagtttataggactcttcatttttgaggactcagtgctttctgactttgaatttcctggacatataatagaagctcaaatccttgttggacttaccctttgtgtcttgccccttcttaatctccttttagcttccttggtccagagaatttgcaactggagttgattttcttttaatattatgtttttagacaatgggccctgcttgggatatagaaaaccaaaccagccctacagatggctatcttacaaacaggtaagttgagtccatgtttttagacagattctttctaacatagtattctgaactacaggatacgatattggtcagtttttggtcttgacctcttctctctctctctcaccccatctctcttttttgtaggtgtctgatagagcagagtacctgggttcctgtctcttgcataaaggttataaatcatcaccagaccagtttgtcggcatctttgctcagaataggccagaggtaactatgttgaagttaactaaaggaaatgagtcagggttaagtttaaaaacttcaaatgctattccccgtccagcattccaacacttgttaatgccttaccaaagctattgttaaaattttctaatgcttattctacttgaaagagttaccactcagaacctatttaatttctggttaagtgtctggcactctcacctaggtgtttggacttctcttttttctcagcctatcatgtgttttttgaagtcagtctgattgttacatgaggaaaataaggaagctaggagggaccgccaaataagatcttgaagatattgtggaaagtatgtattagtattagaactgaaacttgcaatttgtaattgaactagtaaattcagccattcattgctactgagtctggccatagctatctttccacagtgagttggaagcagattttagacagtaagatgacagaatcaagcttatctccaagttttggttaagtcattaggcacattatccccagaggaagtctttttatgcttcaaacgctccctagaaatgcagcatatgatacatataacatacaaaatctgtgttaactgtctgtgttatcagcaaggcttccagtcgacagaagccattagtagttaagttttgggggagttaagttctatgtggatcttgttgaaagttcacaaactgtaagtcccatttctaatgctaatacaaatataaaaatattcaccaacatttttaggtgaatctgcatactccattcttgtcacagtcagcctcaatagaaaaaggttcccttgactctagtttaggaacttaacacctaatctgatacagttaatccttgaacaacatgggggttaggaccactgcctattcagtaaaaaaatccacagataacccccccaaaacttaactactaatagccttcctttatgataatataggtagttgattaacacatattttgtatgttatatgtattgtatactgctttcttacaatatagtaagctagagaaacaaaaatgtcattaagaaaatgataaggaagagaaaatgtatatactattcattaggtggaagtggatcattataaaggtcttcatctgagtcatctttaccttgagtgggttgaggaggagggagaagagaggttggtcttgctgtctcagacctggcagaggtggaagaggtagaggagatggaaagagaggcaggaaatataggcaccctcaatgtaacttttattgaaaaaaaaaatccacaagcagacccttacagttcaaacccatgtgttcaaggagcaactgtatattagtctgctagaactgccataatctaatacacagaccatgtggcttaaacaacagaaatttattttctcacagttctggagtctaggattccaaggtcagagtgtcagcaggtttagcttctcccgaggcctctctccttgacttgtagacagccactttttcattttgtcttcacacggccttttctctgtgcacatgtatccctcatgaccgttcttcttcatagaaggaagggattaggaccccacacttaaaacttcatttaaccttaattacttatttaaaagccctatctcatatactgtcacattggggattagggtttcaacatgaatttgggttgggccggaggaggggtgacagggagacaggattcagtccataacatctacattgatatttaaggcccatcactagcagattcctacctacctttccagttttatttcctgtagtcttcaagcttgctaatgtgtatccacacaatgatgtcatgctgtctgtattagttcgttatcacactgttacgaagaaatacctgagactgggtaatttataaaggaaagaggtttaattgactcacagttctgcagtgctggggaggcctcaagaaacttacaatcatggcggaagggaaagcaaacatgtccttcttcacatggtggcaggaaagaaaagaatgagagcaaagggggtggaaagccccttatgaaatcagatcacatgagaactcactcactgtcacgagaacaatgtattagtctgtttttatgctgctgataaagacatacctaagacctggaagaagaggaggtttaattggacttacagttccacatggctggtgaggcctcagaatcatggtaggaggcaaaaggcacttcttacatcgtggcagcaagagaaaatgaggaagaagcaaaaagtggaaacccctggtaaacccatcagatctcatgggacttatttactatcatgagaatagcacaggaaagaccagcacccatgattgaattacctccccctgggtccctcccacaacacatgggaattctgggagatacaattcaagttgagattttattttatttatttatttatttattttttgtgagacggagtttcactctgttgccaggctggagtacagtggtgccatctcagctcactgcaacctccacctcccgggttcaagcaattcttctgcctcagcctcccgagtagctgggattacaggcacatgccaccacgcccagctaatttttgtatttttagtagagacaggatttcaccatgttggccaggatggtctcaatctcttgacctcgtgatcttcccatctcagcctcccaaagtgctgggattacaggcatgaaccactgcacccggcctcaagttgagatttgaatgggtacgcagctaaaccacgtcaaacagtatgagggtaaccacccccatgattcaattacctcccactgggttcctcccacgacacatggggattatgggaactacaattcaagatgagatctggatggggacacagccaaaccatatcactattctttgttcattcacttccttcttttaatctacctctacctccataaccaaatcctactagtcctctaaagccctgcccagttttcatcagtttcccacaagcagtcccaaatagctttcctcacccttgaaagtgatctctgacaccctaaggctcctaatgccttccatacctcttacggatggaacttatcacactctgcctttgtattctggtctacctttgtattgcagttgtccctgtgcctttcttatctcccttatttaattgtactttatagcagtatttacaactgtccctatggccccacagtgatttttttttttacataaaagtcaacaaataagtaatcccagcactttgggaggcccaggtaggcagataggttgagcctaggagttttatgccagaatgggaaacatggtgaaatcccgtctctacaaaaaatacaaaaattagcttgacatagtgatgtgtgcctgtagttccagctactcaggaggctgaggtgggaggattgcttgatcctggaaggttgaggctgcagtgagctatgatcacaccactgcactccagcctgggcagcagagtgaggcactgtctcaaaaaaaaaaaaaaaagcaaaacaaaacaagacaaaaaaccagacagcatttgttggctgaatgactgaactggtactcttcagtgtgccctccagtccttacttgaacttctctctgtacagtggatcatctccgaattggcttgttacacgtactctatggtagctgtacctctgtatgacaccttgggaccagaagccatcgtacatattgtcaacaagggtaaaattttgctgttacattacaacttgattctttctcaatgctgagtatttcttcaatttctgcttttttgtttatttgtttgtttgtttaagcaaacttgaaatgctgtggtcggaaaatgttcaagtctttctagttttgtagtacttaggatataattttcaggaaagctacaaaaagcccatgaagcagagatacacacagaaagaagtttcaatgacatgcgtcagggtgacatggtatgatgatatagagacaagactactcactctgaacacactagataaaagcccagagagtgagcttaattgacttaatcacagtaaagctacagatttaatttcctacctttgtaaatccaagtcaatacagttaaccagcatgtaccaatgtccatggtgagtctgcagaaaataattgtcgttgttagagaaacaagtccaaatttgatgggcaagtaacagccctttcacatatccaacatgttaccttctgtcatgggactagtagattaagtgagtaagtccatttgcacagtaaacatcatttgaaactttaaacatgcatcaaagcaaatgctaaaatttagaattgtaaaatacttgtcagctaaaaatcctatttgcccccttctttttcttctattccctactatcctcctcaaataaaacagtgatagaaccacacctcagtaacctgtttaggttatctgaatgacttcttaagcagaaggaattctgtggttcctctagaaactgtaaaatctgctggcacagttcaagaacatgtgcttctgtttcagttaagttcatttatcatcaatggaatgtttcaggttgtacattataaatctgatttgcaggtgtaatctcctttggacacctgttagctttgaaaacttttaaaacctcttccttcttgcaaggcaatcaggtacttagcagagagagggaatgacctctggttctattttggcttccagctgatatcgccatggtgatctgtgacacaccccaaaaggcattggtgctgatagggaatgtagagaaaggcttcaccccgagcctgaaggtgatcatccttatggacccctttgatgatgacctgaagcaaagaggggagaagagtggaattgagatcttatccctatatgatgctgaggtatggatctgaaatttagcttgcagctccaatgcttgtccaacaccttgggcaacttgcaagataccttcccaagaggacagtgttcttgttctccaggggtggcacatgaggagtagattagactcatgctgtgaagctctgagaataatttccacaagacaactttgaaactcatgccaggagaggacaaagttctgtggccagctgtatggacttctaagtggataatatataaataggggtttagtaatagttaaaggatgtggctcctggagccaggctgcttgggttcgcatgccagctccacatctgttaggcaaccttgggcaatctcatctcccttctctcggtccgtaaaatggtgataaaaataatcactacctcacagaggtcttgtaaagagttagcttaattcatatatgtagatttctcaggacagtgatggatatgtaataagctctgaaaatgttagctattcatttctttcaaaaaagatttagttagggccctagatgactgaaacttaagagtacaatgggaagtttgaacatgcaatctaccctctataggtagatgattttctagagaaatcttatgctcttccctggggcttccattgttcctgaatgttggcttctggtcctgatccaggttggaattttgcttatattcccatagagatgttctcacgggaaagggagggagagggccacatttatcacagtctgtccatctcaactaatgtctttctttcttggttttccattcacatagaacctaggcaaagagcacttcagaaaacctgtggtaagttttcttctgcctgaatttgagccttgccatagtcaactctcaaagttcatggtggaataagcccttgtgcttcctcctccagcctcctagcccagaagacctgagcgtcatctgcttcaccagtgggaccacaggtctgtgcccatgaaactgaaccttagacccctggtcagccaagaacatggcttcaattcttggccactggtaggctggtaaatactccctctaaagagccctatacttaggggctcacagcctaaggcttctaagtgtgaattcccaaatggaaaaacataaacataagtaaatacactttatttaatatattgggaggtgtttatattcaatagatttcaggggtcttaaagatgatgtcagaaagtcctttcccccgcccccaccaacccaccactctcttgatttgacaccgctggaatggtttcattcaatcaagataactcagtgatagttctccataaagggcttcaaccccaccctacatccacccatctgttagaatgcttaatagtttttaatgtggtccatcatggtctacagttatattctttctagtatgcccagtttataaggtttataaccatatcactatataatattggtagatctggaattccaaacatataaacagcatgagatgtggggcagagggacaaggagggttaacttgaatttttctttgcagctgtgcttctatctgaaatcatggctgtgctctgcatagtagtagaaggccaacgatgcattcagcagtagaatctccgggggcattaattattcctaaacagaggcatataccatccacaaaaagacacagtgacaggaaatgctcttggccttctggaataaaaccaattgaatctagtttctttcaaggccaaaggctacctattagctacataaagtatctttctctccacctcttatttcctacaggtgaccccaaaggagccatgataacccatcaaaatattgtttcaaatgctgctgcctttctcaaatgtgtggaggtcagtggtcagttgaaaaagaggctctcattaaaatgtgaatctgtcataagatttttatttttgaggttagagcaggcagacacacacacacacatacacacacacacacacacacgttaaaggctggagtgtggacaaacaccagcgtgttctttgtttagaggactgtacattttcaagcgttggtcttttaggatcactgcaaatttctacactatatgcagttcaaggcatctcagatctacacagtgtaccgcctatacagctgtctgtggtagtcctgggaggaggtagttttaaaatctccattggaattgaaagttggcattaatctcatgttgcctcctcttacttccctggcctacatagcatgcttatgagcccactcctgatgatgtggccatatcctacctccctctggctcatatgtttgagaggattgtacaggtgagtgttctgtgttcctagcagtatgtggcaagggggtcctgacttgctatcacatgtttattccaaaggcagctacacagtatttactgttctttctccggtgtgagaggtgcaggcaaggagttggctcatgggagccctaatcatggcatggcccctcatttcctgcagagtcttcctctgctaagtctgcatgtgtccagggaggatagtacttgctcctgccttcatgggggtgtgtgagtctagtgacatcacagctaggagcttactatctatctgcccttaattctgagctgacacaagacattgtcttctttttaaattttattttggttagaatttttgaaaagatctaggattagagaaaaggaagttccctacagaggatcagggaaggagcatttgatctacataaggtgtgagatgtcccccgcgccggtttttgcacacctgagtgtgtaaggtggtgctgtcagcatggtgcataccggaggaggtctgctcttctgtgagtggactccaggcttttcaggctattttgaggctgatttgagaaccaagagccatgtcagcctttcaaaaacgcaggtagtgtggttggaaagttctctctctgctcctcgctacccccaaatgcctcttcaacaagctcatggttgatgcctaaaatgccaaaatgcaagattcagttctttgggctaaagtaatgatatctgattcataaaaaaattgattctaagaaatcttaaaaaatattttaacataatttatgaaattgtgatggtcttacgattgaaggcaggttctgctttaattggcagtgctttcttagtgccacataatgaattgcgtcttacaaaggatgattatcttagactgtcacacagacctgtggtggagtctgggggaccacacagtctcaatatctgtcttatctgtcatgccaccacaacagaaataaatgtccatcctttcttgggggaaggttctcagagtcctgaattgggagggaggtgctgtgcaagaaaagtgtctgtgtgcctcagcccacttcccaaattccttccaagacaggtccccactgaaggggttgtttgcctcagcccacctcctgaattccttccaagacaggtccccactaaaggggttgtttgcctctaagctctataatttggttttgttttcaggctgttgtgtacagctgtggagccagagttggattcttccaaggggatattcggttgctggctgacgacatgaagactttgaagcccacattgtttcccgcggtgcctcgactccttaacaggatctacgataaggtactaactttcagctgaagggactgtctgtgacttgggcctgcacgaaggaactctgtactactatgagatttactccacctctacctccaccctctacaagtatctacgtaaagccgtgtgtaaatacaatccccgccaggtgtggtggctcacttctgtgatctcagcactttgggaggccaaggcaggcagattgcctgaggtcaggagttcgagaccaacctggccaacatggtgaaaccctgtatctactaaaaatacaaaaattagctggactggtggggagcacctgggatctcagctacttgggagactgaggcaggagaattgcttgaacccgggaggcggaggttgcagtgagccaagatcacaccactgcactccagcctgggcaacagagcaagactccatctcaaaaaataaataaaaataaaattaaaaaatgaaaaataaataagtgcaatccccttttccttggataagatgacttggacctgatctgaagaaagcttgactaagagacttggggggcccctcagggttcagcagacatcttgggaagttgttccctttctgaagtgccaggccccatgatatacatttcagatgcatcctctcattgaatcctcacaaaatcatagtaaatcatacttacacctattatttctaacttatgatgaggaaaatgagcctcagaggttaaataacctgcccagagtcacatctaataaggggtagggcagaattaagctttcagtagtcatgtttcagtagtcatgtcggctagtcatgttgatgactagcactgctctatttttcattagaaattacagaatggtgatttctgtaattctgtcttcctcttgcattcattagctgagattcttccataaaacctggtgaatatttgattctttttatttatcaatcttcagaagaatggatttgtgcctcagcaatcttcaaaagtagccaatgagattttctctttgtatttttaggaattcataattttcagatttttttttaatttcagtgattctttttttttttttttttttttgagacagagtcccactctgtcacccaggctggagtgcaatggcacgatctcagctcactgcaacctccgcctcctgggttcaagtgattctcttgcctcagcctcctgagagctgggattataggcgtgcactaccacacccagctaattttttaatattttttagtagagatggggtttcaccatattggccaggctggtctcgaactcctgacctcaagtgatcaccctacctcagcctcccaaattgttagtctttcttcttgatcttctaactgccccatcgtggcagttgggaaacctcatcaagttgctcatgtgtccttttgacaatacccctgtagcctctgatagcttccttggtttctggcacaagatgtctcaacctcatcttgtatatttctcacccaattcttagagtgtctgattgcttcagggagccgttgaagctatttgaacccaggcaatatagtatgtgatgattcctcgggctgggatccgtgaggaagtaatgcatggccattcttcacatgctttggaaccctcccccacctccccaaccacctccaagattttaactcttcctttcactcttaggactctcagcagatgctaaatgggctctggtgacagggcaggcagtgttctagcagaactgataacaattccagcagtttcttaccatgctacgcaattagtagatttggtggttgttatggtttttgttcatatgttgttgttgttgtacattttttatttttcagagatagttattgtataatataatacctaatacacagttcacttctggaatgtattttttttttgttttgtttttgtttttgagacggagtctcgctctgtcgcccaggctggagtgcagtggcacgatctcggctcactgcaagctccacctcccgggttcgtgccattctcctgcctcagcctcctgagtagctgggactacaggtgcccaccaccacgaccggctaattttttgtatttttagtagagacgggttttcaccgtgttagccaggatggtctcgatctccctggaatgtatttttaaaatgaaggactttattagcacacgtctctaatactagctctttgtcagtgacttgttgagggagggtgagtcttgtgaatgttgaagaaagataaatctcttttagttgagggagattctaagaatggcatgatgcaggaagcatttgagcatggatcttggagacagattatgacatactggtacaatgataatgttataggcataagaagatgcttatgtcctagagcacaatttacattagaagatgaaaattatcacccctgcttggctggaggcccaaaaatggggttataaacatggaagatggatggagagggattcttcaaattttgaacaagaaaaaagacttcaattgccttgaatctgacttccagtagggtggaatcttgaaagccagataagagttcaggactaaattttggaaataaggggtcactttgagctgtacttggggaagctctcctttggcaggagtgtggttgatggaatgtagggtcacagtgaggtcagagtcagggagaccagggaaatcatgcgagctggaaaaatggtgtcagaattaagcccaaagggaagaaatcattttagtaggaaggtaggaaactctgttggggtttgtatggtgtggctaaagacaccttgtttatagggaagggtgggaattctccaagttcagttatataagcattacagagggagagggaggaagacatgatacttgttttaaaaaatcagattcctgggccgggcgtggtggctcacgcctgtaatcccagcactttgggaggccaaggcgggcagatcacgaggtcaggagattgagaccatcctggctaacatggtgaaaccctgtctctactaaaaatacaaaaagctagctgggcgtggtggcgggtgcctgtagtcccagctactcaggaggctgaggcaggagaatggcgtgaacctgggaggtggagcttgcagtgagccgagatggcgccactgcactccagcctgggcgacagagcgagactctgtctcaaaaaaaaaaaaaaaaaaaaaaaaatcagattcgtaggctgccctttgacctactaaatcaaaagccctagaagtggtgcccattgagctgtgttttttgtttgtttgtttgttttaaatctagtaccccccaggtgactttttaggcagtccctctttatctcagttgtcaagttgtttcccaaggactaaaaattggggcaggaagtgggaggactggagctctgcattaagttcacttctttctgagcatggccataattctctgggctcatcattattcagcaatccaattcatgactgtgagactgtgagaccacttccttataaagctagaacacactgtttcttgctcactaatggctttgatgagtatctccaataggtttccaactaaaaggagctatcactctgcaggtacaaaatgaggccaagacacccttgaagaagttcttgttgaagctggctgtttccagtaaattcaaagagcttcaaaagggtatcatcaggcatgatagtttctgggacaagctcatctttgcaaagatccaggtaggttgggcaggtcctggactgaagcaggcaaatacctgggctgccttctgactccttagaccttgcttttcctctgctgcttgagcgtcactttaactagagatcctttcagactttgtgtccactgccttttgagatctttcttgtaccactttactactaaagggagtaggtttaaaaaaaaaaaaaaaagcaggctgagtgtggtggctcacacctgtaatcccagcactttgggaggcctaggtgggtagatcacctgaggtcaggcattcaagaccagcctgaccaacatggtgaaacccagtctctactaaaaatacaaaaattagccgggcgtggtggtgggtgcctgtaatcccagctacatgggaggctgaggcaggataatcgcttgaacccaggaggtggaggttgcagtgaactgagatagcaccactgcactccagcctgggcagtagggccagactctatctcaaaaaaaaaaaaaaaagttttatttaggttctagcactctctcttattttctttggtggtctgttgagattataagcaatttgaggggctgaagaatacaaattatttgagaaatatatggcttctggtcccagctatggatagtgatgacaataatagctaacattttaagtgcttttctacaatccagactgtattctaagtgctttgtaaattaacgtgagaattgatgtcagtttaattctcataacaacgctgcacaggctattatacccactctacagtggaggaaattgaagccaagagaataggttttagtatgtcttttgtttccactgaacaggacagcctgggcggaagggttcgtgtaattgtcactggagctgcccccatgtccacttcagtcatgacattcttccgggcagcaatgggatgtcaggtaagccaagcaccttctttgagaataggctattttacttttgcacaaacaggctcactgtttaaataaaaatgaaaacaactaaaaggtaccaaaatgaaagtcacctaaattctcaaaatccaaagaaaatatccttctaaccatctcttcaggcatctgtgtgtagaaaccttcacataaataaaaccagtgctctaaaacacttgttaatgttgctccttgtcaaataaagctcagcatcattttaatgatttcacagtagtttactgaatgtagttgacccttgaacaatgcaagagttaggattgcctacccccatggcagtcaaaaattcatgtataatacttgactccctagccgggcatggtggctcatgcctgtaatcccagcactttgggaggctgagacgggcggatcacgaggtcaggagatagagaccatcctggctaacaaggtgaaaccctgtctctactaaaaatacaaaaaaattagctgggcgtggtggtgggcgcctgtagtcccagctactcgggaggctgaggcgggagaatggcgtgaacccgggaggtggagcttgcagtgagctgagattgcgccactgcactccagcctgggcaacagagcaagactccatctcaaaaaaataaaaataaaaaaaatacttgactccccaaaaacttaactactagtagactactattgactagaagccttaccaataatgtaattaatcaacacatattttgtatatgtattatatactgtattcttacaataaagtaagctagaaaaaagaaaatgttatttaagaaatcataaggaagagaaaacatatttactattcattaagtggaaatggatcatcataaaggtcttcatcctcactgtcttcatgttgagtaggctgaggaggaagaagaggaggggttggttttgctatctcaggggcagcacagacagaagaaaatccacctatcagtggagctgtgccatacaaacttgtgttgtgcaagggtcaaccgtacccaaataactaatctcctattaatggacacttgagttgcttatgatatttttcattgttataatcaattaataatctagaataaatccacgcaagaagggattattgggtcaaagtaatacacacaatgtatctgtgtgtgtgtgtgtgtgtgtgtgtgtgtaataatgtatattatcaaactttcttccagaaagatcttttttgcacatttctgcaagtatacaaggccttatttgcccatgctcttgccagtgacagactttatcagtcattcagatattagctaatcagataaatgaaaaatcttattacagttttgtttcttttatttacaccaaacatctttctattgcttattgacatgtatattttatccatgaattattctattacttccttatagaaaaacaggcaaaagataatttggtccttttttatatttctaagagttcttcacagagtaatacaggttgagtatctccctatttgaaatgcttgggactaaaagtgttttgaattttgcatttttttccaattttgtaatgtttgcattataaaacagttgagcattctgaatctgaaaatccaaaatctgaaatgctccaaaaagcatttccttggaacatcatgttggcactcaaaaagttttggattttggaacattttggatttcaaacatttggattagaatagtcaacctgtaatattaacttttgtcatgttggaaacatttttcctggtctcatcatttttgccctgtgtattgccatataaaaatttccaatgtttttatagtcaaactaaataatcttttctatttgtaggttttaaactgcttagacaggacttcctaacccccaatatttcataagactgtttcacccttattttctggcaaacttaccattttccattttttccttttaagtctcagttccacctgaaatttgtccaagtgcttggccatgcatattgtctcaattttcacccagatggataattagttcattcattcaaccaaccatgcagagcatgaacaaaacaggcatagacttttcctcatgagtcccctatctgtataaccacaatcaaaagagactccagaatgatgccaaggcctgaggtccttcaaattagcatcctcttagccatttttaatactgtcctttccttaagcccctaaaaccaatagatcagcaggtcctgttgctaactccttcccgaaatgtcttctctaagccttcctctctctcccaactctgcctatcacaggccacaccccccattgcagcagcccttgaacttgtttcctgcccccagcctctctccagtcaagattatcttctataccaaggattggcaaattgtagcactggctaaaactagtctgcagctggtttttattttaaaaatattattcaaatacagctatgtccatccatttatatatggactgtggctgcttttgtgctattttggcagagtcaagttttgagtcagataccagatggctcacaaagtggaaaatatttactatcttggcctgtacagataaagtttgcccacccttgttttatatcatagtgggggctatttcccttaaaaaatactactccccttcttcagttccttcagtgatgctccattgctcagggtcaagttcaattgctattgggttgcacaccacttagtgaataacttacatgttcccacctacttgaaatgctgcattttcttttcttttttttcttttttttttcttttgagatgtagtctcgctcactgtgtcacccaggctggagtgcaatggcacaatctcggcttactgcaacctccgcctcctgggttcaagcaattctcctgccttagcctcctgagtggctggaattacaggcatgtgccaccaggcccggctaatttttgtatttttagtagagatggggtttcaccatgttggtcaggctggtctcgaactcatgacctcaggtgatcctcccgccttggcttcccaaagtgctgggattacaagcatgagccaccatgcctggccaaaatgctgcattttcatataaagttctatgctttggtctatttccagacccttttggtttctgaatggccagaaggcttggtagtaaatactttgcagcttgggtatgagttcaaggttttttgtttgttcgtttgtttgtttgtttgttttttgagacggagtctcgctctgtcacccaggctggagtacaatggcgtgatttcagctcactgcaacctctgcctcccaggttcaagagattctcccacctcagcctctcaagtagctgggattacagacacctgccatcatgcccagctaattttttttgtgtttttgtagagatggggtttcaccatgttggccaggctggtctcaaactcctgatctcaggtgatcctcccgcctcggcctcccaaagtgctgggattacaggcatgagccaccgccccctccaagttcaaggttttaagacactaagtggtctcgaacccttagagaccttgctttcctcgtgtcttgaccatagcacgtggccagctcacactttatcttgagtaagtctaaaagctcttctttggtttcccaggtgtatgaagcttatggtcaaacagaatgcacaggtggctgtacatttacattacctggggactggacatcaggtaagtcctccatctgctgggcaggaggtgccatggttgggagaaaggttctaactgaactaggactttggagtttagataacttcagttctctggactaatgtggcaaatgcaaaattcaagttttgggtccaggcctgcctatcttggctagtctgcattggtgccaggtgatttttcagtcttcctcttctagagtcaattcataaatatcttagaaatgtgcctggaattatcaccatgcaagagtttctcagctgattcagcacggtatgttctaggtcacgttggggtgcccctggcttgcaattacgtgaagctggaagatgtggctgacatgaactactttacagtgaataatgaaggagaggtgggtaggtcatgccctgtggtcagacagtcatggtggggaggtttatatcagaaagagcaaataattgtaagcaaacttggatttggcccctttgagattgttagcaaagaattaagcattctgaacttcactttcctatcccctatagtggagacttagatctggtgctcttcacagtgtagtggaagccatcaaatgatttaaggggagcaggtgtttcataaactgcccacgctgggaggagcagcctttgctattgtcaccgccttgtatgtctgctgtgcaggtctgcatcaagggtacaaacgtgttcaaaggatacctgaaggaccctgagaagacacaggaagccctggacagtgatggctggcttcacacaggagacattggtcgctggctcccggtaggtatatcatcagaactcctggaagtctatgctaatggactgagaagaacaatctgcttatagcaagaggtgcagaaatgcaagtaggttaatcagctgaggcagctggaggggattaggtttgtaccctacctggcttatgacttcctcatactatccagagaagaacatacagactgaggtggtggatcacctgaggtcaggagttcaagaccagcctggccaacatggtgaaactccgtctctactaaaaatacaaaaattagctgggcatggtaacgggcacctgtaatcccacctacttgggaggctgaggcaggagaatcgcttgaacccaggagatagaggttgcagtgagccaagattgtgccactgcactccagcctgggtgacagagactctgtctcaaaaaaaaaaaaaaaagaacatacaattgaaagaatctaggttaagttaaaaaaaggctgggcatggtggctcacacctgtaatcccagcactttgggaggccgaggcgggcggatcacaaggtcaggagatcgagaccatcctggctaacacggtgaaaccccgtctctactaaaaatacaaaaaattagctgggcgtggtggtgggcgcctgtagttccagctactcgggaggctgaggcaggagaatggcttgaacccaggaggcggagcttgcagtgagccaagatcacaccactgcactccagcctgggggacagagcgagtctctgtctcaaaaaaaaaaaaaaaaaaaaaaaaaaaaataaaaatatatatatatatatatatataggctggaagtcatgagatttgtgttctggttgcagctcttccatggatcaacaatataaaattctgagaaagtaatttaacgtgtgaataggagctgccaaagctagaaagtctttcttaaaaaaaaatttttatagagatggggtctcgctgagttgaccaggatagactcaaactcctggcctcaagcaatcctcttgccttgacctcccaaagttctgggattgctggtataagctaccacaccagaagtactgccagagtacttttggtattttgatcacactgttacagaagacaccaagatgtagaccagttgaagtgttttcttcttgccttattccttatcgaatatacaaccagcaagcagtaagtcagtgatcctagcactgtttttagacccaaactgaaggtgggattctttaacaggtcaggtagacctgcacatcagagttggcatgggtcccctgcaatggaataaatttgctaccagccagggaaaaattaggtgacttctctaggaaaggggaagggagatgtactactctgtcctttttttttcccccttaacttttcttgaggcagaagttgtggtttgaagccaagtgtggcagctcacgcctataatcctaacactttaggagactgaggagggagaattgtttgaggccaggagtttgagaccagcctgagcaacatagcaagactctgtgtctaccaaaacaaaacaaaacaaaaacccaaaaaactttggtttgataatgccgttggtccacagcttttgcctcttatgagtttcttgggataaatatcctccctattaattcacaggcatatcaaaacaaggaagaaggatttctaaatcaagtgtttgcagaggctagtgtttgtctctcattgaccttcacagcccctttctgtggaagatacagagacatatttttagcatagcttgataattagcagtagttgctattagttttcctaagaagaaaggaaattattgcaagggcagtgatgggatttcccaaaagatcttccctctcaaaagttttgtcttaactatgtgctggggaagtgggaatgtcactagaacttaaaactcctttcttgctcaatcaatatttaagatttaagtgagatttaaggaatgcttgacaatgtaacttttaagaacactggtcctaacgatgcattttattgatttgggtttggtagtatcttgctaatatatttgtttctgtctagtaacagaattaaataacactctaataagcctaggatgtaagcaacagatatgtccccacaccagggttatagaaggctgcaccttattaatcactttcagataatgaacgttaggctgaattgatggctaatttatcaagtcggccttgtgatagttccagtgttggtttagttagtcgccctacttagggtgttagcatgtggattttatttgccatttgtcccaattctacaattcaaatccctaaagacctaagctcctcagaccaattagttcagagaaatgaagctgcaaatgacctttggtggctggtcagagtcctctcagccctgttgctgtcctaacaagcccagtaattgagttgcttgattagcacagtggagctgtttgagcctgctcccggatctaacaaggaggaaaacataacagggagtcaagtggtgggagaactattcaaatcaaatcaaaagtctaaacaaaagacaacacctctatttctgagagttctgaaaatgaactaattggaaattagtgattggaaattgagagctgtgcaatttcttccttggatgaggcatcaatttgcataactccagtagatccaggagactttctctaaggctgcgcattgactctccacatagatatacagtaaagacaggttcttgctgcacgatgcttccctcccctttcaccaaagccaagaaagagaaatgaaagacagctcaaaagtctctggagaaatcagctttagagaagaaagatgactgtgacttcaccactctccccactgatatcatctctgtggctcaaaaatactgatacttttatctgtctcatgtagaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacgggtaatatatcattttaacaatagcccatttcagtcacaaaccatgctggttcttgtagctacaggaaatttgtatagttgggttcagaatgagaagatccaagcttataaaactaaaaaaaaaaaaaaaaatgaagttacattccaaacctcaaataaggcaatttcaatttaaaaaatttcaaaactatgatggacgttgtacacaagtcagtagaattgtttagaatggctatactaaaaggtaatgattcagtaaaaaatgagctccacattgcacttagttcccattccttaaggagttccttaaagctatgtttaagagcagtatgtataaaacaacaaactgttgcaatatatataaagcaacaaacaaaagtttgatcaacaaactgttgttttatacatactatgcttaaacgtagctttaaggaactccttatcccaaaacaacgaactgttttatacacactgtgcttaaatgtagcttttaggggacaaggggagagttgacatggacaagccagaggcgctttaagcttaatgttgaaggatcagatttgaatggaacatctttgtaatgagatattgagtgggaaaatgggattacagttccatggtgttgaaaatatatggtgagaaaagaacactagtactggatttaaggttttggggaaataactattacaatgacataattctgctttatttaactactgggggacatccctacataacttctctcatgcccttgcaccttttatttcctttccatagtcatccttagtaggagtggtggttcctgacacagatgtacttccctcatttgcagccaagcttggggtgaagggctcctttgaggaactgtgccaaaaccaagtaagtcttgcctaggaaagctttatgcacacccatgggcccatcgtggaggagaggatgcctcaccagttcctgcatctgtcacaagtggctgcagcccaaacagactgaatagttttatgggactcggggataggatggagagtttaaaaaataaaactctcttttctatttaaaataatatgttcattgtgggaaaagattgggaaagaagagtaaaaatgctattcagagaaaactgttaacacttagatgtgccttttcttctcagtttttctttcaatattgggcatataatgtgcttgtgcatagttttatattcctgctttcatactgcatggctttgacaggcactttgagttggttcatgcttagcccttcaggctttttgaaacagccatgctttaagtgatgttttgtattcttaggttgtaagggaagccattttagaagacttgcagaaaattgggaaagaaagtggccttaaaacttttgaacaggtgtgtgctaccactgatgttatactggcctcttgtcagaaagttttgtttaaagtttccatctaatgaggtttaaatgtataatttctaaggaattgattttagattttgtgccattaactacaaaatgaccttttgtagttacttgtacagcgccctttttttgctgtttattgtccattctcccttctccctactcattactttcttaaattatgtttgtgggaatgggcatgtgttactgttacctttaccctttcactgcatcaacctcactttcttcacagagcactcagggggctctgcagagaagtccaaatcactaatgagcatggatgtgtgtgtgttcatcttccaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatacttacgttgtggtgtttctttcctcatggaccatgatgaaaatcagtcttaaacaaggaccccttaaaaatcaagtacagtatctgttcttaaacttgggtacacaatagaattatctaggaagtttaaaaagacactaatgcccagcactttgggaggccgaggcggacggatcatgaggtcaggagaccgagaacatcctggctactatggtgaaaccccatctctactaaaaatacaaaaaactagctgggcgtggtggcgggcacctgtagtcccagctactcagaagattgaggcaggagaatggcatgaacccgagaggcggagcttgcagcgagccgagatcgcaccactgcattccagcctgggtgaaagtgtgagactctgtctcaaaaaaaaaaacaaaaacaaaacaaaaaaaccactaatgcctggttgccactccagggattctggcttaaatggccggatacagcctgggcactgagattgttaagaagacccacagatgattctagtctgcgaacaggttagtgaagaaaagtaagttctgaagaccaaaccttcttatcccatagctgtaaagaataaaacaaataccagctgagccaaaactccaactgagcacaagtcatatccattcttttaccatctttgttgtactctaattataatcttgaatattaatagtattcttttctggcctccaactggagttaaagagaatgttcttggatggtctttctagattttgagcccagaaaagccaaagaaatatctattcttaaggatctgaaacaaaagggtaggcaggaattaacttttaaagtctagctcccattatcactttaactttctcgccttcacttcctttcctattctcccctcacgcattacagctgaacctcactagttaccttcctgtttctcaaacgtgtcagacacaggtccagcctgtttttgttcttgctgctgtctctaaaatgcaaatatcccaaagcacatgacttgtcccctcatctgcttcaaatgccaactcaagactgtcctaccttcttgcttcacaataacatgactccatcttacatatattttacctgtctgttcactgctgaattcccaagtgctcttcccttatcctcaactattacaggcctggcccccaaagcttcacattccctgccttggaaaggtttctgaagtccagagaaataggctttctctttccttctgtgattccactgttatgtttagacaagcccaatttaagcatccaagcccaccagcttggatcctaccactcacacaagcttcagctttttactcaagggtacatgagtagtttgatatcactatgtttaaagtctagaacactactgccacgggatccttggggtgttgcttccccagctggaatcctctgtggctggcagcccaaagtccagagggggcctaggcggcagggcgctggtgtcagcaccactcagagctcacgtacacctggccaggtcctcacagcacccgggcttggcctcacctttgctccagagcgagtgccaggagcaggaagaggccaagcagttgttggggggggggtgtggggggggtatttcccctcggccccctagagcacaaggatgcccgggtccgcagccacggctggacagctgtagctacgcttggctcctgcctatcacggctccccctcaacacccctcaggccaccactgccatccgctgccatcactatgaccgcaatatcccattaatagggttaatatcttgaagcaagtgtgtcatgtcttaagccacgttttaagatgccagttgtccacagggcagcagagcagtttttccataaggaactaagatgaacctttttagtcagcaaaaagaaaaatgctttaagtaaaaactgattatacccaacatccattgatctttatttgatttgacaaaatctgcatttttaaaagacaggtaacaaaatctgaggt

SEQ ID NO: 16469 - DNA, 18264 bp, Human
actgctgccctggtgcaggtattcagggaagcactggggtgccatatagaacaggcaaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcagggtggctggcgactgaggctcaggtcacccaggagctgaaaggactgagtggtggcgaagagaggccagaaactgagcccctgctgagctttgtggcgtctgtctccccggctgaccgaatgctcactgtgaccccgctccaggatccccaaggcctgttccctgatctccatcatttcttacaggttttcctccctcaagcaattcgacatctcaagtgaagacatggcccctgaagggcaataaagctgctagtttattaatacagtctcccgtttcctttcatttccatctggtcataatcccccttcccctcccccagaacttcctgcagctgctcccgtctgaccccgaacatgggtctctccctgttgctctccaccccaccagcttctccttcctacagttcgcacagctcgaggggagtgcgggggcagcaccgcgcgtggcacctggcacccgcgcagagttcctgaatggcagagcggtgggtggctccagcagtactgagaagagccaggtttgcctccacattcttcctgtcgcctcagatttatgcgcacaaggacggagatttgcgttcagcgttcttcattctctcctttaaacgaggagagttcatcccgttcttaaactgggtaagagatttcaaacctgaacatgggtcaaaagccatgaacatcagaagcgacgatgtcaggtcttccagcgtcagcccctccaggggccgagtccggaggaggtgggagggacagggcgcgttctccctcatgtccctgccctgcttcgggccggagggccggtgccctgctcgcagtaacagcaccctggagctgtcaggggttggatgtgagcaaacctcactttggcaggcgggttcagaccggggcccctgttagacgctcatccctttctggaggaaaagcagagcaggaactaaagggatttagcacacacactgccacctccgcgcagcagctgttcctcgctcccatgagtttcatagaatcatgtgaggggcttggcaaaatctaccatcaagtcacttgtccctgggagggccagagagggacgcccccagtagcactggccgcgccgggccaacaaccgcgccacgtagccaagaactcgcggcttttccagcgggttctcacaacttccccgccctccacgctgtctacctccacgtctagactccgattggcccgctgcacctggggggcgggccagtcaagagctccaatgcgcaggcccgagctttttccgcgctggccagcaggccccacccacccagttctttttccaattcagcgccactggataccgaactgtcgtacgtatgtcttctgtttcgtcctcgctttccggctgctgtttctccacggctctcctctttccccctcccttctctcccgggcggcttactttgcggcagcgccgagaaccccaccccctttctttgcggaatcaccatggcggctggggtaagtttgctggctctggtggttcgggtcatcctatccaccgccatcctttgcccgagtggggccagtcggcgccagaggagttctgaggttgagtggggaactgattcgggggtctacagactgtactgctggagagtagggttcctagggcctggaggggaactgaggctggggctctcggaggccagaggtggaagggtctggggaagaggagaaaagagatgccgggtctgggccgtccgaagcctgagaaaggggttcggctctgttgccgctttgaggcgtggtatctgggcaggttgacgaacttctgtgtccgttttgtggagtaacacaggggacaggttgaagaggagggtctttgtaggcaggtccggctggcacggttaaaggtcgtctctcagggaggtttgggagcgagaggattctccggacagtgaagtcagaccaattggactccgctggccggcataatagagaagcccaacgccggggaactcgctgcgggacaggaccggagggatgatattcgcgacacggaaagaaaggctttttgagagagaggagttgatttaagaagacggcatgccatcccctatctctggctagtctgaggggaactagaaatctctcgatcgtcgtgcgtgccttagagacaggacgatgcttttgaagcggtgagcagctgagcagtagagtaggcaggcgctcggaaccatcaatgaatgaagcgagggctccgggaagggaggagagtatgtttgtaggcagatggagtctgatggagctagaagttctggatttcttggagatagatttgagaggaagagaatacttccagaggtgtccttagggaaggtcaaatctgtcaacaagctttatttagcagttggtgtgtagttctgttcttggtatttcggaggattctgattacatatgacaagtactaaaggacttggttcaccagaggaagtaaaagggtgagttgaatacattgggattattcaggaaagtcatcctggagagtggcattaaggactgggacccttctactcattaattttgtccctctctttctcccatagaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtgagttgggagatggggagcatccttcggttctgagaaaccaaggccctgcgattctgtcactctggtggtggcccccatctctaaaagggagcttcccatgttgttttattcaatttcggtgattttattttgagataaatacagatttacatgtagttgtgaaaaaaaatacagagctattctgtgactttataaaattcacgagtttactttgtgggaaagagaatgagttttgactaagcattttcagtgcaaatatatcagatatctgttatgagcagaattcttaccccaaggggtttatagagataggtgaagaaacatgctaagaatggaggagatgaagtgctgtgtgggtctgggtcacacactaatactttaactgatacagacattgatacaggagttgcttttggccttctgcttgtttgatccagagatttcatacaaatatcctgtaatattcaaatctattgggcttcctagttaacattgtgaattcagattgcaaaggaggccaagttcttgaagtatttatttatggttcttgagtatcaagagtttggatagtgagaatcatcagccttatataagtattttcaaagcagtttggctcctggtattggttaggaagaaattttgtgtgttttaccttatcttttcactgctttgtccccaggtcccagcatttgagggtgatgatggattctgtgtgtttgagagcaacgccattgcctactatggtaatttgcaggggtatatgggaatgggagaatttggaggtgagggtgtaggagaggataagtgtgagcgggggtggatatgaaggaattctccaggacctggactggtgttggcattcccccagagttctgaccttcgtgttctgcctctgcagtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggtgagccttggaactttgagagaagccaggggcaggggtggcatcagctcctgggtgttgggagtaagaaataaaataggttgaaaaaaagatgccaaggatatgtaggcaatgagaagacgtaatctctagggtacgagtttgaagcagtgggcagttgatggaggaagtgtctgtcatgagtgatcagaagagggattgctgctgtgaagagattataccaaatggtaagggggtggctggaccagaggacctctgaagttcattgtttgtaatacatttagaatgaccctaggatctgcctccattgaaagagagtgagggtgagctcagacttctaggtgaaaatagccctcttagttctattaatgggggaggtgagggaaagggattggtacccactgatgagttttatcatgttgaatcactaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggtgaagtttatggaaaatccatttggcagtgggtagatggggattagaaacaaagtgacgaggtatctaggttaccctgtattctgctgaggacttggaaaacagctagaggtgggtgcagtggctcatgcctgtaatccgagcacactggggggccgaggtaggcagatcacctgaggtcaggagtttgagaccagcctggccaacatggtaaaaccctgtctctactaaaaatacaaaaaattagccaggtgtggtggcgcacacctatagccccagctacttgggaggctgaggcacaagaatcacttgaatctgggaggtggaggttgcagtgagcagcgatcgccccactgcactccagcctgggtgagagtgagacttcgtgtcaaaacaaacaaaaaacagccaggaatcccaggactgagtaccatcacttgctttccattctcttaagaagctgggtaatgtcttgcctttagtttctgtttggcagctaagatgtttagtttgttgccatatttcctgggaagattggttattcttagttgtgaagacagaggtgatgatggtagcttcagcattaagatctttttggaggcaggccaggcactgtgtctaacacctataatcccagcactttgggaggcctaggcgggtggatcacttgaggtcaggagttcgagaccatcctggccagcatggcgaaaccctgtctctattaaaaatacgaaaattagccgggcgtggtggtaggagcctgtaatcccagctacttgggaggctgaggcaggagaatggcttgaacccaggaggtggaggtagcagtgagccaagatccagctactgtgctccagcctgggggacaagagcgagactccatctcaaaaaaaaaaaaaaagctctttaagctcttttggagacagatacaggttcaagccttggcttcattgtttaccaatgtaggtaaggggttatatgcgggtgaattcctttagtcctgttttttactctttgcaatctataaaatcagggtagtaataatcactgtcaaggttattgggtcaaaaaagaatgacaagtcactggtttccaaataaaagctcttggactgatgctggtccagaatagtaatgtgatcatagcaaaagaaaaaacacttactgcatgccagaccctgtgccaggggcctcatggggatcatcttagtgagtgaatctactaagtggtagagtagaatttgaacccaagtactgtggaaccagcactctgactgctgtgttctgtttccatgacaagattttttttcctcttctggtctttgcaaactaaaaaatgacaacagttctacctgaagctttgcaaactgaaaactgacaacagttctacctgaagctgtttattcttatttttctttgaccatgcttaatacaccagacactaagtttaatttgaaggactgtccattatttatttatttatgtatttattttgacagagtcttgctctgtcacccaggctggagtgcagtggcacgatcttggctcattgcaacctccacctcccaggttcaagcgattctcctgcctcagcctcccaagtagctgggattacaggcatgcgccaccaaacccgtctaattttgtatttttagcagagatggggttttgccatgttggtcagactggtcttgatctcctgaggacctcaggtgatccacccgcctcggcctcccaagtgctgggattgcgggggtgagccaccacacccagccaggactgtccattattctaaatgcgtttgaatattttctttgaatgttctttactttctgaagtttgatggatgggtgggtgtggggggtgtgtgtgtgtgtgtgcgtgtgtgtatagtatggccaatatagatagtaaatacctatagtgtttagattttatttggcaaaaaagtcctcgatagccctctgtgggtctcaatctttttttttttttgagacgaagtctcgctcttgtcccccaggctggagtgcgatggcgcgatctcggctcactgcaacttctgcctcccgggttcaagtgattctcttgcctcagcctcctgagtagctgggattacgggcatgtgcaaccatgcctggctgatttttgtatttttaggagaggcggggtttcaccatgtttgccaggctggtctcgaactcctgacctcaggttatctgcccgcctcggcctcccaaagtgctgggattataggcgtgagccaccgctcctggccgacgtttgaaatttaaaagattggaaacagtagatctgaaatagttttgtaaaggagcaagacaattattactcctactcctaaatggaggatggacccaagcatccatccattaaactggactacactgaaaaaaaagattagaaaaagaaatggaggccaggtgtggtggctcacgggtaatcccagcactttaggaggccagggcaggaggattgcttgagcatgcgagttcaagataagcctgggcaacatagtgagaccccatctctattaaaatttttttttttttttttttttttgagacagagtctcactctgtcacccaagctggagtgcagtggcgtgatctcggttcactgcaacctccacctcctgggtttaagtgagtctcctgcctcagcctctggagtagctgggactacaggcacgtgccaccacgcccagctaatttttttttttttgagacagagtctcactctgtcacccaggctggaatgcagtgccgcgatctccgctcactgcaagctccgcctcccgggttcacgccattctcctgccttagcgtcccgagtagctgggactacagctgcccgccatcacgcccagctaatttttttatttttaggagagatgggggttcaccgtgttagccaggatggtctcgatctcctgacctcgtgatccgcccgcctcggagatcccagcagtttgggaggccgaggtgggcggatcacttgaggtcagagttcgagaacagcctggccaacagggcgaaaccccatctctactaaaagtacaaaaattagctgggtgtggtggcaggcacctgtagtcccagctactcagaaggctaaggcatgggaggctgaggcacgagaatcacttgaacccaggagatggaggctgcagtgagctgagatcacgccattgcaccccagcctgagcgatagagtgagactctgtctcaaaaaaaaaaaaaattgaaaaaaatgaagaaatgggaagtaatccagggaaggatgatgttgtatgaagctattgtctatagggtttgaaaagaaggtgagcactgggacttaggtagagcaaggactcttgctgtgaacagaactcttcagggcctttccactgactttgtttacacccttatgtcctggcaggttctagagccttctttccgccaggcctttcccaataccaaccgctggttcctcacctgcattaaccagccccagttccgggctgtcttgggcgaagtgaaactgtgtgagaagatggcccagtttgatggtgagtctgaggagactgggaggcatatggccaggatcagggtctggtttgctctgcatcaaccccttgatttcctgtcttgcttttgggttatggggacctgcagaatgtagggtgtcaatgtggtagctaatattatgtgcagtttcgtgtacactcataccctgactaatttgtattactatatagatttgcgatataaagtatttgttgctgagtgtgttgttgctggaggacacacagtgaactgatgagcagtctggggcctaagttccttacttgtcccattcgtcagtttcctctgttaccttgcttgctctgtgtggttttggaggggtgtggaaagaggcagaacattcgttcactttcctgccttcctctgcaccagctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagaggtaaggatattggagggtggagggtgtgggaccaaagaaggcctgttctcacctctgtatgtcccccctcacacacagctagagccagaattttaggttgtccatataaagttaaaggtatattttagttgcaaataaagcagctttctggctgataatcaggaattgggcaaattttgattgtggagagcaagtttcaagtacagccagtactggggaagattgaactcctattccaacaaagacaggaacagattttgatatagtggtaagttggttttgagcaagctcatttgaccatttgagagctctgagaacaaatacagggagaggcgtggggaggaagaaagtgcagagagccttgcggtgcgccacgcgcccggctgtgcggagatagtggatgccagagcagggtcctttgaattgttttgttttctgttttgctgaatcagactgtacaaaaattgctcactaagaaaaaggatgaagatcatagctaagtagtgtctgtctagttcattgttccacaaccgagtaaagtccccaagtagaagaaagtaggtgtcctctgtatccctttttcagttaaaggtagggcttcttggaagaaataatatagtaaaaacgagatttttggcatgaaaaatgtaggacgctgagtgcttgcccagttctctgggatggagtctttcttccatcactgctccaagtcattttattgggagttcaagcagtttgagaaatatatattctgtggtcactttgctttggaactcctctttctctgtactttttcctcccactcaccctgtcatttccaaagccgttcatctttttactgcttggtctgctagggtttacatttcaccctctcccatcttgtaatggcttggataccgggtgaaccagcctaaaggagcacccactggtagggacacagtagctgtgcatagaattgtgaattacaagcattgcactaatagatgggagcaacttggggtatagctgaaagttcttactcccgggtattttgtacaagaccaggaaggctccatccagacacaggcactctttaaagatgtattttttgaactagtgatttgccttgaatttagcacaggtgcaggtcaagagtgagcaggatttttggtgtgtgtaaataggtcatgataattaacccaaattacatattgtgttgtaactcagacgttgttaattattagctagagattttcacatatagtaggtcagtactctgggcaggaaataaatgaggcagtagtaaacttaaaatctttatttaataaactttacattttcttaacatggttttgggaatgtttattaatgtctatttattgggttaccatgatgccctacagggctgccagaaatgctttccccaaggtttttttttttggaaacagggttttactttgttgtccaatctggagtgcagtagcgtgatcacggctcactgcagtcttgacctcctgtactcaagcgatcctcccacctcagcctctggagtagctgggacaaaggcacacaccaccacacccagctaattttttattatttgtagagactaggtctcactatgttgcccaggctggtcacaaactcctgggctcaagtgatccttggcctctcaaagtgctggaattacaggtgtgagccactgtacctggctcctttttgtgttttttgtttttttttggtttgtttgtttggagacagagtctcactctgtcacccaggctggagtgcagtggtgtgatctcagctcactgcaacctccgcctccccagttcaagcgattctcctgcctcagcctcccgagtagctgggactacaatgacaggcgcgtgacaccacggctggcaaattttttgtatttttagtagagacggagtttcaccgtgttagctaggatggtctcaatctcttgacctcgtgatccgcccaccttggcctctcaaagtggtgggattacaggtgtgagctaccgtgcccggcccccttttttttttttttttttttttttttgagatggagtctggctctgtcgcccaggctgggatgtagtggtgcaatcttggctcactgcaacctccacctgccgggttcaagcagttctgcttcagcctcttgagtagctgggactacaggcacgcaccaccatgcccagctaattttttgtatttttagcagagacagggtttcaccatgctgggcaggctggtctcgaactcctgacctcgtgatccgcccgtctccgcctcccaaagtgctgggattacagatatgagccactgctcccggcctttttttttttttttgtgagacagagtctcactctgttgcccaggttgaagtgcagtggtgtgatctcggcttactgcagtctccgcctcctgggttgaagcaattctcctgcctcagcctcccgagtagctggggattgcaggtgcgtgccaccatgcctggctaatttttgtatttttagtagagatggggtttcaccatgttggtcaggctggtctcaaactcctgacctcaggcaatccgcctgccttggcctcccaaaatgctgggattacaggcgtgagccaccgcccctggctcccccaacatttttaatgtcataaaagtgatatcctaaaagaccaagactattaatgtccagattttaattctagttcttttaagacccagctaggtcaactgcagtggctcatactacttggcaggctgaggtgagagggtcacttgagtccagcaggttgaggctgcagtgagccatgatcgtgcccctgcacttgggtgactgagcaagaccctgtctcaaaacaaatagcttgaacagttcaggagggtgtgaaaaaattcccagccccagttttggtgtggttgaggttttaaggctcctcagatgaggtctcttatgcatttggaaaggaacctgggacctagggttaaaggacagatcctctgctttgctacagtgtaatcttggacaggtcattctacttggtctcatctgtaaagagaggggagggtcagggtaacagttgataactcatgggttataaggattgagtgaaattggaatactcatggcaatatttatgctatgaacaatagaaccaactaaacattcagtttaatattcaatgtttagtagatttatggcacaatcctgcattagaagattgtttggccattaaaatgtttgcaaagaattctgtttttgaggtagggtcttgctatgttgcttagtccggtgtccaactcctgatctcaggtggtccttctacctcagcctcttgagtagctgggactgctagtgcaaaaaattgttttgttttaggctgggcgcggtggctcacgcctgtgatcccagcactttgggaggctgaggcgggtggatcacgaggtcaggagattgaaaccatcctggctaacacggtaaaaataccgtctctactaaaaatacaaaaagtacaaaaaattagccgggggcggtagcaggcgcctgtagtcccagctactcaggaggctgaggcaggagaatggcgtgaacccaggaggcggagcttgcagtgagccgagattgcaccactgcactgcagcctgggcaacagagctagactccgtctcaaggaaaaataaaaaaaaaaggattgttttgtttttttgacagggtcttgctcttctcccaggctggagtgcagtggtgtgatctcggctcactgcaacctctgcctcccggactcaagcaattctcttgcctcagccttctgagtagctgggattacaggcgtgagccatggtgcccagctcccagctaatttttaaatttttttgtagagacagtgtctcgctatatttcccaggctgaaagaattcttaacagcatggataggatgtccagtaacaacaaagtataagcacaaaactgcatatgtcatggctacatctttgaaaaatcaaaggctgtaggaaaatacataaaagattatcctgggctgggcacggtggctcatgcctttaatcccagcactttgggaggccgaggcaggtggatcacttgaggtcaagagttggagaccagcctggccaatatggcgaaacctcgtctctacaaaaaatagaaaaattagctgggcgcggtggctcacacctgtaatcccactactctgggaggctgaggcaggagaatcgcttgaacccggtaggtagaggttgcagtgagccgagatcgcaccactgcattccagcctgggtgacagggcgagactccatctcaaaaaaacaaaacaaaaaaaagattatcctcttgttggcattataggtgattttcttcagtcagcatatatatatatatgtgtatgtatatgcacacacacacatatatacacacacatgttgtacctgagcgagttagagaaaacgccacactttgagacgaattaagagtcctttattagccggcaaccaagagacggctaacgctcaaaaatctctcggccctgaggaaggggcttgactaacttttataccttggtttaggaaggggaggggaactcaaatgcaataattttacagaggtaaaaacatgcaagaatcaaaagaagcaaaatggttacagagagataaacaatttaaaagacaaatggttacaaaaagcaaccgtaccaggtgcagggctctaaatccttcattataattagatatggggctatgcgggacacaactcaaggctttatgttgttatcactttgagaaaaatcctgggaacttcatacattgtttgtgccagtaccttatcagttaattgggctcctttgaaatgctgaggatctgcttaacacaggtcaactccttgtggaagggggttgggtgaggagcccttagtgtcttgtaaattaaagggtcaattggagtttgtccggctttcccagctagagagagagtcttatttacatgagaagcaaggctaggtggttaaagagacaaacagggaagattcaaagtagtgagttagagtaaaaacaaggttaggcatttaacacatgtatgcacacacacatatatgtgttttttggttgtttttttttttttgttttttttttgttttttttttgagacggagtcttgctctgttgccaggctggagtgcaatttcggctcactgcagcctctgtctcctgggttcgagcaagtctcctgtccctgcctcccgagtagctgggactacaggcgtgtgccaccaattttttttttttttttttttagtagagataggttttcaccatgttggccaggatggtcttgatctcttgacctcgtgatccgcccgcctcggcctcccaaagtgttgggattacaggtgtgagccaccctgcctgtccttttttttccccccagacaggactcttcctctatcgcccaggctggagtgcagtggcgcgatctctgctcactgcaacctctgcctctcgggttcaagctattctcctgtctcagcctgccaccacgcccagctaatttttgtatttttagtagaaacggggtttcaccttgttggtcaggctgggcttgaactcctgacctgaggtgatccacctgccttggcctcccaaagtgctgggattacaggcgtgagccaccgcatctggccagtgtatatgtttataactggaaagaaagaaaacagagcaccaatcgtggagggagtgacctctgctatattgatgctggcattcttggctcagtatgccagattgcttttaagataacctgaacctaagggctttccagcatcggaaaaccttggaaaagactaaagcttgtttataggcagagatggactaaaggacatgggtgtaagatttggggtggaggccctttgagaatgttcactgcttacattcctgttacagcttgtgtaacctgaagaggcctgtatggtgggggggaagagacttgggtgagtcagtgacttagtgtggttcatggaaaacagcctggggagggcctgaacagggaaaaagaagtcctcactctgtctccacctgggggcagcagttagccatgcccttcctggggcaggtctcagagtcccactttgagttccaccctccacatgccttgcatacttatgcagaggagtgtcctaggcccctgttcaaaccccttgagcttacttccctcataaggtcatacacatctgccagcacaatgaccatttcctttatattagtaaattttaagtgaaagcacccttcacttctcttagcctggcaaccttcctccttattgattgacccctgtgctttcttcctcttagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggtaagagagtgggtctgagaaggaaggagaacaaggtgtagcaagtgctgtgattccaaaggctgaatgttctcccttgccgcttcaggaatgttccagcgactggacaagctgaggaagaatgccttcgccagtgtcatcctttttggaaccaacaatagcagctccatttctggagtctgggtcttccgaggccaggagcttgcctttccggtgaggaaggtggaggagaggagtctctttagggtggggcagggatataagaagcactgtgttttatttctgagttgatggatgtttaggagggttcaggaatgcttataggaaggagcagttcatgttcacaggagacctggggtctgatgacatgtgtttgagctggaagtaacacaggtgtggggtggtgtctcataacttgaccacatgctggctttttatccccagctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaccctttcctgtcctgcctcctttgtgagtggtggcgtcttcaaggggagtagatatgttgaagcagggtactttctgtgttcgcagtacctcgatatgcaggagagaagacttcagaagaacagaaatagaggcctgtgttcacttgtgattttaattaccctgcctcctacggtgatgactgtcttctagctgggaaagagcggaagcagttggggcgggtagtgacatggggctttgtgactacctaattcttagggatcagattccaggcctttcccagtgaagggagagaatagctgctaataacaagagctaacgtgtataattcacagagcgcaaaggaactttacattatttcctgtaactgtcctgtgaggtaggtagctgacaatatgcaagggttgtagtttctttttctttttttttctttttttttttcagacaaggtctggctctgttgcccaggctggagtgtagtggtgcagtctcagctcaacctctgtctcccaggctcaagccatcctcccaccttagcctcctgagtagctgggactataggtgtgcaccaccacgcccggctaattttcgtggtgggtttttttttttttttttgtagaggtagggtttcgccacattgccgaggctgttctcaaactcctgacctccagcggtcgtcccgccttggtctcccaaagtggtgggattgcaggcatgcatcaccatgcctgccctagggctgtggttcaaatgcctcaaacctgcaggacaaggcacagactactcagaacagacactggcctggcccattggcccattcctggctgtgttatcagtctggtggtggtatccctgatttctaacgggaagcatagggatttacagatttcactaacttgactgtgatcacacattttaagtggtagaggcagagttttgaacccagtgggtgtcactttttttttttaatttaaaatttttttggtagaactgggtcaggaaaatgttttaaattttatttatttgagagctggggttcttgctatgttgctaaggctggagtgcagtggctggctgtacaaaggctcaatcgtgctatagtttttttttttctttgagacgggagtctcgctctgtcgcccaggatggagtacagtggtgcgatcttggctccactgcaagctccgcctcccgggttaacgccattttcctgcctcagcctcctgagtagctgggactacaggcacccgccaccgcgctaggctaattttttgtatttttagtagagacggggtttcaccgtggtctcgatctcctgacctcgtgatccgcccacctcggcctcccaaagcgctgggattacaggcgtgagccaccaatcgtgctacagttttgaagtcctggcctcaagtgatcctcccacctcagcccccttagtaggtgggattataggtgcatgccatcacgcctcacttgggtgtgacttttttttttttttttgagacagtttcactcttgttgcccaggctggagtgcaatggtgtgatctcggctcaccacaacctccacctcctgagttctggttcaagcagttctcctgcctcagcctcctgagtagctgggattacaggcacgtgcaccatgcccagctaatttttgtattttcagtagagacggggttttatcatgttggccaggctggtctcgaactcctgacctcatgatttgcccaccttggcctcccaaagtgtttggattacaggcgtgagccaccacgcccagtgggtgtcactttgaagcctgtgtccacaccctgctgcctcctagaaggtagagtagttgtaattgtcagctaatatcctgctcaggccaaaggttactattttttcccctttgagcttaatttttattaatatccttttcagattttcttgctcttctgtcttttccgaagatcattgaagatcttcctgtaaatttaacagctcaggtgaaactg

SEQ ID NO: 16470 - DNA, 8112 bp, Human
cagggtcagttcatcaggaaagggatatcagaccatgtcactccctgattaaaaccttcaagagcttcccactctgagtgtaaaggccttagaacgaggccttgtgtgctctggcccctgaatgccccctttgcaggcacagcaaccctttcgaagccctcaggcacaatggggtccttcttttttttttttttttctgagacggagttttgctcttgttgcccaggctggagtgcaatggcgtgatctcagctcaccgcaatctatgactcccagattcaagcaattctcctgcctcagcctcccaagtagctgggattacaggtgcccaccaccacatccagctaatttttgtatttttagtagagacggggtttcatcatgtcagccaggctggtctcaaactcctgaccttaggtgatccacctgcctcagcctcccaaagtcctgggattacaggcatgagccaccctgtctggccttttatttgtttatttatttttatttatttatttatttttgaggagttcttgaagtgccacgcaatgcctctccatgtctatctaccccagttcccgactcctagcaccacatctggcacatcataggtggtcagcatttattggatgaatgaatggatcaatatttgattgagtcttgaagtacgaatagaatttggcgaagtggacaaggcaggaaatgtgtattcaggcatgaggcttagcttgtgcataggtagaaaggcatgaaaaaacatggaacattctcgaatccacaaatagtaagagagggctaagtcgttgtgtgggggagaggagaaatgaagttcaaatggtaggcaaaggtcagtgggcaagggccttgtaaattgcacttgaattttattctttaggcaaaaggaagagtttaagggtttcaagaagaaggacacgaccagtgggttttaggaagatcattctgatggcctttcagaggatggctgaggagagctagcagggaggcagggaggtcgagtcaggggattttgaccaggccaggttaggtgctatgaggcccgggctttggagaagaaccaggaaatggcaactggaggcaagaaaggggagaaggccaaagcctgggaaccatcaacacttaagaacagtaaagaataaacatctaaagagaacaagaaggaatggccagaagaaggaaaacaggaaagaactgaggcgtgggagcgcaagagagagaatggttcgagaaggaagcagtcacaggtgtcaaggccattgggaggtcaagtgagataaggactgaaggtcccaccaattgggccatcaggagcacaggacttgagagcacttctgggtgggaacagacccagcctggggcagggctcaggtttctgatgggaattctggaagggtcccttttattcaacatgcttcaatccaggggcccccgaagtctgaccacagcaatgctccaaaccatgtgtctttcctggcttaaggttcagtcgccctcctcagaggggagcctatgaaagagcccagtggagtgtcagggtcctgagtcctagtcctagtcctgtccctgccacttgtgagggaacttgggcctcagtttctccaggtgggctccacaattgcttctcttgatctggactgccccagtgcccaggttcagtgagtgacacaggcagctgggtttccacatcctctgacttgggttcccttcactgcctccaggcagggctcggccctccacccccaagtggcccattgtgtgagctcagtttcagtggggacagaaactgggttgagaaaagggaatatttacctatcccaccaagccaatgccaagtaaatagtgcagtatcttatgtagagcccttgccctgcccttccccatctgggtgctgctgcctagagcatataaaaggcaccttgctgggcatgtctcatactagcccaccagactcagagacggaaccagagacgggccagagcatccccctcctccaccatgaaactcgctgtcaccctcaccctggtcacactggctctctgctgcagctccggtgagtgctcagagacccttccctccctcctggacttaggaactctcaggaccccccagttctgctcagaagaaggagtgagctgcccattcctgctctggagctgctgggaggacctgggcatgctgagtctcagaaaactgggtctggtgagcaagctcatcttggaaacttggagagagccccaggctgtaaggaagcctaaaaagggtcccatcttctatatccaacaaccctcagaatcccagggaatggaatagcctggagggaggagtggagaataccccataaagatgagtacatccagcataggaataatgaggccctcatcccagatctggacagactccaagatgctgagaccttggtgcagcctccaagtctggggtctccactccatgctggcagctgaagtcactggaaggggagctgcagggactcgtgaccccaaaagaaacccaacccaagacaaggtctctcattctgggcacagaggaatattccagaaagagagcttccctttggggaactgccaacccagagtgaagttttctaaacatttccgtcctctgcaaaagggattaggagtctctgagtagttgctgctgtcactaaaaggaaaagaactgtggggggaagaggggcagaaagagagacggagagagggggagaaaggaaggaaagaaggatcacagctctctccaagatcccccgtctttggggaactgggttatctaactctgtttttcactctgcgtcagcctcttccattctcatctgaaaatgctgttgttattttttaataaacaaactccaattaattcacttggaaagcttcacaacacccatggagataagttttatgaccctggggagttagaaaacccaaaccaagaagcagtaggaacaactattttgcagagaggtttatttgtttttcagagaaaatgacatcattttggactgaaatgtgtattaattagaagatctcagtgctgtctgcgtacagaggtgggtggctgagcaagataggactgcaacatgttaaggggtgggtcagagatgcatttgtctatttgtgtgcacatgcatacaatatttaacacttacttcacacaatgtgccaatcactgtcaccctttcacataatatctcttttcattcttttttttttttttttttgagacagagtctcgctctgttgccaggctggagtgcagtggcgcgatctcagctcactgcaacctccgcctcccgggttcaagcgattctcctgcctcagcctcccaagtaggtgggattacaggcacgcaccactgcacccagctaatttttgtatttttagtagagacagggtttcaccatgttggccaggatggtctccatctcttgacctcgtgatccacccacctaggcctcccaaagtgctgggattaggcgtgagccaccatgcctggcctctctttttattcttacaacaaccctatgaagtagggatattgggccaggcacggtggctcactgcctgtaatcccagcaatttgggaggccgagttgggtagatcacttgaggtcaggagttcaggaccaacctggccaacatggtgaaaccttgtctctattaaaaatacaaaaattagccaggcatggtggcgcatgcctgtagtcccagctacttgggaggccgaggcaggagaatcacttgaacctgggaggcagaggttgcagtcagccgagatggcatcactgcactccagcctgggcaatagagcgagactccgtctgaaaacaaataaataaataaaaataaaatttaaattaaattaaaatttaaaaaataaaaaataaaatgaagtagggatattgttcccattttacagatgagaaaactgagctacagaaacacagagtgacttgcctggtgacacagtaagttacacatcaaggacctaagttctggagagggtctgacttggagtggcaatttctagtgaggccctagagtcagaggagggaaggcaaatttgttcagaaggcagagaattcaaggaaaagggatttgagactcactgggaagatggaggcaagcagtgggtagaaaatggtgactttcccccatgttcctggttgtaaggacctgagaagaaaacagagtctggaagctctgtgttgaagggaatgaagtggtacaagtggctgctctgtccatgagctgagtgtgccacagggcccggtgtgcacatgtgcacacctcttcccggccaggttcgggggcccatgtttggctggtacaatctcaatggcttcttttcttttcttttcttttcttctttttcttttctcttgcttgcttgcttgcttgcttgcttgcttgctttttgagacagaatctcgctctgttgcccaggctggagtgcagtgacgagatctcagctcactgcaacttctgcttcctggattcaagtgattctcctgcctcagcctcctgagtagctaggattacgggtgcccagaaccacgcccggctaattttttgtatttttagtagagacggggtttcaccatgttggccaggctggtctcgaactcctgacctcgtgatccgcctgcctcggcctcccaaagtgctgggattacaggtgtgagccaccgtgcctggcttacaatcgctttttcctgccagagcctgaatttgtcacatgcccccagtgaagcatggctcagggcatctctaaccactgatgagaggcaagtttctggtgggaaataaaaccctcagtggcctcttcccagcctccacactgcattaaaaaatcaggccagcagcttctatgatcaatactctgccttgatctccaacagaaagaaaaacggcaccttgctcacctcaacccaagaagtctaaggaagactcgggcaatccacaaatcttacactctagtccatcgatgaaaaggctgctatctctcgctgatgggcctggctgtttgcatctgggcagacccagccagagggctagccagcttggaaaggggcctggagacatgtgccttctctcctctgtgttgcagcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggtaaccagcacctttcacgtcacactggttagaagtggcttccccaagtggggctgcaggattgccccagttttcagacctgtttctaatccagagaggagagtcacagtgccactgtccccaggcaggcagcacagtgatctttctagacatctcctcttcctttttttttttttttttttttgagacagagtctcgctctgtcgcccagactagggtgcaatagcacgatcttggcttactgcaacctccacctcccaggttcaagcgattctccggcctcagcctcttgagtagctgggattacaggcacccaccatcatgccgagctaatttctgtatttttgtagagatggggtttcaccgtgtttgccaggctggtctcgaactcctgacctcaggtgatccacccgcctcagcctcccaaagtgctggcattacaggcgtgagccaccacgcccagcctccccttactattttgtaagaggcttttgagaaacaatccaagcccttactaccttagttcctcctagagttgactgcacctctcggttaatgttgaagtttctgtggctcgtcatctctgcctaactatgcaattcattcactgttgtattgggtttttctgtttctttgtctatttgttttaggaaaaaatagcccaaagctcactgtgtaattagcatttagaagctgaagatccccaactgctccagcctctgccgctgccatgctttgagtccacgcccaccagccttgctctcttcaataaaccacaagcatctcacttttgtgccccctgcgtggttttggtctccttgttatggtggggggtctgcccctgtcagggtaaggtgagccaggacaaaaggaaagcagccgagctctgcccttggatcccagcagaaatctctgtgctcttccaaagctcttttcctctaggtttctgcctccaacagagctcaagccccctccccttatatcagaccatctactcaacatcacagactctactcaacatcacagactccacttgtccaacagaaccagtgatcctgccccagtctgttcctatctcagtgagttctggctccatcctccccgctgggctgcaccagcctgaggagcatccgcgatccttccttctctagccaacccaggctacctctaaagggcctctggaatccttcactccaagtccacaggcaacacccccatccctgcctgtacagcccccggggcctcctctctggctcccagccagactccagggcccccacaatcccttctccaacaacccaaaggaattcttctcaagtgcaaagtccctccccatccttcaaagctttctagggctcttattgtaaaatcctaaatcctgacgatagatagtggcccctcaccagtctttcctgtgctcctccttcccacggctccttcattctgctcagtccccacacacacccccaccttccctgccctcagtttttaaaaagagccaagcccctttcaaccttaagacctttgtaccagccacacagccctggctgctcaaaaagtgtggctgatggccaggcacggtggctcacgccggtaatcccagcactttgggaggccaaggcgggaggatcacctgaggtcaggagttcgagaccagcctggccaacatggtgaaaccccatctctactaaatatacaaaaaattagccaggtatggtggtgcgtgcctgtaatcccagctactcgggtggctgaggcaggagaatcacttaacctgggaggcagaggttgcagtgagctgagatcgtgacactgcactccagcctggacaacaagagtgaaactccatctcaaaaaaaaaaaaaattgtggctgattggtttttaaaattgctctagagcaaaatgtgcaaagaatagaactcatcctaaagatgcatccatgtggatataaagacccccaaatccccggccagtttcatggcagccagccccctgctgggccacattatccacagcacctaaatagaagcggaggattggctgggcttggtggctcatgcctgtaattccagcacttcgggaggctgaggtaggaagatggcttgggcccaggagttcaagaccagcctggcaacatagtgagactccatctctacaaaaataaaaataaattagccgagtttggtaacgcatgcctgtagagctggctactctggaggctgaggcaggaggatctcttgagtccaggagttccaggctgcagtgagctatgatcatgccactgcactccagcctgggtgacaaaggtgagaccctgtctcaaaaggaaagaaagaaaaaggtggaggactgcagaggggctgcaggaatcggaagggcgtcggcagagggcacggaaggaggcggcgggttagagacggagctctccagttcgagcccctccatggagcaacgtggtccggtgggccttgtgccccgcggccactagggggcagcatcgtccacagggtcctggagcggacgcgctgtcggggctgaggcacccagagctccggctctgaggatctggtgtcatccgtataattttttaaatctcggccgtgcgcggtggctgactcctgtaatcccagcactttgggaggccgaggcgggtggatcacctgaggtcgggagttcgagaccagcctgtccaacatggtgaaaccccatctctactaaaaataaaaaattagctgggtgtggtggcgcgcacctgtagtcccagctatttgggaagctgaggcagg

SEQ ID NO: 16471 - DNA, 22906 bp, Human
ccattgtaggtgggaggctgagctgtgcatggtttttttgtttttttttttgagacagagtctccctctgtcgcctgggctggagtgcagtggtgtgatcttggctcattgcagcctctgcctcctaggttcaagcgattctcctgcgtcagcctcctgagtagctgggattataggcatgcaccaccacacacggctaatttttttgtatctttagtagagactgggtttcaccacgttggccaggctggtcttgaactcctgacctcgtgatccgcccacttcggccttctaaagtgctgggattacaggcgtgagccaccgtgcccggccggttcttggttttaaagaggtaagtcaggatggtggatcactgccattgacttgaggcatgcagtctgttgttatggcttatgaccaccacccattcatttgttctttcactcattcacctgttgggatatttaatgagcccctgttgtgatgtagtagaatatggttgtctcttggaatcctcaggggattggttccaggacctcctttggataccaaaatccacagatgttcaagtccctgatataaaatgacatagtatttgcatataacctacacacatcctcctgtatactttatatctctatattacttataacacctaataatgatgtaaaagctatgcaagtagttgttatactgtattattagggaataatgacaagggaaaagagtctatacatgttcagtacagatgcagctctttttcaaatattttccactggtggttgattgcatccatggatgtggaactcacagatatggagggctgattgtacttcttccttgcttgaggtttttgtaatggctatcaagttttttgttttgttttttttttttttgagacagtctcgctgcgatgcccaggctggggtgcaatggtgtgatcttggctcactgcaacctccacttccttagttcaagtgattctccaggctcagcctcccaagtagctgggattacaggcgcacaccaccatgactggctaattgtatttctagtagagttggggtttcaccacattggccaggctggttttgaactcctgacctcatgtgatctacctgcctcggcctcccaaagtgctgggattacgggtgtgaaccactgcgcccggctggttatcaagttttaaggaggatacctgagctgctagttttataagaaagtgagaaaaaactgtttttgtgttttctcttgctcaatgcttgtaggcaagttttcttaaaagcaagatattgcttactgttcccttcttgttctatttatgctccatttggagggcatttcagctcaagggagaggggtgtgggaggccccttgagggcatatctctggatcactactttctcactcattcctttggaacacagaatctcttctgctcactggcctcttaaagaggcagttgggtttgatgttctttggcctgatgtctggagtcagcttgtatgtagtgcagggtggctgtgtcttagcccttacttaaccatgagtagtaagatgagggcctactggagagcgagagcaggactgtgtttgggcagggagtgaggggccctggggtggccaggaagacagatggcagtgccctgtcatcttaagcccagaaaaggccatttataaggaggactgtcaatgtcagaattggttgggaactgtggacttatggggacagtcatgctggcgggggggtggggacagggaggtatttgaagagtgtgagtagaagggcttctctttgtagagatgaggctggggatgagtgtttggaattctgcagctctggggagtggctgtgagcagagaggggccctggttcgggcactgggtgtttgtggtggttgtgggtcaggtgggtattgcagcttggagaaagccccagacccctaccctgggcccctaacttgtgcctcttgtccctgccttcaccagacagagccaccatggggacgacggccccagggcccattcacctgctggagctatgtgaccagaagctcatggagtttctctgcaacatggataataaggacttggtgtggcttgaggaaatccaagaggaggccgagcgcatgttcaccaggtgaagacgggcacagtgagaggctgggaacaccagggcctgtctgggctgctttggtcttggggacacaacagcccctcgtccccgcctacctggcaaaacagacagcctgtcagggctccctgctgtatactgtgtgtgcagtgtgctgggggcctgacctagtgtcatgggaagaggcagcaggagagatccagtcccttgcctattcgccatcgttgctggctgggcctctcagggtatgtggcaatggacgtgcgcctgggagcttgcttccctgccgtgtctccaggaggaagccctgagtgcccgcaggtgacttgcacatggccttggagagctcacttggtgctggacaccccagcttgacctgtcgctgccaggaaatgggcaggggccaggctgggtgggagaggggaccagtggttcccaggcagcctcaagtgacaccctccttgtgccaaacagagaattcagcaaagagccagagctgatgcccaaaacaccttctcagaagaaccgacggaagaagagacggatttcttatgttcaggatgaaaacagagatcccatcaggagaaggtaggaggggttgggggagagtgagctgagcagtgggctctgcggaggcttggtgccatctgggagtttgattctgaaggtgttgatttggaagtagcagcctgtaggaggggtggtgggtaccaccgcgggtactgcgtgggccatgctgagaggggttgggatgccacagggaactatagcttgacccaagaccctggagtccaaatctgtggctgtgtgttgggggtgggggtgtttgatctgggccctggagaatgggaaagatttccgtaggtgggatgagaaagagaagccatccttctgttaggtgagtgtgaccaggggtgtagaccacgtgccttgtcccagccgtcatattgtcatgcttgttttagtccccctcaggaatgattggggctgcagagtgctagggaaagaggctgggtcttggggttaggcttgggtgtgaaccccagctctgccccttagcagagcagtacggctttgaattgaatttctgcctctctgagcctccgttcctcatccctaaaatggggatagtggtctctgcctctcaagggcgtgctctggattaaggcagagcgtgtgtaaggctttcagcaggggctcggtgtggtgtaacttcagtcagccggaggtttggatgaatataatcttcctagccagttctgtgcggactgtggcatgatccccaatttacagttaggaagactgcggctcagacaagaatggcctggggcctcatggctagaggtggcagaatctggcctggaacccagatcttttgccttcaccttctcttatcatactctatccaagctggtggctcttggagagactgggtgccaccctgtcctgctgcccgtctcagcctctgccctgctgcccctgccaggttatcccgcagaaagtctcggagcagccagctgagctcccgacgcctccgcagcaaggacagtgtagagaagctggctacagtggtcggggagaacggctccgttctgcggcgtgtgacccgtgctgcggctgcagctgccgcggctaccatggcattggctgcaccttcttcacccacccctgagtctcccacgatgctgactaagaagcccgaggataaccacacccagtgccagctggtgcctgtggtggagatcggcatcagtgagcgccagaatgctgagcagcatgtcacccagctcatgtccaccgagcctctgccccgcactctgtccccgactccagcttcagccacagctccaacctcccagggcatcccgacatcagatgaggaatcaacacctaagaagtcgaaggccaggatactggagtccatcacagtgagctccctgatggctacaccccaggaccccaagggtcaaggggtcgggacggggcggtctgcgtctaagctcaggattgcgcaggtctcccctggcccacgggactcgccagcctttccagattctccatggcgggagcgggtgctggctcccatcctgccggataacttctccacgcccacgggctctcgcacggactctcaatcggtgcggcacagcccgatcgccccgtcttccccgagtccccaagtcttagcccagaagtactctctggtggccaaacaggaaagtgttgtccgcagggcgagcagaaggcttgccaagaagactgccgaagagccagctgcctctggccgcatcatctgtgagtctgggggcttggcagtggcgggtggtccttggtgccaggctcagatggaggctttctgagggatcatctagcaaggagctgtccagagagctttctgcagtgaggtagatgttacacatctgtactgtcctgggatggtggccgctagctggcctcatctggcgattgtgtcctcaaaatgtggctagtgtgattgaggaactgaattttaaattgtattgcattctacttcttttagatttaaatagttacatgtagctagtggcttccacgttggatggtgcaggtctgacccaacctacttgctttacaagtgaggaaactgagcttcgggaaggtcggccactgtgtggctgtggttactggccatgttgaggctggagcctgggcctcttccgcagggccagctcattcctcccaaccctatgctgcagaggccacttaaattcaccgggtttgcgcgccgcctattggcgacactgtgtttgatctagaggagggaattatggcagcaggctccttcggggagatcagatgactgggcatctgatgggagccaggagggggaaccaagctgactctggagctggccggcctgggtctgagtgccaactcagccattcacccaccctgcagcctggggcaggtcctggaaacttcacgggcctccactccttgcctgtcaacgggggctaatcgcgtcacttcaaagggtcgttgtgaggttttctttggtcaccccacacagggagtttagaagggtgcctggcatataggaaggactcggtaatgttagctgctctctcagatctcagcttagggggccattgcccactggagcaggtgtctggaggggcaggctggctgcatgaggaggtgaatctgagctgggagggttctgaaggatggctgcgcttttgctgagtggaaaaaaaatgcggggatatgtgttattggcagagggaacagcttgtacgaagaccctgatgcctaaagcaacaagtgatgggtgtctggggctcatgctcacacaagagcttgaacttgaccccactgaagcaaaagaagtggcttgatgatgggaaagtgagggaaacagggagaccagataggaggctgctgtaaggatgcaggcagaggacgggcgaagcagcggattggtggcgaggataggccaggatttatctttttttttttttgatacagagtctcgctctgttgcccaggctggagtgcaatggcacgatctcggctcactgcaacctttgcatgcatctcaggttcaagcaattctcctgcctcagtctcccgagtagcagggattacaagtgcccgccatcacaccaggctaatttttgtgtttttgttttttagtagagatggggtttcaccatgttggccaggctggtttcgaactcctgacctcaagtgattcacccgcctcagcctcccaaagtgccgggattacaagtgtgagctactgcgcccagcccaggttttatctcaacgcatgttaaatagtagctggcatctgcctggcactttaagatttataaaatgaaaggttatttcatttggtccttacagcagcattgttagcttgtgaggaatttttcactttacagaggaggaaactgaggcttaaggaggccatggagtctgtaaatcgggaagctggggcttgagcgctgtgtgtttcattctgtccagaaagtcaggtgcttgcagaagaggctttgtgcaaggccgcagggcagggcctgtcaggcaggggagggcacctcaccttggcagctttctctctgcctgagtcacactgcctggggacgggcctgctccagggtttggggtgacatactctggggcgtgtgcagatgtgcagtctgccacactgtctatttctggattctcagaaggatctaaatggttctgatctgttttggagattttctcaggcctggatctgatcttgggaaggggcttcaagcgggggcaggtgagcctgggcctgtagagggagggccaggcagggttgcagagaatctctggagacctttggagcagacatccagatctgcagctctcatgcccttccatcactcttccctctctgtctaccctttccctgcccatgaatgggcttctgatttgactggtgcatgttacctgggtctgtctgactcccagcccagcatcatctctcctcttgagggggtggaggagagagaggaggatacaggatctaggatctggagtcacacagaccctgggtgaccttgggcacaccccttctctcaacctcagcttttctgtgaaatggtgataacacttgctttgaatgtgaatagataactcatcttagtgcttgagtgtagtggatactcagtacatcttatttgagaaaactcaccaatggctgatgctcagtttgggtgcgacaaggccgacccctagtgaggagctgcaagggtgtcagggagtggggcggtgacaggggaggaggcttcctgagggtcttcctgataccaggctctgggagaggctctcgggcagctccaaggtggggtcttggtttgggtgttccccacgagcagcccttgacacaaggatttgagttcaatttgttaatttttgggaaattaacaaatttaatttcccaaaaattaaattcaggatgggaaggaaacacctgcaccagaggaatggaaaaatgagataggaaaaaaagccagcagtcagcgtgggtggagggggcttctggaagccagagtgtggccccggggcgtggaactgctgtgtgtcagcaggaatcccctgcctcctggcctggtgcgcacctgcctgcggggcccatcgggcagcagttctgaagtggataggaagggacaggcccactgcctcaggactccaccttggggcgttcgagccacctctgcattggagaagagtccttccatccctctgccagtgcttaggccacttccctaccaccagaccagctctgaggcctgaatggcgtgcagatggcacttagcattccagagaatgcttgtgctggtgggagagccatgtagtcacatgggcgtcttcatcagggagcacgtgagctgggatgacacagcatggggagatgaggaggatgtatcttctgggtataaaccccttaaatgggggtcatcaccacccatgactgtcagcccggcgctgcagctgctcccaccacctccccaaacctggctgctatacccaggaagggtcctggcttcccttctctgtgcctggcctgttgtcttccctcttttcctgagaccctgtgcaccccaacctcccgctggccacctcccagcctgaactctgaccaagcccccatggctcaggatgcgccagctcagctaccttctctctgttccccaaaaaagcctctttttttcctgcctcatggccttggccctccttctccctagaccagtggcactgggaacaggcatgctcccagctaggaagaagccggggacataaagctagcagctgtggtgaggataccagggtgagtgctgagggtgagggacctgggcttcctgtttttaatgattaagcctcagcctcaaaaagcttttgacagcctggacaacatggccagaccctatctctaccaaaatggaaaaaattagccaggtatggtggcatgtgcctgtagtcccagctactcaggaggctgaggtgggaggattgcttgaacccaggaggtcgaggctgcactgagctgagattgtgccactgcactccagacagagtgagactctgttaaaaaaaaaaaaaaaaaagctttgattatgaggttatatctattgatcgttactgtattaaaaattaaaactgaggagtttaaaagtattttaaatattaatatttttatatgaatatttagtactttaaagatttaaaaatattgtttaatattttaacattataaaatgcaagtaccaagcctatcacctgtttacattaagactttttatgaaaaaataacttttccaaaacaaaaatgtactgaagacactggcattattctacattttgcaaatctctttattgtatgactttaaataagccacattctgcgtttgatctgttgttgcattgtgttgtttgggttaaagtaactgaagaactggacgggcgaggtggctcacacctgtaatcccagcacattgggaggccgaggtgggcagatcatgaggttaagagattgagactgtcttggccaacatggtgaaaccctgtctctactgaaaatacaaaaaattatctgggcgtggtggcacgtgcctgtagtcccagctactcaggaagctgaggcaggaggattgcttgaaaccgggaggtggaggttacagtgagctgaattcacgccacttcactccagcctgggtgatagagtgagactctgtctcaaaaaaaaaaagtagctaaagaacatctggcctcacatagacgtgtagttgggaaagggaggagtatcttcatagctttttcagataattatgcatattctttgttatcaggaccagcgcaagaagtggtagttcttaaaggtttgttgtggtgtggaatctgaaaccatgttgctgattccacacgggtctaccttgcactttgttttgtttttttttgttttgttttgtttttgagatgaaatctcactctgtcgcccaggctggagtgcagtggtgcgatctcagctcactgcaacctctgcctcccggttcaagtgattctcttgcctcagcctcccgagtagctgggattacaggtgcccaccgacgcccggataatttttgtcttttcagtagagacggggtttcaccatgttgccaggctggtctcaaactcctgacctcaaatcatccgtctgcctcggcttcccaaagtgctgggattacaggcgtgagccaccacaactggccacactttgaatggatcttttagatgtgtctgatttcataaccacatacatcgatcatttcgaaaatattgtttcaccaagttatgcacgtcttccaagtgttgacacccttcattatataatatcctaaaaaagcacatttgttttctgacctcatcagaaaagtccttagatattaggatgctgtgaccctgctggtggtggatacgcgcttttcaaaattctactcttggattcgttttggctcaattttttttttctttttgagatggagtcttgctctgttgcccaggctggagtgcagtggcacaatctcagctcactgcaagctccgcctcccgggttcacgccattctcctgcctcagcctcctgagtagctgggactacaggcgcccaccactacgcccggctaattttttgtatttctagtagagacggggtttcaccgtggtctcgatctcctgacctagtgatccgcccgcctcggcctcccaaagtgctgggattacaggcgtgagccaccgcacccggccttggcccaatttttaaattattgtcagcacgtggtgttttatttttgtgatggattcacttcattgacttgtgaaaaaatgtcttccagatacccaagactgaataaccattgtcagtcgttcttttaattaataatagtggttcaggtgaaaaagtggctagtgcagctggcagcttagagacgagcgcttttcacagagagttgggtttgcagcaacaggcattgtgcacacttcccacgtcagcacacagaagagtagaatggcatgtacttgagtttagatttagtaaaattaggacttttgcaggcgcagtggctcacgcctgtaatcccagcactttgggaggctgaggcaggtggttcacttgaggacgagttcaagaccagcctggccaacatagcgaaaccctatctctactaaaaatataaaaaattagctgggtgtgatggtacatgcctgtaattccagctacttgggaggctgaggcaccagaatcccttgaacccatgaggtggaggttgcagtgagctgagattgcgccactgcattcagcctgagtgacagagtgagagtctgtctcaaaaaaagaaaaaaaattagtactttttacaccttcatcaaggacattcctcagtgaaactggacatctctccttcccgtgagtgtgtggtccgaggatagtgtttgatgctctggccttgactggggctgaggcttcagcagctagttcctcattgcttttgtgccatcagggcaaatgtcaacatagtgaaagggaaagtaacattttagtatcataattttagtatcatgattagttacgacctcgtggatcccccatgggtctcaaggacgtccaagggtcagaggatgcaagctgagaaccactggcctggacatcctcctcctttgtaaactcctccaggccagctcaggtccccccatcataggcttttaaaattctctgctctggaccaggcgcagtggctcacgcctgtaatcccagcactttgggaggccgaggcgggtggatcacttgaggtcaggagttcgagaccagactggccaacatggtgaaaccctgtctctattaaaaatacaaaaattagccggaagtcgcttgaacccaggaggcagtggttgcagtgagctgagattgttccactacacaccagcctgggcaacagagcaagactccgtctcaaaaaaaagaaaaaaaatttctctgctctgttccaccattgcccatgctggtgttgttgataggactatttgatgattgttatctagaccagatggtggttctgttttgctcaccattggggtcctggggcctggcccaggtcccagtacactgtagacacttgatgaatatttgttgacagaataagctgctttgtgttgggccccatgctgggagtttggggcctggagctgcagcaaacattgtccctcttctcgagatattcccagcccagtgaaggtgcccagccgtgctctcagatgggcatgggaagaccatctgggaagcagccggggacatgaagccagcagctccgataaggacactagtatgagtgctgaggggagggtcctgggcatggtgggggctccacggctagtgatgggagcagtggccaggcccttgctggaacccggtcccctggaccccttagagtgggacctgtgtggtctctgatgagatcttttgtgcctttcttttccccctcaggtcacagttacctggagaggctcctgaatgttgaggtgccccagaaagttgggtgagttcagttccagggcttcggaggtaggcagggcataccaggacagggagccaaggtgagcaccagggctggaagcaattcctgggctgagtcttccccactgagccttgaccgcccaggagctgccccgttttccctgtctgaccaggcagtgagtgatgtgggtgttggccacctggtctccttgcagcacccgtcagcgttgctggttgcctggctagacctgaccctggggcgtgggctccagaggttgggggtgaggcggggctgccaggaagagctacattcaaactggctggggtaggataggagtgctccaggattacacccagtgctgcttcgggccaggacacagactccttttcctggaggccgtgtcctgccatcactaaaaccagccccctccctccttgctgcagagcagagggtttgttcttgggacggggaaacagggtgacagggcagacctgctggccttgccagccccatggtgaatagagaacagaccacaaaagagatgcagctcacctgggcccaagaggtggaggcggagctgaggacagggctcacatcctgagacagctctgtggtggggtgccagggagatgaagccacattctgaagctgacatccctcgtctgtccatggagccattgccgggagctgccatcctcctatcctacagggggctgtgggttcgtggccctggccagggcaccttgtgttgacctcttgggtccccatccctggaatggtagagggactccctagggggagggcttggactagctgggcagtcccctcagagtccctcttctgttttcagttctgagcagaaggaaccccccgaggaggctgagcctgtggcggcagctgagccagaggtaagacggctgcctggggaagggaggactcacctctggggctcccgctctgcactgcggccatcctgggccttgggttccaggtcaagacccctaaagccttggttctttccacaggtccctgagaacaacggaaataactcgtggccccacaatgacacggagattgccaacagcacacccaacccgaagcctgcagccagcagcccggaaacaccctctgcagggcagcaaggtgaggcttcctgacctgccgtgtgcagtgcccggagccacagcgggccttggcggcctcggcctgaccttctctctggggataaggaagccccattttctgggccagtaggctaaagagaaattaaacctgggggtgcagagatcccttttgagtctgtagacttcacctcccaccgttgggctggagctgtcactgagtgcagcatggggggctgtggctggttgggacaggaagcagaggaaggggctgcatcggggtatggatatgaagaggccaggtcaaggccttgaccttgactccaggggccagtgggaagagctgtgggctggggattgaacaccccacctggcctcctgctttgcctcccccgccagctcctttctgacctttgtatgtccatccttgtctaaagagggctggagagcagtgggtttgggagtgtcccagggtcctgctcacatctccctgagaagggtgcctctctctggtggaaagtgcactgtagctgtgagatcttgaacacggcctcctcctctttacgacgtggtcagggacaatggtcatgccagccctgcagccccaagggctgctgtgaggaacttttggagtaaggtgcaccttctcctagcagtgaaacaaaacaatactgaccctacaccctccatgttgaccctgcagcgggagctgccccctcctgctgtcatggccacaccagctgcatggcccaggaggggtggaatttagaagctgtgcaaggggcttggagctcctgcttctacaaggcgtccacacactgttcttcgtgtcagaggtgggtggggcacgtctggggctgccgcctcgacaggaccgtcccgccctgccttgcctatcatagagccaggcactcgcggggaggtgttcgtgagctgggggtagccaggccctggcatctgtagatttgtatttttagtagaggccgggtttcactatgttggccaggctggtgctgaactcctgacctcaaggatccgcccaccttggcctcccaaagtgcttgtagattcctcaaggctagtcagggttaaggctgatatgtctgcgtttggccaccccggagctgccaggaagggagccttgcccactgccaaggctgctgcccaaggaccccttccccctacacccccattcccaccctgccgccgccatcgtttctgcagccttgctgaaattgctgtcttcacagaggccaagacggaccaagcagatggacccagagagccaccgcagagtgccaggtttgcatccgggaaggggtgtgtaggtaactctgagggccctggaggatgtggccttgtgtccttgctcagggaaggtggatgtgtgctcaggggcttcagagcctctctgctggggtgtggcctggtgttgtgacttaaccaaggaggcggctccatgctgtggatgagcgcaaacctgggaatagggcgacccgattgttgaccccgtcttagtgtggtctcctggccatgtgaccttggactgttcacctcccttcctctgagtgggcagcagagggttgcttaggctctgcagcctctttcagtctagaggcctgtggcctgggcccggtattgttcaccggggtgacttttgatggggtgtggctgggctgtggcgggctgccctgtgatgccgccgcccgcgccttggcaggaggaagcgcagctacaagcaggccgtgagtgagctggacgaggagcagcacctggaggatgaggagctgcagccccccaggagcaagaccccttcctcaccctgcccagccagcaaggtgagccaggcacctgccctctcctggagccctgacccccttcagtaccctgccccgcctgcccacttctgaccctggtcctcgtctgcaggtggtacggcccctccggacctttctgcacacagtgcagaggaaccagatgctcatgaccccgacctcagccccacgcagcgtcatgaagtcctttattaagcgcaacactcccctgcgcatggaccccaaggtgaggggcctgtgcccaggccgggctttgtgggagctgggcagtgtggctgaaggtccagtctgtcctgtaagatactgggagtagtgtgagcctgggcggaggcaagtgtggcctggcactgttaggggccggttgaagcctctgtggccaccagctgtcttgacctctgagggcactgtcctgcacttgaccttgtgggctctggactacagcctggaggcttggccggctcaatgtgagccctggggatctgtgtagttaaggtgagaggtacttgtggacacctccaccactggggtgagggttgggtgacaggagaggcggtgggggtgctgctggcaggagggcaggccccacgcaggcttgctggcacagctgggcatgtggcctgcccggcaggatgctccccggcctggcattaactcttgccttttcccttgtctcctccacagtgcagcttcgtcgtaagtaaagccttttcctgtcggtaacctcgccccacctagcactcacccgctgtagccccttccctgcgtagctgacagcacctgtagatgcactaacattgtaagcgggaggggagccttaggaagagagtgggacggtgaggggtgcactggctggaggcgcccagcagttctgggccccagcgtccttctctgccctccctgcccttgactctgctcttaggaggaagcaagggggtgtggcttttcaccagggctacagcttgatgtgttctccacagccaccttccctccctcctcccctgcaccaggccccgtcagggtctgtgggtctttgaagagaacagacaggttgtctgtggtccccagagctactgagatttattggttcacagacctgagcagtagccttgaggcagtggggtgatgggggagcgcaagtgtgggtctgaactgaggtggaagtgctgggtcttgctgtgctgggtgacagtagaacagtgggtggtagcgtctagaaacaagtcgcagaagctgttctcttctcagacacctcagagctgagccgagccaggctggccctgagcaaggaccctcagatggggacatgcttagcctgcagccccagctccccgtgccatttgccaaggccacagacacctcattcctttagttcctgcaagccttctgaagggtcctctgcagccacacagggacacctgtgacagccgggagggcttctgcctccagttgagggcctcggcaggtgagaggggcttcccagcagctggccaggtgggccctgagctggcttctccgcatggaggcctgttcccctcttgttggagagggtgactgacagtataccttccagtggccttaccacctgtgccgattagagccctgcaggtctcacagggtgatagagaagaccaggaagtggtcccctttcctgctttggggatcccaggtccctgcacaaggcatctagtgggtggggacagtccatagttaggagaccagggggctacggagtcattttggactgcatcctgaacattctgctatgagtctctgggtcttgtttaaatctatggacaatgttgatattttctcagcattgcaatttagtagcaattgacctggttaggtttaggctgcaggttcccatctgccttctgtggactctggttccaatgttagtcccgattttgaagatggcagtgctgtttggacttttcccgggtgtgtgccagtcagcagtcagcctgggacttggcaggtggtctgttagtttagttctcagccttcggtgtggtaattaggatcagatcctagcatctgcagcttagagctgagcctgggcgttcgtcaataacctgcagcatcattttcccgatctcctctggggctcccttttctgtcctccagccaggaagctggggcttcagttaccttgttctgctttgtgtgcttctacgactgtgtccagggccacctgccagggggacagggaaagaacaacacataggatttggcccacacttttgggatcacagctcctcctctgagttttgacttggcagctttctctgtccagggtcgcctggcagggggacagacggaagagcaacacacagggtttggcccacacttttgggatcacagctcctcctctgagttttgacttggcagctttctctgtccagggtcgcctggcagggggacagacagaagagcaacacacagggtttggcccacacttttgggatcacagctcctcctctgagttttgacttggcagctttctctgtccagggtcgcctggcagggggacagacagaagagcaacacacagggtttggcccacacttttgggatcacagctcctccctcgaattttgacttggcagcttttcttcaactgctgctgcccctggttgccataggactgcttgtgggctggggcacaaggcaaagaagaaaagagaacaaacaaaaatgggatttctgccttctctgagcattagatactccctttctgctgcttgagtcaggactagagggcttgtcctggaattctttctgtccgtgccccagtgactcctttggagttccaggctgtgttgagttaggctggagaaaaacaatggagaactcactgctggttggctggtgcttccaagtctggtcttcttccctatctgcctgctcctctttagttttcagaggcctcaagtagccgctccttgcattctgtccaggttttgtagctgcattcagtgggagagagaggtggagtatgtccactccatcttacccgttcccgggaccccttctctccgtctttgggaggatggtattaccttggagccagatttctaggcgagagtgctcctccagttaggctcagaagccaaggagaaatcgatagtaaccagtacaggaagagggggaagctattggacactgtgcctaaaggtgggagtctactgggagccaggttggggtgatgggtgtggggcttccctctgggtcccagcctccacccagccccagactgttcaaggggaaagcactagccttgtccttggccagggagggcttagagcccctgcccatccctgctggctgcccattgctgtggctgtgcccctgggactttctgtgtctgcccaggagggggtgccagcatcaatcagcttttcagccaactagtacttttttaaagttgccttaaaaatgaacatagccagctgggcgtggtagctcacacctgtaatcctagcactttggaaggccaaggcaggcggatcccttgaggtcaggagttcagcaccagcctggccaacatagtgaaaccccacctctactagaaatacaaaaattagctgggtgtggtggcacatgcctgtagctccagctactcgcgaggctgaggcacgagaattgcttgaacctgggaggtggagggtgcagtgagccgagatcgcgccattgcactccagcctgggtgacagagcagactctgtctccacacaaaaaaaaaaaagaaaaaaaagtgcatagccatgtcacaggaagtttggaaaataaaagaaaattaataccatccctaatccatctcactagactgttagcatttgtcaatatttccttttatttttttcaactattatgaaatagttgatatacacaatagaatatatgtatacatatagtatggatattataaagcatgacagtagtaagttaaaccttgcatctgcaccacccccttactagaacattcaccatgattgggagagctgcctttctgctcctcacccttccaagctcatccttcattttctttttcaatgcacagtttatgtagttgtcattagcacataaatcctatttggagcctgacttttgtgttgcccaaaacttggcagggctcaatggagggcactgtggctcaggcccttgcgaggtagctgagtgctcctgggaggaaaggcgggagctgcgggccttggcttgggtgctgttggggccacgttggggatacctctgcctaagaagcattctgatgctgccacccacgtggctgcaggctgctggggactgtgggcagcttttggggctgggtggggggtcgtccttgctcatgtcccatctccctcgctccccgccaccccaggagaaggagcggcagcgcctggagaatctgcggcggaaggaggaggccgagcagctgcgcaggcagaaggtggaggaggacaagcggcggcggctggaggaggtgaagctgtaagtggcctggcttcctggactgtggcccatcccagccttggtggggctccccatgactatcctatgccccgcaggaagcgtgaggaacgcctccgcaaggtgctgcaggcccgcgagcgggtggagcagatgaaggaggagaagaagaagcagattgagcagaagtttgctcagatcgacgagaagactgagaaggtgggagcctgggctgtggaggcccaggcaattcaggacttgggccaagggttaggactggacccctcaggaaattgcagatttgtcactgtacccctgtacccatctcctgtctgccccatgggccctggagtccactcagctctgggtttccctggcagccctttgtgagtggggtctgacactcaggcaggaccggcttctggtgtcctctccctgggtggtgggaacaagccaggtgtgcaggggcaggtggggcctgtcacacacagttctgggctccactctgcaggattgaatgtgggtgctccaatgggcatgtgtgggtgggctctgcaggccaaggaggagcggctggcagaggagaaggccaagaaaaaggcggcggccaagaagatggaggaggtggaagcacgcaggaagcaggaagaggaggcacgtaggctcaggtggctgcagcaggtgcgagcacaggtgggcctcagggaggaggtgggcggggtgggcgctgtctcagcaccatggggccctactgggtgcaccccaccttgtggggttgacccagaccatcttgttgcttcatgctaagaaggaggtttcgcagaagtctccagggcggggatggtgaccagaatctgcctctcctgtagcagcagtaatttgagggttaagtgcttgtacttggagccagactgcctatctcagctctgccatttattagctgtgtgactttctacaggctgcttgacctctctgcttccatgtcttcaagtagcagtgagggttaaatgtgttaatgtctgtaaaatgctcagtagtgtctgatgcctgctaagagttctatacaatggctgttatggtccaccccctgactgttctgcctataagagtaagggcccacctcttcccagccagtcttaggactctagagaaggcaaatccaccattaggggttatgtgactagtcaccaaggtcagttatttactgtgtgctaggccctgctgtgtgttgtgcgtatcaacccagcaaccccatgaagtgtgggaataactgcagtctccattttatagacgagtaaacaggccagagggtttaaatgcttgcccgttgtttcatagctagcgagtttggctccgaggttcctttctgctaaatctacagcagcagcagctgtcacaagatgccttttcaggctgctgctggtggttctggcagagccttgctcgggatgtcccacggcgccattcctgggttgtccgtggtggtggctgatatgaggggcacctgggcttcaggggagtagggctgctgtcctgcctctctggcctgggcctggccgcagcacctgaccttgctctctgtttcaggaggaggaagagcggcggcaccaagagctgctgcagaagaagaaggaagaggagcaggagcggctgcggaaggcggccgaggctaagcggctggcagagcagcgggagcaggagcggcgggagcaggagcggcgcgagcaggagcggcgcgagcaggagcggcgggagcaggagcggcgcgagcaggagcgacagctggcagagcaggagcgtcggcgggagcaggagcggctccaggccgagaggtgagggacctgctggcccgcctgcctgccttccatgtgtgtggaagagagacggtgtgaaccttgcctggacacagccccacctgcatgtgacggtttgcaggtgctttccttggcaccaaacccagaggcccacctgaatacactgcccattggctatgggagatccaaggagtggtaggtgggcttgcttagggcttggcttggttctgcctccagctgcatgtgctgacctcttaggtgtctttttgtaactgtcaggagtgtggtgctcagaggatgagctgatatttctcagcagggccaccatgggcattttgggcaggaaagatctttgtgttacattgcaggatgtttggcatccttggcccctgtccccactaaatgcatctcccctggtgaggacgataactcagattaccccctaccgatattttcagactgttcccctgccttgggaaccgtggacccaggagccctgggattttccagctgtgcagatgcagtggtctctgtacaatagacaagagttccatgtttagttttacaggcatttgtccctggcctaccctgtgcctggttgttctgagagtcgtggggatgccaaggaggaaaagccacactcactgttggtcaggagatacatgggatcctgtgtctgtgtgcacagaagtagagcacaaggcccgtgtgtgtgagacacgcaggccccgtagctgttccctctcccgctctacctcctgggaaacaccgggcagcacgttttttccgtgtccatcttcgtgggtggcttcaggtttatcagataagtgaagagtcacagccagggggctgcactgagtcagggctgcttgatggggacaaagctgtccttggtcctctgggcagagtctgggaaggcgagaaggcgtagggtgtagctaatgtgcagggtgctgggcagagcagggggctttgagggtggcggtgtgatagtcatagtgtcggcagctttggtgggtacccgagctgcatgctttacacctgtttccttgtttagtcctcagttgaagcccatggtggcatgggagccatcagctccacttcacacagggggaaacaggtccagagaggttaaatgacatgttcaaagtcatgagccagtgtgttgtggaggtgactccagaactcatccacagcctcttgttcatgcttggagccagtgtctgccctgaaggttaggataaaaaggggtattgtggattatcccatttgattctcatgttgaccctggaggaaatgtgttatggtctccattgtataaaagtgttatgaggctcagagacccaagttacaaggaaaagtgggggccaaatgttgggctccagcttgtgttccctgcaccctcaggtgtgcacacttctagccccggggcaaaagcgcagctcttggctctaagctggttgcccattcagcaatcccactttctaaggtgtgtcctactggctgggcctggtttccccagcagggatgggaacagggcttgggctgggcctccacttcctgtcctaacaggctcttgctgggtcctcagggagctgcaggagcgggagaaggccctgcggctgcagaaggagcagctgcagagggaactggaggagaagaagaagaaggtgaggggagctgggttgcgggctcccctggggtctgccctgagctgtgggcgggtctggactcctgcagcaggggctgcctagggaggggagggaaagggaggagaatggagcggagggaaggggaggggagggaagggcacctgcacagctccctaacaccccattgccacctgggttccaggaagagcagcagcgtctggctgagcggcagctgcaggaggagcaagagaagaaagccaaggaggcagcaggggccagcaaggccctgaatgtgactgtggacgtgcaggtg

SEQ ID NO: 16472 - DNA, 37996 bp, Human
  misc_feature (1)...(37996): n = A,T,C or G
cttactaagaggttttttaaaagtgcttgccttcttctctttgcataacttacgatactgagggaacatcttttctatgccagtgaattgccatagtcctttataaatttgcatcagcttgcaacatcttatctctttgctttcagtgttgtgaaatacctctggaagttcctataatgtgaagttttttgctgggatcacttcctgtgggacatcttcatcctttttgttgcaaccactttcctcatttatgctttgaacaatggtttcaggtttcatcaatataaatcgaaacttcaagggtcccaactgtcagaaagtcacatagaacttactcagaatgatgtcaaattccactctagaaatttaaaacctcaccctgttaaaaatagcttgtcatcaacaaaggaaccagatgataacagacacaaggctgactttttagtttcgacttatatatattaaaaaaaaaacaaccacaaaactgctcaacataagcacaatgtgctttcaggagagaatctcaaaggacctttccagtgcattttcagtgccctgcacccaagcattaatgattatttaaatggtagaataacataaaatgatgaaacaactggataaattcaactatgttgtaaaaattttgtagttgacagaaatcagtctttggactttaagatctcatatagatcagaggagaaatataatgacatactccttaagaatctgatgaaagttatggcctttctccactagaatgtgccgattacaatattttatgcagtgtttcaaggaatacacagagcccccaatatccagttagaagccctggctgtgaatctagaattttattacaggtgaaacccagcacaagtctgattgagagccattgcaagtcacagaaactctaggccctgtctaagtaaaggcaaaccttggagtatgtcatctgccactgaaaatgcatttaatgatgactcactctttcctcactatacaagtttgttcaacctacacctcttcagctacagactacctaccatccctgaaactctgttctgaggagtaaagggattacaaaacctggctgaaaagacagattcaatggcatgttgaaaaacacagcagaaccagcacatcagactgtaaattgattgtcttgcacaggatgttagctgctcttcgaatgaggttcctgagtggcacctgagcctattgctggtggcatcctattctgcctgttctctctttcttcctccttccccattcctttcattctcttctcccttattcttcctctgcaattctttttttccacactaccgttggccggtccctagggatactgtttaatctggcccatggtacaagagattttagatcttcattgaagtcactagagatggcctgagtgagtcactttgaattcaatagacaaactgatggaaggctctgagaagacctcaacgatgcccaagaaatgtgttcttactgtagaaacttactattttgatcaaaaaagtcattttggtcaaaaaggggagttgggagattgcctttttgttttgaaattgatttggcttcaagggaagaagattgcctaaacaaaacctgctgatgaagtcacaaaatgactccacctctggaatgagctttattttcttataatttggcaagaaatttggctttcaattgggaatgcacgtcactctacccactcaagggcaagatgataaggttctatcagaccaagcgtctaaaggaacctgagactctaccaaggtcagaaatgctgcaattcaagccaaaagatctttcttgggcttccttgttttgacttgtaaccataaattagtcttgcctaaatgtctgatcacattataaaacagtaagtgaatctgtactgtacagcaccctctgaagcaacaggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtaagtcagtcatttatttctgtatctaaggagattatttacttgggattttggtccatgatggtaaagaaaattttgcaaaaggacaaaaagcaaacctggaaagatctctgaagactatgtctgtgttagcaaatgaggacttgggagaaaattttcagaccaattatctgcacattttaaatgaaagcacttaaaaaatatcttagataaacccttccactctgtgctgtgctttcgtaaagtagacttggcacaagtaccctttaaaacaagctcaagatggggtggagtaaagtaaaattccagggttttctggttaacttttaaaaaatagattgcaattttgctctgaaggtgaaaatgtctctggaacatcttcttcactgcttttcttctccctttcactttgtttccgccatgccccctctttgtcttgtatttatcccttctctttattccactcatcattttctcttattcttgggaatgtgggaataagtgggttgcacttaactatttctctacagactcacccagtaagtcaatactttcattaatgttactgatttagatactaaaacttgtgccaaactttccactatatcaggaaaaccaacagggagtctaactccaaaaggagattcactgaaaaatgcttaggaccctcattgattatagaaatgtcagacaccacagtgaactttccaataagnnnnnnnnnnnnnnnnnnnnctgactcgaagtcacgctcggtaccccctggaaagactctgaagactatgtctgtgttagcaaatgaggactctggagaaaattttcagaccaattatctgcacattttaaatgaaagcacttaaaaaatatcttagataaacccttccactctgtgctgtgctttcgtaaagtagacttggcacaagtaccctttaaaacaagctcaagatggggtggagtaaagtaaaatttcagggttttctggttaacttttaaaaaatagattgcaattttgctctgaaggtgaaaatgtctctggaacatcttcttcactgcttttcttctccctttcactttgtttccgccatgccccctctttgtcttgtatttatcccttctctttattccactcatcattttctcttattcttgggaatgtggtgatagtggtccccatttttctcccactgtctggatcccattcgacccttatgggagcctggtagtgggagaaaaatggggaccactccagtgctcttggaacatcataccccgggagaatcttcaacaagatctgtggttcaatcaaaagcagagaataatataattattcagataatcccaatagaaaaccccacccttccacccttaaagccgcaatgatcagatatcagattaattcagaatgacttgaaatttcagactgcttctttaggtttcagtgaaaatgcttcattgcagacacatctgttcccaattccataagatatccaatgagactttaagagcatagttacacactggtaagtgtggtgggcctagtctcagtgggatcagaagtgggagcatggggctagcacaaaatgctctgtgtctggattctttttaacattccagataattgcctgtctctctgcctgattcagcctgatattttagattactttaatgcccagtttaaaggaacatttagttaattttgttctctgctccctgacagggtcaactctagagaagggaggctcagagctaagggacaactgtttcatggtctttaacttgaactctgttccccagtgtggcccttcctcactggatttctcctctcccaagggggcttctaggtcagggtcagtgaatggtcggggtggggtgagtaagtggtgggggtggagagcctttttttcctcttcttcccttcataggctcaggtgctaaattccaatttgtctgtgttagcagacaatcaggccaggagagtccagcattgcccacgcagcattgcccatccagtgagccacaggttctcaagcttttaagtctatgtaagaacacccagcaggtaggagcttgttaacatttctgttcctggaccctgctcctgactttttgactcagactcttcaggcctagaaacatgcatttttaaaaagtccccccagatgcttatgttaatcagcactggtggaatttccttggacccttgaccaaggaggtcagcctgttaggacaagcctgagaaccagcagccctgaagctctggatcagtgggagagtaggcagcacctcactctgtccaccatttctgggccagggccatcatgctgatccactgacagtcagatcaagtagcacagtgattctcagcactgtctgaggtaggagctcagctagtttggggttgctatttttaaaaaaatctcccttcctgattttttatgagcagccaaggttgagagccacaaatatgagcctaactccttcatttgacagaaggggaaactgagacccagggagttgatctgccttgcccagacaaaacactatgacaagcatgagaagccatggagttcaaacttgtcgttttacaagtgaatggttaaagcccagtgaagggaaatggcttgtcatctccccagctggacagaaagtgggaatgtagggggaccaccaggaagtcctaaagcccaggttgatgatcattttgctagacaggtagtttctagtttcacactttccttttgaaaacagaaggtctagttagaatccactagtagcacagactgtgagatcctatggtttctggttgggggagggaagataagaaaattggccttgtttggggtggcttttgctgatcaatactcctgagctcctgccagctccctttaatcagtggctctctaggttcttggttttagaggtttaggggaagcacagagtcaggaaagctcaggaacagtgaaagctggagggacttataatgatttaaagcccttaagtgagttataatttacaaagcagtttcgtgcccattttctctggtgaggttggtgtgtttgtgtctgttttgtagttggcaaaactgagactcaaagagtcacacaactagtaatgatgaaactggggctcatatctaagcttcttctagccgtatttactgctaagtaaacaggctgccctgttttcctgcttaggggcaggaggatgtgtgaaaagattaaagagatgtggtttctgccccgaggggattatataaaagtagtaaagacagtcaaggaaacacacataggtggttgacttagtgccaggtaggggctatgaaagtcctgaggaaagggtcattcctgcggagaagggggagtggccgggggaggggggcggggttggaagcttcagttctgaaaaattgctcccagaccactgatctgggtcaggactcacagtcacctggcactggctgctctcccttcccccaggacgtatagccatccccagctctaaacaagggtcctctccctccagatgccatgctctgcccggggtaccacatcccagagcagggaactaggggggagaaaagcatggcaactgacattcctctttttcttaagataatatttcacagaaaactggacagtgcggtgacaaatttgccatcacaatgcagcctgacaaagcggatgttacccttgttccagaagctcctcgtgtgcctttgtaatcactctctctctctcactccagagcaaaacactgtctttgattttgtgacagtcactcccttgctttttttttttatcattttaccacataatttcacatcccagagaatacaggttaattttgccttgttttaaaggttttagcagtcaattcatacattatgtattcttctatcttgcttcttttgctcaatagtatgtttctaagatccatccacatcgtggcatgcaggtgtagttcattttcattgccatagggtattgagttatataaatatctcatggtttaattgccagttccactgttgagggacacttgaggtgtctttagtttggggctattgtgaacagggctgttctgaatgtatatgtgcacacaggtttctctatggtgtacatctgtaaggcgtggaaagcaacagcttgttgattaggacagctggggagaggtcccagctgttggctccaaggaggctgtctctgtacaaaaatgcagcaaagtattcactgcttcttttagggtgtgaaagaggctcccaccatcattgcatgcctagataagcattcccaaatctgagaagcaacgatcagcttaatgtggctacaaccagaatatttccctaatattttgccaaagtttctaccttcctccagcattcttctctccagctggagggtgggtagaaggcctaagatatacacgtaaatgaaaaggtcacactgtgttaacattcttttatttagtaattatttttcacatactctcctctcttgcccctagactctgatggggaccattatacttataacatctccagtccctaattttagtgtctataccagtagtatctataccagtaattgtttgttggatgaattaagctgatatacaattgatcgctagggactcaaaactctggttctcttctggttagaacactcaggttcttaatctaagcacaaggttcaatctccctttttcagtagatatatctctcctgcgtcacagcttacatttgaatggcaggtcccaaatattaagatttttacatggcgggctgggtgtggtggcacaagcctgtaatcccagctactcgggaggctgaggcaaaagaatcgcttgaacccgggaggtggaggctgcagtgagccgagatcatgtccctgcactacagcctgggcaacagagcgagactctgtctcaaaaaaaaggatggcatttaaaacttcatcctttatattagatacacatgcctaattaatttttaaaatttattcaggaaacattcgttgagcatctacaatgtgccaagctataaatatccagtgagatattatattatgcatatattaattgattaaaagttaatatatctaatgacagtttaaggaaatacatattcaatcaaatctgctgtggaaatcttttaaagagcttaatgaaattattttaatacaaagtcagtcatctactgtataatgtagtgttactaaaataatcacaagattaataaccttagaccatattttggttctgtaggtattagcaaagatcttttatttaaagggaaaaaagagctgacagtcttgctcatattaactcagctattacaaagtaaaagactaaacactgtttgctgtgtttgggattaaacatccaattcagatgattcaagcaaaagcttacactatgtatattattacacaacttttgcccgtaaggtgagaatgctgtttcacgtagttaggcatgttttggcttcagaatgatttcactgacagaatggaattaaaggagaaagatttagaaaaactgctacttgtcaactcctgaaaacattctaaaactttttaatctaacgttttaccaacaccagtaaaatcaagctaccaaggttgttctctgatataagcagcaccaaattccccagttgttccctggacgcatgttctttacaattctgccatcctctgcataagcaagattgtaagcagccactactctcggctaaaaccagatcatgggactcaaactccaatctagaggttcaaagacccattgcctgactccccatctcttagctttattttgcctaatgagatttagcttaagagccttttcttaaacggagtcttttttgagggtaacaaaagaaatagatgttcttggattggacattctccttgtagatcttgtttctttcagttgaaagatttcctacaaaactacagaccagttttaacccacccattgtgtcaaccggggcactcaaaccaaaagtttccagaaaaaactaggcgccaaacagatctgccagattgtcactcatcagtgtttccatgtttgctaccaaatgcaccaattgacttgtattagaaactcactgataccagttaacctgggaagaaattagcacacacaccccagttcattcagactgaaatgattgagaccaaataaaactagtgtggtatggatactgaactcctttttactcatggagaagtgaagagcctcatgttaagcgtgaggcttttgttttgttttgttttgtttcaaatcactttattcgtgattcacagatatacatcacatgtaaagaacacttagctataaaagaacaaaaacaggagtaacacaaaacagttgcaatttttggtgtaactaagatgttgcttatgctctgacacctgtcctaggtcctggctactgcatgggaattggacccctcatctcccacggcagattcctgtggatggggatcggcagtgcctgcaactactacaaccgggtgtatggagaattcatgcgagtctggatctctggagaggaaacactcattatcagcaagtgagtctgttcataatcgaagacatactttttaaatcgaggctggagttttttccacttaagacaactttattttgaatcttgatgtctttgtttctaacgctatatttttaccactgaaatgaagtgagcaatccccagaaatctaacattgcaaacagaataattgggttttgcttgaattgaagccagcagtacataaataactaactctggaaagttgggaaattatttacaatctctgtgagcagtgaatgtggaaacttagaagccagataatttgattttgacaaaacatactttagggagaggtgttatcttttctgctttcccaagttttttggtcttaaccacaaataaacattaaaaagaaccaagccaaacaaacaaagaaaaaacccacagaaaacaaaaataaaacccgagacatcactgcactatagtctgggtgacagagtaagaccctgtcttttaaaaaataaaacaaacctgaggcagaggtatctgattagcaatttgctaatttattctcctgccaagcaactgagcacctctaaaagagcagatggtaagccgaccttggctgaatccgattaaagtaaagaaaaaggaaaataaaagaacaagacagtagaaaaagaagtaattcacatgctgctttcccatttatgactttatgcgagtatcccggtggagtgatcttacataaatcaggaacaatattacccatttaaaaaaatagtgtcctccctctctgcattattatattttgtggataactagcagattgaattagctctatggttaactaaataggaattgactataaggaactagtttggtgaaatacttgttttcttgtttattgatcttagaaaatggagaatttcaaagatggcgtatttccctagactttcagccagctttagtagacttttagcaaagctatctgcaaacattgtctcattaacgcatgtttatattcgtaatccctgatagcgctttacccacaaactaaagctgaccagggtgttttaccaatttgttagaattattcattcagatacaaagactatagctcaaaagtaagtgaagcttttctaaactacataattttttcaggtcaagattacatacatcatctcataaaataccacggtatcctcaaagcccaaatatttgaagcagatattgaaagaagggagcaggggagaaattggtattattttaatacttctaaatatttcaaactatccaaaaagaatttttttgacctgggatttttgtttgtttgtttcattcagttttgtgttgtagcacttttaagagtagctgaggcagacctcacacaactaaacagaaatggcttcaggtggaaacatcatttcattgggttcattgtgaagtactctaatgcagtagttttcaaagtgtggtccttcaacaagcagcatcaacaagcctgggaacttgttagcaatgcacgttcttgggccccaccctgacctactaaatgagacagtctggggtaggacccgcgatccgtgttttaacaaagcctgcaggtgattctgctgcacacttgagtttgagaaccactgctctaagaactagatcataattacttttttattttaattctcctggtctattaggctctagtcagccaaatttaagtgactatgatacgttcttgatacgttctcattttaaaaatcagtacttgagtcacttttacaactggctatggtctcacaaatatcctggaagcactggtgtttgggtttgggggtagggacatttgccgctgctctttcatttccccgcacagccacctgcctttcagctctccccagcccagggtctgccttccccatcacctctttccctcagcagacaggtgaagtgacccccaggatatttatctagaaggatatctacctgctgcccaggatctagcacagtgccgtgcctctcaccctagctgtaccttagagtcacccagggagcttttcaaagccccactgcccaggccacacccccacttttagatcagaacctctgggggtaggactcaggcatcagtggtgtttaatactcccctgggagtttgagaacattccatctagagagagggtggaggaggaagctcatggggcaggagggcctctccccggggttacaggaagcagcgatgcaggactggttttgtcttatgctaaggtggtggaggtttaagactagaactggagtaaagaatgatagacttgagaaaggaccacagtaccaggacagaaatcattctgagatactagatatttcgatgctagattcttaaatctccagaaaaagtccgtgaatttccaaagacaattcctgaagtgcttgctcgttacagtgggggtggcatctgaccactccgctagtcttaattaggaaactgactccaacaaccccgaccgactcaggcgctggtgcacgctgagacgcagccacaacccacccacactaccatcagctctcccagttctttccttttcctgtcctctcaggcttttcacttgttggagtctttgtgttctctttaattgcctcagagcagttcaattttgttgttaaaggctgagctccccgcgggaataggacatgtttgtccccatctcctttccttgcctgctcttcaagtcccttccagcactccccgtacctcttgaaaagaccccattggacctcagaaagatttttatttttatttgaatagtttgccagattttttttttcttttgaaaagtttgaggtctgtagtcattacaactgtgtagaaattatggtccaacttttccaaccagcttcgtcccaaagtagtaggggctgcagaacttcaggggagaagtcaggcatgtgcgctgctgagatgccgcgtgtgccactgggggcgtggaggcacggtccatctggtgagctgtagatgatgtgtgcaccgttccccaggcagctacccaggcagctgtactctaaattaatgaaggtctgtaggtgctgcgtatgacactatatgtccattatatgtccctagattagtttttgtcatgaatacaaaaaaaatttatgtatcactcataaagggaaattagcaattagcatgctaatttgggttatatttgcatatctgttagcaattaacatactaattagggttatatttttacatctgtcttaataatgtgcaaatttacacatcatttacaggggcttccttcatttattctgtgaatatacatttactgagaatttattatatactaagcactgaatgattctaagttgtaatagtcattattggctcttcatccattaaatatttcttgaaaacttactatgtatagcagcaggtattgttctaaactctgggaatacagcagtggacaaaccagccaaaattcctttacctcatggagcaatatgtcgtcactaggtcaacaataaacaagtaaaatatatagtgtatcagtagagtgaccaattgtttcagtttgcctgggaccagggcctttcccaggatgtgggactttcagtgctgaaactggcatagtcccgggcaaaccaggatagttggtcacacttatcaggcagataggtgttacatagaaaaagaatagggaaggaggatgggggaggaccagttgtagagacgcaggtgtgattgtaaacaggtggttcaggcagccctcactgagaagacagcatttaaataaagacctaaaggaaatgagcaagtagcccatgcagagacctggcgggaaagcattctagacagaaggaacagcaagtgccaatattctaaggcaagaacctgagtggaagaatacaggagatgagagaagcaatagggtaccaaatcacgtcaggccttgcaggccattgtaacaattccggcttttaccccctgcaagaaaggaagccactgaagaatttgagagaggactgacacatatgactcatttatgtttcagcagaatcattctggctgctctgttgagaataggtgcaagaggacaagggatggggacagacagaccagttaggcaagaggtgatggtggctggtccaggtggtagcagtagagatgataagagatgagggaaaattctggacatattttgaaggcaaagccaacagacttgctgacagattggatgtagggtgtgagagaaaaaaaaagagtcaaagtgctgtccagttttgcattgaatggggacatcgtgtcctgagataggtggagcaagtttgggaaggggagagattagggttccattccagacatgttagatttgacatgcccagttgacatctgagtgggatgattgagtagagagaactgaaccttgagaccctctagtgtaaataggtcagaaactagcaacagagactgagaagagcagctagaccgagaagagaaaaccaggaaagtgtaatgtctgaaaaccaggtgaaaaatccatatcagggagtagaaaattgtgaaccatgtcaaataccactgatggggcaagggaatgcatggagatttcagtactgcatttagcaacagggaggtcacaggtgaccttgacaagagcagtttcaatggactagtgggggcaaaagtctgaccagagaagagaatcgggggagaagaatcagaggcagcaagtgtagacaagtcttccaaggagtttgccataaagaaggcaggaaatgggccagtagatgagtgagatgtgcgggcaaaggaattttgatttttaaaataggagaaattacagcatgtgagttgtagggggactggtcagttatggaggaaaatcaaatgattgttgatggaagagaaagagtgtgctaggtgagatgtgaagaggtccctggggacaagtggatgggttggccttgaatagggacatggaatttccatagtaataggagggaaggtggaatatatgggcacaggtccgggtcgttggggattgtggagattctcttgtagttgcttccactttcttgggaaaattggaaataaagtcttcagctggggctgagtagggagaatataatagtcatctagaagagtgagagagtgaatgggctggggacatgcagtagcattgccagcgacactaagggcccacttgaatttaaccgagacctgacagcaggcacgtgtgcgctaacgtacacacatgcgcacacatgtgtgcgcatgtgtggtttttctttttttcccagcccacttcaactgccaggtgcaagcacagaataagctaagagttggatttagctagagtgtggtcttatcagacaaccatgacaaagtaagaagagggtcaagggagttgaggattcagggaagggtattttaattttaatgattgacagtaattttttcccaactttctgttaagaaaattgtcaaatgagtaggaaaattgaaagagccgtccccctgccacacttttccccctgtgacattgacattttgaagagaccaggtcagctataacatatcccacattctgaatttctctcactgtttcatcagggtgtcatttactatattcatctattctctgtatttcttataaactgaaaattgggtctaaaggctcaattagattaaggttgcacatttttgcaataacacttcagtagtactaggaacttcatatcacatcacatcagaagatgagtaacaggttgtcccactagcactgatgttaaatttgatcactggttaggtggttacagtgagattcctctgttataaagattgtttatctcttgtagtcacctagaatttaagctgggtaagtgaggatattagagaagtgaaggacagtgaaaaggtgataggattgatggaacagatctacatgaggcaagtgtttttaaatgtttgttaccagccgggtgcagtggctcacacctgtaatgccagcactttgggaggtgaaagtgggtgtattacttgaagtcaagagtttgagaccagcctggccaacatggtgaaaccctgtctctactaaaaatgcacaaaaaattagccgggtgtggtggcgggtgcctgtaatcccagctactcagggggctgtggcacgagaattgcttgaacctgggaggtggagtttgcaattagctgagattgcgccactgcactccagcctgggcgatagagtgagactctgtctcaaaaaaaaaaaaaaaaaaaagaaggcaccaattagtccattaattgcctcctcatcactgttgaatctgcccacaagtgtgtgaattgtttaatcccagaactcaggtggctttcttctcatcacctaagagcttactccctgactacttttcattttgaacagacaataggtttgccatctttggagatgtcttttatcttcaatcatgcttaatgagggataataaccctagtgatcagacacccaacgctgtgcactgtccctgctgaggctggggactcagctggactctcctcagtgctaagaaatcctcactctcccaaataatcagtataacacttgcctctggcagtattgcaggctggcccacaagccagagccaggcctgtcttgactgccaggaggagctctgggctggggtccttagttcatcactgaccttctcttcacttttctgatttactctggttagataaatccagcctacttttagtaagtgaccttgttttaaattgctcatctgtggccagtcacacatcccttgctttatcacatcggcctgattagctttgtccctaacaagcctgagctttggattcaaaatagctgagaagttggtgccccctaaaggacacaagaattttaaaggttggctctttattactaataactagcaaatatttcgttgggtttgttttatgtttggagtttcttactctctttttaaaactgattagcaagttcttaaatgaaatggacaggccaatatgattaatgcagtatgcaaaagccccagggtcagagcagaaaaatagtgtttgtcctttaagtgcttaaaatttttaaatattagtttgtgaataaagaatatataaattacttaatttctgctttaattatagaatgatggaggggaaggtaagtaaagctagagttttcaaatattttaattagtaagaatttcattccttcctatagcataatttttctatatatgacaaaatttgaaacgtcagacaaattccccagaatacaaatggaagcatctggatttttatttatttatttatttatttttgctagggagaggcaaacatgtccaaaacttaggattatttgatgaatattatctggaatcagatcaagagaatatttaatagtgtttttatttgaaaataggtggtttttcctgaaataaatattaataagttatttatacaataactctgcttttttttttttttttgagataggatcttgctctgtcacctaggttggagtgcaatggcttgatcatggctcactgcagcctcaacctccagggctcgagctatcctactgcctcagcccaccaagtagttgggactacaggcacacactaccacaccttatatattatatattattatacaataataatcctgttctaatttcttgacactaccattatttcaggggcttacttttaaagcttaaataggactatggaacacatcgcagatgtgagagctggattaatacttagcccacaacctaatacattgaaccagagcagcgcttttttggtctagagtcctctgggaatgtatttcaacaggcattaactgaacaacctcattaaggcaaaagtatccttttaggagccaagtgtcaactaggagatggaggagcaagtctctccaacctgagaaccaattgcagatattatagtaaccacttgcaatctttgagggttatttgttctgaaaacctccatagtgggagaatttgcagctgtgaaacaaaatttcaggagaccagaggagagggaggaccaaagttgcaattaatacatgaaattttgtataaatattaagttcaccaagaaagtaacaacaacatctaaaatcaagataataccaatgacatctaatgcatcttgaatttgcataattgagcatcatgcaaattgccctgtctcatgactcatcacatcctgtgtcgtgggagaactctgtgaccctggagactttgatgagtcatgatggaaggcagagccccaaaatagcttcctttactaccacagtgaactttgcatgccagtccagccaggcgctggccaagctcagggctagaagaagtgcccaaggagatatttttcaagccctgactgatactccactggagggggcaggcctgattagagactggagttgggtggtactaggcaaaactgctggttccaaaataggaaaacaagactttagtaattccacaaacttctgattctgtggctcactcttgtagtgggtggcactttgtggagtgaggctggatgatacctgggaggctggaggttcttctggctctggtggtatggagggttcagcttcttagcagccttgcagctctgactccagtagtgggtagtattttggtgaggttagagaagaaagagaagtaaggaatggtatatgggtgtgtgtgtgtgttttctatctttggtgatgttgaaacagggagtcagtaggtagaaatgattcaactggagaaggatgtcctcatgctaacagaagtgcttattcaacccgaatactagaaatcatgcacattgcatttggagcaacatgcatttgctaagagagctacctcctagtcaaaatgtaccaccaggagttctcctgacccttaaaaattgacaccaaagtttcctgtcttttcaggtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaaggtaagcaggtacttagttagctacaatcttttttgtctatgaatgtgccttttttgaaatcatatttttaaaatattttatttatttatttatttatttatttattgagacaggctctgactctatcacccaggcaggagtgaccttggctcacgaccttggctcactgtaacctccgcctcccaggctcaggcgattctcccacctcagcctcgcgagtagctgggactacagatgtgcaccaccatgcctggctaatttttgtattttttgtagcgatggggtttcgccatatttgagaccaggctgggctcaaactcacggagtcaaacgattgacctgcctcggcctcccaaagtgctgggattacaggcatgagctatcattcctagtctgaaatcatattttgaattctactgcaataaaggaggaagagctaacattcattatgcctttactctgttgtagccattgttctaaacacttgaatggcagccccatgtggtaaatgttgttatctcctacaattcacagaaaatgaggttaagtaacttgcccaaggtccaaacattagtaaatgatagcccggaatatagccctgaagcctatatttcttaatcaccacaaattcttttcttcttattgatgtgcaaagcaattttataggcaaaagaagagatgtagctatatatttagagtaatttcagttaagaatttagcatgtcacccatatgtttgatttaaacacggccaaacaatgtgtttgctgagtgcttgactgacagcccagatgatttagcaggaagcaatttgtgaatgaaattagataattttagaactgagagggaccatatctgtcatctagcctctgattttaacagttgaggaaataaagttccaacgaagttatgattttcacccaggcaaaatagggagtaatgaatgagctgagacccagttgcaagcttccttatccagtggttttcccccttaacctcatcatgctggaaatgaaactgttggggaatacacacgactaacccttgacattactatcaagcataaagaaagataatcataccctggaaaccttgtcagtggtggaatctggggctagatgattttaggtctggccctgtctattcacagccttccctccagcagcccgtgctgtgaacctaggtagccgccttccatgtgcctgctaagatggggggagctatgccagtacctctgcccactgggtgttgagcccagccttcagagctgccctccctcaccaggactcagcacaactcttgctgtagaccccagtgtatcactttcctattgctgctgtaacaaattgccacaaactaagtggcttaaaagaacacatttatctcacagttctgtaggtcagaagtctgacatggatctcaatgagctgaaaaccaaggcataggcaaggctatgtgcctttctgggggctctaggagagactctctttctttgtcttttccagctctagaggccagccacattccttggcttgtggccctttcttccaacttcaaagccatcaacagtgggttgagtcctttgcacattacatctctctgacccaccttctgtcatcccatctctctctggctttgacctcggcttggaaaggttctttgctttttttttttttttttttttttttctgagacagagtcttgctctgtcacccaggctggagtgcagtggccccatcttggctcactgcaagctccacctcccaggttcacaccattctcctgtctcagcctcctgagtagctgggactacaggtgcccaccaccacgcccagctaattttttgtattttcagtagagacggggtttcaccgtgttagccaggatggtctcgatctcctgacctcatgatttgcccacctcagcctcccaaagtgctgggatcacagacgtcagcctataatctttgcctttaagaactcatgattaggtttggcccaccccatctcaaggtccttaaccttagtcatatctgctaagtcccccttttcatgtaaagtaacatgttagtaggttctggggattatgacccagacaaatttaggatgctattattctgcctatcactcatgttgggggagataaatctccttataccttataaaactatggaatgaattaatggaaaacgtataggacttagtattacaggttgtgggtttgcgtcccagcactgccacttgctacctatctgaccttaggcaagtcacttcgcctttctgagcttcagttcccctatccacaaaaggtgataaatgttatgaaacttgcactctagggctgttgtgaagaacaaatgaaataatgctataagatcccgtagaaatgtacatttgactttttcatttggctcaggtgtattaggaatatgtgaactagtatttagtagtagttaactttcacataccaatatcctctaccctgacatgcaagagctaattaaaagaatctctaagttcatccatttgtttaacaccccaccgttctcatctttgaactaggtaccaagatacaatgacaaacaagatgtggttcctgccctccaggaacttataatgggggagagaggtttgaattaggaaggggcagcccagcacatcaccaaatactaccctaggtgatggtaatgctggcggtgtgcccagagtgatgccaagtacagatgaacaggccatctaaagcacattgaggggcaggggagacttttcagaggaatggatgcttataatgagttttaaatgaaggtagaagctaattaagaaaacaaaagacaaatattctaggagtaaagaataggataaccaaaggcacagacaaatagatagacatgatgcatccagggccctgtcggtaagtccttgtgcctggtgcagatacattcagggacgtggccaaggggagggcagggccagatcaccaaagacctctcagttaaggcaaggaattgagcttatctcaaaaactatggagaatcactaaagattttaagcagaataacataaacatatttgtattttataaaaatccctctggtagcagagagaatgactaattggaaggaagcaggattgtgagcagtgagaacatttaggagctactgcagtgatgcaggaagggtggaggggaggctgtggtttcaagaaatgtcaaaagggtagaccctacagtagtagagcctatagtacttggaaattaagcaaaacatctttgtgatttttttttagacagccttctataggcaagatcagggtttctacaaaaagtgctacataactggacccaaattcataatctcaggaaatagggggataattgcttattggaaagttcactgtggtgtctgacatttctataatcaatgagggtcctaagcatttttcagtgaatctccttttggagttagactccctgttggttttcctgatatagtggaaagtttggcacaagttttagtatctaaatcagtaacattaatgaaagtattgacttactgggtgagtctgtagagaaatagttaagtgcaacttaggcaatgacccatcttgggaggtagggaagggtggtggcgaggggtgaagaaatagcatgtgtttcccaaaactgccgagaaatgtgtccatattgatggtatttgctgattgttgcccaattttcttttcactagatagagtcaatactttttagcatattttaaaaattaaatcatatctacatcataccactgcctataagccatgttattacatttttgcccataaatttggcatgtggcttcaagctctttaaacacagaggcaaatcatgcatcggcctgggagaaaaccacaagtgacattctaagccaacccttccacacaaagggttgagtcatttgtcctgcttgctgaagtggcagtcacccagagaacaacatcctggcctttcatatctgccaagtccttcctatggtcagaaagcctgctccttcctcaaccttccttccaagatgtatggaaatctcaaaagtctaggaccagtcctcaggcctcctttcttatttgcaaagtatacctttaggcatggggattccgcagcttaacccagtgtgtgtgtgtgtgtgtgtgtgtgtgtgtgtgtgtgtgtgtgtgagagagagagagagagagagagcaagagagagagagagaggatagtcttcttctggagttacgtctacaaagtttcccaatatttttcatctcatttcaaagactctgatgttaacagcaaacctgaataataaaagacttaaaaagagattactcctaaaagatgcttaaagaaacgtaacacaaagagagaaaggggcactttaagggttaaaccctcctgtgtaggccacctaccatcaggacccaccagccactgctcagatatgaacagggcaagagtaagatcaaagccagtttactctattttcattcattcattcattcattcattcctctattgaaaaaatatgtatgaaggcccccatggaccatcagcttgaagtgcaatgctaatgagtggctgtcactgtccttaaagagctctcagttcagtgagggaagactggtaagcaagcaaggaattgcttagctgtcatgccattggctgagtaaaataaacctggaagtagtttgaagagaaatcaaaattaagagaagggcactttgggggatttttacaactagccttttacacttaaacaggaagcaccttagatcaaataggatccaatttgaccagttttccaataatatcctgccacctgttgaaacgcaaaataaatatgaccctaggcaaatccaaatcatctttggagggaaatgtatgcaataaatatgaaaaaatcactgatttgtgatttatgaccacaagtactaaatgtttcatttgcaatctcataaatggctggctagagcatgaaaaaaagtttaatttttaatagtttgtttaaaataatatttgtccctatctccttccgttcattcattcttaaccataggatagtacatgcttatgtaaaattaggagaccacagaaaagcatacgaaaatattatgaaaacttccacccaattattaaattaaaaattgtggacaattaagctccaacataaaaagccaaaatggcatgattgtgtgtgtgccctggagttcgtgatggctgattctctgatgtgtactctgcagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccaattgttcttttgggcatgatatatacatacatatatacatacatacccacacatatatacacacactcctccctcaaagctactaaacatgaaaacattgtgcctatatgataaaaatgtcaatattgctggtgatactgatgctgatggaaatgacgatattagctgccattaacgtagtatctaatgtgtgccaaacaatattaaaaattgctgtatatacatgtttgccatttattatttataaccttaacaagatgtctcactcataagactactttgcgcactatgatacagaaatgaatattaaaacatgtgcatgctcatgtcaaactcatagaacttgattttattttggcaggattaaaccaatttgcaacttgagtacaaatgccaatatttcagctagttcttgaaaagttgtgccattgtgcaaaagtcattgaattatttgataactttttaacctaatgatcaaacacctgacaggaatggaattcactggacttgtatctaattgttttacactgttttctatgggttacattttttattgccattgtgacctttatccacacactaacctggaaagtataggaataaaagaattggcattctttctgatacaccctttttgttttcttcttaaagtcatttatattatgtattactcttaaagaatgttttagtctccattttagtagtctgtgcataaggtagtaatacatgtacacaaagaaaaattcacaagcccattcaggtgtcttttagaacattatttaccactaaatatttatacagttgacataatgcttattatgcccttgaataatagaatttgttttgtttttacttcttatccataagcattggccttacattgcctcaagaggaacagaatttattattaaacaggattcttaaatccataactcatattgtgacttcatacattttgtaaccctagtagtgaatataccctaaaaacctataaatccccccaaatcactctactgatgaaaaaaaaaaaaacatgtgcatgcaactctaccaccaccaaaaaacaaacattaatcatttgagtagtttggtggttaccagaggatgggaagggtagtggggagagaagagatgaagagaagttgattaatgggtacaaaaatacaggcagatagaagaaacaagacctagtgttcaaaaaatcagtgtagtgaagaaaataaataataatctatgtacaaccaagtagctagtagagaaaatttgaatgttctcagcataaagaaaagataaatgtttaaggtgatgaatatcctcattaccctgatttggttattacacattatacaaatttatcaaaatattacagttacccctaaatatgtatatccattatgtatcaatagaaaattaatcatttggattaattccattctactgttggcattaagtatgtacaactcaatgtgacttttcctgaattaacttacaccagtgttcattgattcatacattcattcatcaaacatttattgattgcttattttatgccaggcactgttctaggttctggggacataacagtgagcaagacagataaaattcttgccttcaaggggcttacattccagtgagtgatgtggacaggaaaagacatagatatctaataaaatattaggcaataataagtgccttgaaggcaaaatgaagcagggcaagaggacaggaagtgaaggagggcaacagtgtgtgtgggcacagatgtcatggagagggtggttagaaaaggcctctgcagagaagacatttgaccatagctcgaatttagtgaggccacaagccacaggcagatatgagggaagaacactccaggcggaggaacaatgcgtacttttaacacttgccccaaccagctgaactggaacacatgctacctggtatactacacttgggcacatagacaagctataagccctccctattgccgcatctcccctactccagctactccatacaagagctggagacacttcatctgatggccatttggatgggagcccacaatcacttgaagaagttttagtcacactttctcacctgatctcttttcaggcagggatgccactcccagggtgcctgttctacagacatcacttctaaagtgaaacaggcgtgtattttaaaagtctagatttccaggtccccctctagccttgcctcattaggaaggatcatataaaaggatttgtaaatctctccattcatttttggatgcagactatgatgctggcaaacctgtgcaacccacagagttacataatcccttttcacagggatccttgttaaactctcaatttgcctaagggacccagtgcaagaaaagagaaaaggacatggtcctgaggtcagacagaagcagctccagcctcagggcctgcctgtcagccacactggctgtatggttttgggcaagcttccgaatttctatgaattgcaatttcttccactgcaaaaggatgacaccacaacgcccatggcaagaatatgaagatgaaattaaaaatctctttcacaaagtgcctagcatggtgactggtatttagcagttggaaatatatgtctgttctctcttttgtatattatctggtataatttgaaaaaataagggtttatttcctctagtattcaatttaattaaagagcatttattaagagctgattgtatgtgaggcttaggacaaggcattaaagaacacaagatgaattctacactctggactgaatataaataactatgaaagctatgtgatgagtgttatgggggaaaaatgaataaagcaccatgagaacatgattagaagctattaagtgtataatccagataaactgtccacttcatggctctgcttacccagcaccaaatgaagttaaaatgtggttgttagccacctaacaggctctgctttttacactcccaggtaccagagtgaaggccataacagccataattactagttccatttgtacagagaaacaggagctagttgaaagctcagcccaaggagaatatgtgaaattctaggctgaaaacttgaaaacacaaacttgaaaactggcaactcactggttaagtaggccaatttggatggcaaggagaacaaatcagtgcttgatttgtctagtggtattcacgtggctaaaactcctactgaagatggaatcttgctgagcttagaacccccagactgttaggagaatctgcagggaatgttttctgctcagagcaaccttcttaggctcacattttgctcaactgctctttcttgtgtatgtgtggttttttttcctacagaaagtgctatcgtggttaaaatccaaggttattttgatgcatggcaagctctcctcatcaaaccagacatcttctttaagatttcttggctatacaaaaagtatgagaagtctgtgtaagtaatacaactttggaagatttatgagtacaattggattggtttttttcccttgtgtctttgctgtttttcttggcctctcaggtaacttttctgctctctagagcccacaagggagctgttgattaagttgctgatgaaacactttttacagcaatttggctgcatttggccagaccagagagtaaatgaagcctttggctgggcagcttctcggcaagggggctgagtgtgtggtctgggagcttcagcttggtaactaggacactagtgtattttgagttgaagagaagggtcgactgatcctgtcattaatatctgtcaaaattatctttgcacaactaaaaaactggaactacagaatcaatttatagttgtgttgtttttgaatgaatttaacataattcaacttgtaagaactgacaatagtctcaatagaattttttcttaatgagtacaattaacttcaataaaatgtgtgtgggtttttgaaattatgtatcttgtgttttgggggtcctgaaattgtcattaaatgactttgttttggtcttagaatcatccagcagaaaactggacaaatgcccagtggcctacaggctaatcaatgggcttgtagagtacaggtagccagtcactaaacactgctacctctaaccaccagtggaaagcctgtggaatctagaaacaggaactcctgttttgtgtcctgtttctaatggccttgggaagttatttaaaataagatataacctatcttctagagtaggggcataggttaatgagatcatataagtaaggcaattagcatagagcatggcacatagagggtactaaatatgttagtttctccctttcctgtgttcatatcttcctcagatgttcctaaccatctcaagttctccatctctaaatgtccccaagcttgtctgaagacctgactttattctacctgtggattttgaaattcgataatattagtttctagagaagaagccgacttgatgttgttttgtttattctctcatggttgataagtactaggtgaatgttttagacacttggttctttatacatttcatttccaccagagcttattgtgacttgaaaactaatagataaaagattcatctcttccctgtgatcagagttgttggcagtagtggtggtctggagagttcattacatagttctcagtcattagtttagccttggtcttggccattggacccacagaaatttattgtatgagtctgtataacggattctcttaggtttctgcagttccctcaaggagctctctatgaatttagaggctggggcattccaacacctcccagaccatttggggctagtgcccagatgggaatgctatgagcattctcagcctactaggaagagggcaccacagcccagctgagtgaatatctgttctttgtatataagagatgcttagcaaacatttgatgaatgtgtggatcagtagggtatttaagtgtataggtgaacatgtcaattagaatttggaagatggatttattgtacatttaacgtaatacagaacattgttccctgagataagggaacaatacacttacaaagaacacatacacttaaggacagagataagaaaaattgaatttagattaaggtgactttatttttcatccagtctgatcccttcactttaaaaggatgtagggcccagagacttaaagtatcttacatagaaagagaacaacctgaactaggacctgaccccaccccgtccaagtgttctttcaaccacactgccaaaatgcctatacatatttatgcagctggtaattcattcaacacatattagtgtttacaatgtggcagaaactaacaaggcatgagaataaatatcaagaatgatacctagtcactggagtttactgtttagaacaggaatctcaaactcaactgtcttcaggactaggcaaataaaagcagactatgggggccaggtgcaatggctcatgcctgcaatcccagcactttgggaggccgaggtgggtggatcacctgaggtcaggagtttgagaccaacctgaccaacatggtgaaactctgtctttactaaaaatacaaaaaattagctgggcgtggtggcaggtgcctgtaatcccaactactcgggaggctgaggcaggagaatggcttgaacccaggaggcagaggctgcagtgggctgagatcatgccactgcactccagcctgggtgacagattgagactttgtctcagttaaaagaaaaaaagaaaaagcaggctatgggaatgtaagacaagggaatggaggttcctgtggcaaactgaagagcacctgacagcactcacaggtttttttgtttttgtttttttaatttaaacattgtgcctgccaaatcagaaattggaaaacattgttagatttagccttttgatatcaatttttaacccttaactagaagtcacaggcttgatttcgctaccagtatccagaaatcttagctaactctggcaccttaacatgaagtgtagggtctatgtaatttaagggtatttatgaagaaataaaatagtaattcacttactcataagcaccaatggtttcaattaaagcagatcattttacctaaatacatggcaaataaatctgtttcgctagatgtctaaactgagtaaaaatagacaatattttgactttttttccagcaaggatttgaaagatgccatagaagttctgatagcagaaaaaagacgcaggatttccacagaagagaaactggaagaatgtatggactttgccactgagttgattttagcagaggtactgacctgaactaactgtaattcccatgccacatatgttatgactgtgtagaggtgtgtaaagatccccttttgtaactgttgcatatttctgcttttaaatactttctctagcagttctgtaatcccaatccaaatagcccacacattagatatttcagtaaggcttttaagattggaacattctagtaagactgactgctaagattgtgactcttctgtgtaacagtataaaatatgaaaacaagttgggggaggccaaagacactacatatacatagacagtcggcctaatcgttcatctttcagctaaagattgtcatgtaaaatgtccacagtcaatcacagagacatgtggtttctatgatttcattttgttgaggttgttgatccttgagtgtcacctcccctcattttttgaaactttgattcacttttccaaatttttcccatcttccaattgttcagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtaagaatttatcaaataaataatacatcttaaaaacaatttcttctgaatgtccatttcttatgtcctaagaatctgatatcaaacatgaaattttttataatttgctccaaacaataaagcaagacattctgtcacatttgattacaccagatagacggaaaagatagctctttctgtgttcttaatcataaaaatgatgcatgctcattgggaggaatttaaatcacagaatgatgtgtaaagcagtaagtgacatcccccaatcctttccgctctcctctccagcctcatctcccctctccagtggcaaccattgttaatagtttgctgtgtatttgctaaaatctttttctatttgcccacaaacacatatttatggttggatttgtccattttacaaaaacatgggatcatatacaatgttctgcctaccttgtcagttacaaaagacttttgtggactctcccagggaaattatcgtcccagggaagtgatagtctatcatttatagcactgtttctgggcttcaagcagccccttcacaaatgaacttccagtttgtggcagaaggaagaggagaggatgacagcaaagacagggtagtgatacatttccctctccactccaatccagtgatgctagccccttcctctcccctgccctctgcaggggagcttccaggtccacactcaggtcttctccaactctaccgcctcactactctgtctctgcttcaatttcatcctgctccactcttctacagaaacaaggccatctttgaaagaaatcaaacttgctttctgggagaaagcagaattcctcatttgacacttccttcacataagtaatcttttaggaacacatttcttacagatgtgaagagagatcacagaatgtggacttccctctcttgactttacacagaccctgcaaaacaagttatttggttgtagaagggcatcatctttttcaaaccattggagtgctccttgaaatagttaaacgtaagggaaaatttcatcgaagggttaaatatgggagagaagggatctgcagatgcctcacacaggtgggaagtttccaggcaaggtagatagcaaggatacagaataacatctggaatccaaattccagcatgttttcttgagtgcctcctagcaggttctcaggttctgtgccaggtgcagggctacagccttgaacaagccaacaccacccctgcactcacggggctcatggtctggtgggaaaaagaaaacaagctcaatacggtaaagagagaccgaaggagggcattcagagaaaccataagcctttaatacatattgaataccatttatttgagaggtgaaatgtacgtgtacatgttaatgttcccctgacacttcaaaaggcctctgcaaagatggaaaagcagcagagccatttgcaagcgtccatgctccctcctgtgtgccacacacagactcgctaactacttcctagtgagcacctttggtcaccttctccatcatcttcttttctacctcccaaccccagctatacaggccccattagacccttgagtgtgccaagggcagtatgtaagaggaagggccatgagaagactctgaccaaactagacctttcctcagtggcttcgttgtatatgagacagggctgcctcaggaccctgggctatttttcatcctgcaaaagtggcatctctgaagctttaccatgtctgggaataatctaagtctctttgaccagtgtcaggctaatctgagacagtgagggtgtccatctatccccagctcacccagggctgatctgaggcacctattttgtcgtggtggggagaacatccttgtcactctactgcaggtctttcttgatgagatgcagagggactatcagtgacatgtatgggcagatgactgcacaggtaaccagaagagaaaatttcattgaaatagatcaaatctgccatctcactttgactctgcagcagcctgtgcatcatctctgggatggttgtggtgccagtttgctcgtaagtgaagagaggaaatgaatgtcccctacaatttagagtagggaacaaaaactcaaagatttcagaaagcaggcacatgagatgaatgtttgaagcagattgggtgtggtctagatggaactgtatgatgtatgccccctctaaacaggtaattggccactcagcgtcagcccattattgctatgtgggaatgtaagttcagcatcaccaaattttctggacattcagacttttctataaactccaccagtttttaaggtaattggcttcatatctgaatttttataaaaccctctgtggcccaagcataacatatttggccctggttgctggtgtgcattagaattagagccacaatttttttcaaccaagagcaaacggttctgtggaaaaaaatagaagctttaataccaagcacagatggaaactaacattaccttctttgttccttttatctgtttccacaggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgtaagagcccttccttaaaactgagtgtgccactcttgaaaatgtcaactgttaaatcctctctggttctttgtgtttgcaccataaatacttcatttttcttactcattccctctgccacctcaccaggagcacacacgtcccctagcttggagcagggctcccgtattcatcctcaagccttcaaggatgttgggtctccagctctaagaagtatctacatggtggccacaaaataggtcaaaatgtgaaaaagctgggcccttcatttggctaaaatgaagtgatttttgtttaacccaaccaacctacttttccatttaaactttgtcatcatgtcatcacattcagctatagcaccatctgagcaaaggaaagtccactactgcttcagatgaaaatcaaatgagaccaaaagatttggtttttgcaaagtgcctttggctcatcaaatggccccatgagcagtaggtcccattctaaataggacttaataattagaagagagacagtttttctttttttataattgatgtgtactacagattccaccttcattatgtcaaattttaggcaatatgtttttcaatctgaattacgtacgcagttccctaagtgcccttttttcaatttgcatatggtgtagaaacatgatgctaaataattcagtactctaattcattttgtttctacacgggcaatccagataatgctatgtaaatcagtcaactgatcaacaaaaatttattgaacatctactatatgccaggcactaagtccaaatgtggacaagacagctgtggtcctcattaattttctgcataactacaaatagttagatgcttggcactgaataggccaggaatctacatccttgcttgcctttatctcttatatggtgtcacacaaaaataatctttgccttagtgacttataaaacaatagtaaatctgtggctattccacagagctacctgattatactaacacttgctgtaataagatttggtttgcattgctttaccccagcacatgaaaggcaaaactggggactctctgaggttgggtcagaacacagggggtgaatgaaataggacatagaaagggcttgagttccagttgttcatctgaggggatggagggcattgtagctgataaccccaaaacagtgttctgactgacccatgttttcagaatgaatcaaacagagactgagtgactctagcctttaatattctggctaactgtctgatcattttcataggttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggtacaaaaatatcctgggggaaaactgggagtggaagggtggggggtgggagtgagggacatgggggagggcaaggaaaaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtgccattggcccactgaaggatagagggacccttttcaatctatatcagctgggctctgggactgaatctctcacctattcttgcagaaagacatactaattaaaccttgtcaaagtagtaagtcaaatggagcgtatgatgctttcagttgctcttagctcaaagaacaaagtcaagggattaacccttcagggatcaatcctgtcagggcttacctgtttcaacttcctcatttcctttctgcagcttttagcaggtattggcctattctaggaagtcaatggccataaccctgtttctaccaggtcaacaagacaatggaatgtatttagacagggcaacccccattcatcaagtccagcccattaagtataccctgctctctcccatcaagaaaacatttcgaagtgcaaaacaaatgagagtcataagaaaatgataattatcataagaataactttgaatccactgtgatttataaccaaaagcaaatgtttcacaaacctcagtattttaatttgttagcaaaacatttcttgcaaagaaggtcttaattacaaggc

SEQ ID NO: 16473 - DNA, 63926 bp, Human
ctacttatcttttcctttcgtagcacttattgctacctgaaattactttgtttatgcatttgtttacctgtgcattacttgcttctcactttagaaggtaagctccaccagtgagcaactggtgtatgtcttcctcataacacatccccagtacctagcacagtgtctggctcatagcaaatgatgaattgttgtgagttaaacaaatgtgaatacagttgggaaaaacaaagccacaagagccaaaaagatacgttcgagaggtaggtagaagggtatcatttcctggaagatggcttcccagaaactttgggattatcttgtataacctcctcagtccacaagtggggaaattgaggcccagttacaggacactgagagaaaaactgttgtgggttcccaggcaattgggatcagatgtcacaagctgtctagcagatgaggtccagagaaggccacagccacctccctgaggccatcactataagtctgcagccaccaccagccctaaccccacatggggaagaggtgcctctttgggagcagaggtgctagtcagctgacaaactgtgaaggcagggctgtggagggtggagaggcccattcctgagacaaccagctattctgagacagttagggataatggttggtactgaaagaacctggcctcctcaccctcgttccagtgctcacacctctgtcccaccagaggtgagactaatacttgaactcctttcagcaactcttagacgcttcagcttttatcagggcctgcaaaggagaggttgatcatcagatggagccctgtccactgggggctcccagtctgatggaggagacagactgaggtcctcaggttactgactgatagtgtctgggttggagggagttaaacagagaggagacccctagaggaaaggatccctgaattagttcaatcggcatacagaaattatccagtccatgaggtgacagtaagagaagtaactgccagtgtaaagggagggaggcaacacagctaagttccaggaattgtttgcagtcttgtgggtggaatcttccggaatttgagaagagagtggcagaataggaggctggaaaggagggtttggccaaattatggaggactctgaatgtcaagtgaagagtttgggctatctttggtgcataaagaggtccatgggagatttttgaccatagggagaccatgatgagctctgcatggtagaaagtgctttgtggctgttttggggaggtagctcgggcaaggagagcaggggtgggaggcagatagaaggaaaaaaaaaacactgtattttggacgcacagctcttggcaggactcctgtaggaggaaggaattgggccttggtctcttgagagctagtatcctcacttctcagactcctgcgccatgcccttcctagggtccaactttcattcacttcttccgaactccaagtttgaatagaaagtgttgctgaaaccctaatttaaaacgaggggtcagagcaaaagagacttcagctcccagaatgcttggctctacagctctgcaggtcgcgcatggttcttttcaagaaaggggggccagctgggtgaagtgtgggaaacctgggtaccgccatcttaacttgggtcaaaccaactgttcacctaatgggaggttcgtgttctctctgttgtcacttgttaacactattgaaataaaatgcgcttaactattgcaagtctccttattctgctttgcgttggggattccttccattttgcaccctaggccagaactgaatccctaaggttacaataggacatcccagcatggccgcattcagagagattcctctgggggcggagtcggaagctgtctcgccccgcctcctggtaggagggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacaggtacctagggagcagccaggcgaggtcgttggcgggtggggtgggcccaggatagggcagcggagcgcggccgaccctcacgcttccagcagactcctgagcggcccgtcgccttcccctgcccccaccttcacacataaaccaagcgaggcccctgcagcccatcggggaggcccaggggccacccctcagggcggagggcgaggtttgggggcagaggccgatgtgagggtgggaaccggctgccggagtccagcttattgcagaggagaggactgaactgggtggggactaggggacaacttggaggagggggtcgtcagagggggaagggaacttgaggggtggggccgcaggggggtgctgggggagggtgcggagggagtggtgcctgctgggtagtgtgcagtgaaccctcccgcgaaactgggcagctggagtaggggccttcttagggtccctctgggcggggctgagcttcccacctgcagagtgggtgcgaggtggagagaaccccaggcggggttgctggggcgaaagggggaagggaccaagacgtggggcagaacgtctggagttggagttaaggactagttaggagcctggatagaaaaagaggtatggagagaaagcttggctaagggtatacatatgttggtgaccttttgaaagagtaggacttttcaattttgtttttcgttgtgtgttttttgcagtgttggaacattgctagattaagcaggtgatgggtggagcttctgtagtttgttttggggaagcagagtcagggtcaggagaagttgcatcttggctattgctttgtgtggaggaaagagttttgaaaagaaggtggcaaattatttgggaagacttgattacttttcagctgtttaattctacgagaatgggacatggggagaggaaatgaaaactaagaagagaggccgggcgtgtggctcacgcctgtaatcccagcactctgggaggccgaggcgggtggatcacgaggtcaggagttcgagaccagcctgaccaacacggtgaaaccccgtctgtactaaaaatgcaaatatcagccgggcttggtggcgcgcgcctgtaatcccagctactcgggaggctaaggcaggagaatcgcttgaacctgggaggcggaggtggcagtgagctgagatccgccactgcactccagcctgggcgacagagcgagactccgcctcaaaaagaaaaaagaaaactaagaagggaagatttttccaagaattggagacttcattccatctgaggagtgcagtgtaggcccagtggttaaaaaccagactgcctaggttctcaaatatcagggccattgctacttagctgtgtgacctaaactctctaagcctcagttttcccgtctgtaaaagggggatgatggtattttctagcttgtgagtttacggagaagagtaaataagacaatttgtgtcaagtgcttactacagtgtctggcaggtagtaagtgtagtaagtagcttttacctgtcactgtaaagggactagctggtatatttggggctcttctgttctaagtaaaatttatagtcaagaatttgactgtagacagggctttagagtagtatctttgtagttgttgtagggttttgttgtaagtcatttggctttactggcttggtggacctggggctgaaagtccagtaccaatactagttctcctccgtggtattctcaaaagttcacctgcagtcttagcagggcatgtttttgtccttctgtgactttgaaatacttggctttggtttgctattgcgggagggtgtatgacttgaagaaagaatgcaagattggaaatttgcttagattgattaatcaactgattatacagttaggtccccgtgaggtgacttttctttaaaaataaaaaaaagcctagttatgtactcctttgtggaatacagagaagagaaatacacatttaaggaggagcatgggttagtttctaagtagttatgggtgaagtgccttgcaatttgaggatgaaacaggtggcaactccttttccatactgcgcgtccttttcctactcactcatccagagtgagtccttgtttttactattgtctctatctctgaacatacatctttgtgtcacataagtaaagacatatgtatgtatgtatatatactttacttcacataagtaaaatatatacatctttacttcacactctgttaaagaaagggatgattttctttaggaagtgagtttaaacccttccataggacttggatttgtagtaggcagaattacatctccctcttcccaaggtgccataccttgatccccagaatctgtagctatcctgtgttacatggcaaaaggaacttggcaggtgtaattaaggttaagaatcttaaaatagaaaaattatcctggattttctgggtgggccgaatctagtcacttaagtccttaaaagcagagaactttctccaactgggatcagagaaatgggcagaaaaggaaatcagagatttgaagcatgagaaggactccatttgcctttgctagagaggaccacatggaaagtttatcagaaggaatgtgggcagcctctagtggcaaagaccagtccctggctgacaaccagaaagaaatggggacctcagttgtgcaaccagaaggaacctgaatttggtcaacaacctgattgagcttggaagtgaatttcccagtttccaccaaggaatgcaaccttgagacaccttgatttttggcctcgtgagaccctaagcaaaagacctagctagccaagcccacccaacttctgacctacaataactgtgagataacaaatttgtgttatttttagctactacatttgtggtaatttgttatggcagcagtagaacactagtatagattttggtaccaggagtggggtactattacctaaaaatgaaagtggcagtagataaaggttagaattgttttgaggggcatgatagaaaaggcctggaacacaggaggatcgcttgagcccaggaagtcaaggctgcagtgagcggtaatggcaccactgcactccagcctgggtggcagagtgagaccctgtcaaaaaagaaaaggcctaggacatacttttagtagcaatatggatgttaatgactctgctagtgagggcccagacagaagtgaggtctttcttattggaaactggcagaaaggggatccttgttacatagtagcaactaagtttagcagaattgtatcctatggttatatggaaagccaaatttgcaagtgatgaacttgtatatttagctgagatttccaagcaaagtattaaatgtgcagcctggtttatttgtgaatgtgaactttaatggagtggacccatgtggaatacttccacagcccattaggttcttgagaattttatgccaacataaacagttctagtttggattgaaagagacagaaagtaatagggctgttggaccccccaaattctactgataggaagcaggctgataaaactactcacatgtgaatgtgttgcttttcataaaagaatcagggtgactcagacggagataggagagcccagaggggtggagctaaaagctggagaggatttttcccaggctttgaaatggaatggagattccctagattttgaaactgctttggaccggaggctctgttttcttttacattttgcccatttgaactggaatgtctaactgttattctctacatgtctcacagtggtatgttgggagtagagaacttgtttctttaggaattgtgccccaggaattggacttactgttttgtccccagaacctcatccacacctgaatagatgaatgagatttgggacttctgaaatgataagctttagatgggaaacctttgggaccttgggatgggatggatgtattttgcatttgagagagagatgaatccttggaaaccagaaggcagactgcggtaagcagaatggctcccctacgatttccatactataaaccctggaacatgaatatgttaagtagatttaattaaagttaaggatcttaggtagattatcttggattttctgggtgggtttattctactcacataagcacttaaaagcagagaactttttctggctggtgtcagagatgaggcagaaggggaagtcaaatttgaagcatgagaaggactcagcctgccgttactggaggggaccagattgaaagtgtgagacggggaatgcaggcagcctctagtaggaaaggccagtcccagctgacaaccagcaaggaagtgggaactcagtcctacagctgcaaggaactaaattcagccaatagcttgaatgaatgtggaagcaaattttccccagagtttccagcagggaacccacccactggataccctcatttagcccttgtgagacccagtcaagcccactgacttctgtaagataatccatttgtgttgttttgtttgtgataatttgttatgacacaatggaaaacaaatacaggggttttgctggttttattttagagtctttgggatatcattttctagagaacaaagatagcaaagattctataaaacaatttagtcctggaagactccacggaataatggtgttgagtggaacctgtgcctgtttcttgatgtttgaatattattattgtccttagatgcagtttgaaggggcttgatggtcagcttagtgagatgtagtttctgaaggtctaggacattggtaggatttctgtaaataggtggttcttccatatcttggataaatgacataatttcttcattagtttttattggcttaataatgggtttctatgacagccttttaaggcttatttcatatttttttagaggagatggaaatgggtgatacatttttgtgaatttgtaactgtctctctgttctctcacacctcccaccccaccccagctcagctcaaacttgtaagatcttttctccctgtcattgtctgttgaggttgttgagtttaagagtcagatctgggaatcatcactacagaatggagtttctagcttttaagaaaagtcttttctttttgttctttaaagtatcctattaattggattcataaaatatggactaactaaactttagtcagaggatgaaggaagtgagaccatttcttttgagttattacctgaatagaaagatgattacaagattagcatttcagggtatgaaagactttagaggttatgtttgactttgggtttagagtaagggaaattgggccacatgaatgttaactggtctactaagatatctcagccctagagctagtctagaatcctggtccagccaatagagaatcatgacttttgaactatgttccctgagtacccttttctactgttggccgggcatggtggctcacacctgtaatcccagttctttgagaggccgaggtgggcagatgacttgaggtcaggacaagaccagcctggccaacatggtaaaaccccatctctactaaaattagctgagtgtggaggcgcgtgcctgtggtcccagctactcaggaggctgagaatcacttgaacctgggagacggaggttggttgcagtgagtcaagatcacgccactgcactccagcctgggggacagagcaagactccgtctcaaaaaaaaaaaaaaaagatgttaactgtctataatattcaactatatgacaacttttgcataaatattacagtatgatttgtacaagttcagaaactgaaaaccaatatgatttgccattgaattaggtaagggcttagtattttaaggtaataaataatgtgatacttgatttgaaatgagaaactgggttttgatctgtcacaattcgtgggtaacctggataaggtttgtttcatgagagtattaatgtgttcttatacctgaatttctttgaacttctgaaatggataatttcgaaagtagcatgtcatttagtttatagagaaatctaggccagccagcttttcaaatgaagaaattcctctaggattattaaggaaaagtagctgctgtcattgtaacaaaggatgtattttcattgggttatagacaattggtagttttcttacgttgagtgctcccagatgtactttttttttttcacatgtagaagtcaaagattgagtcttttaaaaagtttaaggtgaaagcattcacagtatcacaagatactgctaagagtggcattttaactggtttctacaaattctgtctttcagtcttagacattaaaaaaccctacgtagcaacagttgctatggtcggcaagcttctttacattcgtggtgataatgttttcttgcatagaaaatattgtgttatctgaggtgacagttttagggttaaataccaaggtacaagttagattaatgttttataattttttatgtgtgacatcttaaatgcccttatattggctgctcttttctttttatactttcttgtcttgtgggtttttctgacaggtttttattagctgaaacattttaatttgcttggaaaagtgaacatttgaaattttcctgaagttatgactaatgctttaatgggcatttctcagtttagctatctcatcaatgttctataaattttaagaaagctaccctgtttaaaatgaatgggtaaattattttccaaaaaatggtatcatgtcatatccagaaatacgagatggtcattttgggttattgaattcataaccactcagaagatgttgttcattcagcagatcctgagcgcctgccacgtttctggcaggcgttgtgctaaagatctccaaactgtcactgccctccaagctcaaaattgagtgacgttttctgataacaggcatatcataccacaacttagtagattttggaggtgttttcttataataactcctatttgctttgtatcttaggtgtagtttttgaaacagctgcagaaatgagaagggggtagaatagagaattaattgagattgcgggtagggaggggaaggcaataggttagtgggaaagaactcccactttgagtttggggaagtttacttaacctcttcaagtctgggagttcttgtctctacagttcggataacaactaccttgggcaacttactaacttttggtttcttcacctgtaacatgggaattagtagtacctacctcaggatttttgtgaggattaataactagagtactagctagtattatctcaggattattgaggattaaaggagaaaattgataaaatgtctggcatgtgggtgcccaacattagttctttcccttccctttcggagaaaagaatgtgtttattgccagtgctgtcattcttcattctttattttcattttctgctgccaagagttcttatttttttaatgagacttttgacctgtacttccttgtttctaatgtagcctgttgggtgggtgaggtatgaattgctgcctaggggtggatcagtatgtaagtcacgcccagtgtagattacctcaattactcgtgtacagtgtctattacctagtcctggtgagtctaggattcttttgcttctagatagagaaggtaatattcccatctcagactcaggaaaaggtctacctttgctcacctatagacttgtaaatatagatcagaggtcttactcccagtggttctctgatcacagtttgggaattgcttgaatattgtgtgttagggatatgtttggagaaggccagctccctgcattaacatcttctctatgtcttgctctctcaggtaatccactaacttgctttcttgtttgctttgtattattaagtgataaactgtaggcagaccaggaacttgtatttatcggcactttaaaactttttttttttttttttttgagatggagtcttgctctgtcgcccaagctggagtgcagtggcgcaatctctgcctcctgggttcaagtgattctcctctctcagcctcctaagtaactgggattacaggtgcatgccaccccaccgggctaatttttgtatttttagtagaggcggggtgtcgccatgttggccacgctggcctcaaactcctgacctcaggtgatccacccgcctcagcctcccaaagtgctggggttacaggcgtgagccaccgcgcccggccagtgttttgtgtatttatgattatatagaatggctacaaatggccatctgctttggagttgtctaccttttgtgaaaaaatgaaaatagactattgcctagcaattaagtattcaagcatgtattttgccacataatttattgtgagaaggttatcaatgtcaaataaaatgctttcattatttgcttctatttgtctgtcttcctgaccagttcatttttccttccagtgaagccatcttgagctagggttttctttgtgggtagttgttaattttttttgtagagacaaggtctcaccatgttgcccaggctggtctcaaactcctgggctcaagcagtcctcttaactcagcctcccaaagtgctgagattacactcatgagccaccacactggtccgaagaaattttttttttttttttttttttttttttttgggagatagcatctcactctgttgccaggctggagtgcagtggcacgaccttggctcactgcaacctccacctcccgggttcaagcaattctcctgcctcagcctcccaagtagctgggactacaggcgcacgctgccacgcctggcttttttttttttttgtattttagtagagatggggtttcactgtgtttcccaggctggtctctaacacctgagctcaggcaatccacccatctcggcctcccaaagtgctgggattgcaggtgtgagccactgcacccagcctggtctgaagaatttttaaacaccacagctaaggacctgagcattcatctgcagctacctatatgctcttgttacatacagttgttatactagggggtttttcacagccatcttttatgactgtttttggaaaacatcacattgaccttcatacatattcaaaactttaggctttgttgcatctggagtccaacactgaggcccacagatgtcaccagcccccagccagcaaggtggggcatgtctcagttgtcttcctttctcccttcagtagccacacagaaaagcttttccatcatttaaaatctgatttttatacaattgtggcctggtggccagcccattcaggtaaaagaataatgaagaaacctgattattgaaactcagtatcccacccctaccttgcctccaaatttaaagcagttcattttattatagtgttttggataggctgttaataaatcagtttggagaactaaggaaatagtattaaatttagtgaaaagaacctatttaggctttggatcctaaacagatctggcttccaccacttagtaatcctgttgtttttggcagattatttaacctctgaatctgtttatttctaaaatcagaatatgcatctgatactgtgcctggtttgtaagaggcattcaaatggtaacagtagttattacattcataagtgctgaatttttctttagattactgtatatcccaaatgaagttttccatcttttggttccagagggtaatagccagtggagtaaagtttcacattgtgactttattttgcttatatggcgtggtaaaaaggtgtatagatgatgactatattgtaagagacagtactggaattccgatttctcttaggtgtttggggtagaactattaatccaaatcaaactgcttggattttcttctaatacctcccttcattgggagacctcacactgttgctatgtcatttatgtcacattgacactcagatcccttttctgggttgaaggtggagaaatgtaattcacacaaaaggcccaaatgctaatgttttctgttttactgtacttcctggtttgttttatggaagtaatacttccgtgtattggtttaatttttttgtatgtatgtatgtatttattttgagacagcgtctcgctctgtcacccaggctggagtgcagtgacatgatctcggctcattgcaacctctgcctcctgggttcaagtgatgcttctgcctcagcctcccaagtagctgggactacaggtgtgtgccaccacacctggcctatgtgcattgtttttaaaaacaaacatgttgtatgttttgtatgtaggaataaaagcagaaggcccctaggggcatgttaggatttataatctcctaaagttaaatattctgcaagtttacacaagcagtaacttcatgaattactaagtattactgagagtatttatgttccaaattcgaagccttaatcaaaccagaaaaaaacatattctgttgggtttgaacaggtagttttcttattcattgtatacttagaaccttgggacttaaaggtcagagagtcaagggaactgccaaggagttagttgctagatatttttttgtttttttgagctgtatatatttccccacttgaaaaaacaaaaacactactacttatatggcattagtatgataggtgagagagaatgttgttggccatggttaccaccttaaattgacatgggaaaagagaatcaatatgaagtggaggaaaaaaaacaataacttcatttaatcatacatttttaccgttaacctgttttcttttggcttatccttctgagctagggtaaggaggcttgttttgtctttgttgtttttgtttttttgtgtcagtgacctccaaatagatgatcttccagacgaaatggttgcctgttagtacatctggtctatacttgaaagctgcaaaaggtgattgcgtatctcttgaaataagaggaattgtgaaatagttttctcaacctgctgcatggattttgactattcaggtcgtgatctccacaagttatttaaactagaatttctcaaccagtgtattgtgttagggtgcgttacagatgtgttgagatactggtcccctcacacctctggccattcatgcagaatatagtttggatacagcatccaaactaatgacctcagatccagagcagtcttgatcatttaccccattgtgccatacaaatattattttctgtcttgactgtaaaaaagactgggagcagtggctcacacctgtaatcccagcactttgggaggccgaggcgggcagatcacaagatcaggagttcaagaccatcctggccaacatggtgaaaccctgtctctactaaaatacaaaaaaaaaaaaaaaaaaaaattagccgggcatggtggcgcttgcctgtagtccagatactcaggaggctgaggcgggggaatcgcttgaacccaggaggcggaggttgcagtaagccgagagcgtgccactgcactccaggcctggcgacagagcgagactccatctcaaaaaaaaaaaaagttaaaagtttagaaaaactgggagcactaatttagaaagctcagtaattggatatctgaacagttttaagattcaagggggtaaacaatctgaaaataatcttggttttaagtttttaaagccattttaaggtacctctctgacccacaagtaattctctttggacacatgattcaaaggatatgctttaaaatacaagactgtgaacaatttaaggttggacagtagtgaagaaattcaagttcttattttctaagcagtaatgtgaggcagaagtaaagttcccttttgtaaaactgttatctctacctgactaactctgaatgctactgtatcttttctgaggctgacattttgttaatcattcatcaagcttgggtctcatactctgaagcctaggatacattgtcttcttgtcttccttcaggaaagaatggcatatacttagtttgagcagtttaattttttaatatttatgtaaatcaccaagttagccttcttagatgagtttctgtttgtctaactcaggaattattaattttgctggagtttacagatttcctgagcctgtaataatttttttcttcaaaaaaaaatgtacatgtacatgctgctttatatacatttaccagagagttcatggccactgatctcattgttgagctgcattttcagttccaaaatttgtgtagtctaaataagagttcccccatcttattatttgtaaatttatatatttagtataaaccagggattgattgctcaaatgccttcaggagtcgagtcaataaggtaaatgaagagttgtccaggtttacgtgtggtatctccattgggtgtctgttaaaagagccagttgttggacagtcacagcttagcatatccagcaggtttttgtcagtgcaggaatgaagagtcattgttaccagacagacagacctacctgccctccctcctgctttatttcttttaagaaatagaaagttaaatttttttttaattttggtaactgtcactttgaaaaatattaattgtgaaaaattttaatacataattcaccttaataccttttcttttgttttttgagacggaatttcactcttttcacccaggctggagtgcaatggcgcgatctcagctcactgtaacctctgcctcccaggttcaagtgattctcctgtctcaggctcccaagtagctgagattacaggtgcccaccaccacacctggctaattttgtatttttagtacaaatggggtttcatcatgttggccaaggctgtcatgaactcctgacctcaggtaatccgcctgcctcagcctcccaaactggtggggttacaggtgtgagccactatgcctggcccctgatttactttttaaaaacagtgtgaaggctgggcactgtggctcatactgtagtcccaacactttggaaggctaagatgggatgatcgcttgaatccaggagttcgagaccagcctgggcaacatggcgaaaccctgtctctactaaaaatgcagaaaattaactgggcgtggtggcgcacacccatagtcccagctacttggaagactgaggtaggaggatcacttgagctcaggagtgtgaggctgcagtgaagtgaactatgatcatgccattgcactccagcctgggtgacagagcaaggtcctgactctaaaaaaaaaaaaaaaaaggaaaaaaagtgaaaaacttgtacacatatgcacctagcgacattatttcatagtagccaaaaagtggagacagtccaaatatctgtcagtgaatggacaaccagaatgtgatgtatttatacagtgaattcagctgtaaaaggaaatgaattactgatacttgcaacaacgtggataaacttgtagacattttgctaagtggaagaggccacatattgcatgattccatttatgtgaaatgtccataataggcaaatacatgaagacagaaagcagattattggttgccagaggattgtaggaagaggctattgggagttaatcctctgaggtactgggtttctttttggggcgatgaagtgttctggaatcagatagtggtgatggttccacagcattgtgaatatacgaaaacacaccattttagggtactgattgtaccctaaaatgatgagttttatgttacatggattttatctcaatttttaaaagtaatatgtgagccaaataggagatatacacacagagtagtcctgttcccagccatctgtgggaaatatattccaagatccccagtggatgcctgaaaccacagataataccaaacctgattatcatcagttggaacacagttttctgttgatgtcttctacccacaaatttaatgccttttccattttaactaagcatttatcacatactgcggtcataacttttgcagtttgaggtacaacagcaaaacaaatgtgaatttatttttccctcttcacattatcactgatagaagatttgttcttaccatagatcttagcaatttccacatatgatttttttttccatattaagtcaagaacttttacctttttacttaaaggaagcactttacagcttcacattggcatttccagattctcagcatcgctactcttgcactttggggcatttcttaagtaaaataagggtaacttgaagacaagcactgcaatactgcaacattcaagtaaccaagaaggctaccaagtgactaatgagcaggtggcatatacagctggacaaagggatgattcacatccagggctggatggtactagatggtgcaagatttcatcacattactcagaaccatgtacaatttaaaacatggctgggtgcaatggctcatgcctgtaatcccagcactttgggagggtaaggcgggaggattgcttgagcccaggagttcaagactagcccgggcaacatagtgagaaaccttctttacaaaaaaaaaaaaaaaaatagccaggagtggtggtgcatgcccgtggtcccagctacaagggaggctgagatgggaggtagaggctgctacagtgagctacggttgcaccactgcactccagcctgggtgactgagtgaatcctcgtctctaaaaacaaacatggaaaataaaacttatgacttatttatttctggaattttccatttaatattttcagactgcagttgactgcgggtaactgaaaccatgggtatgggggttggctgtgtttgtggtcaccagtttacagtcccttgctgtagaacagaagaataggctgtgaatctagacgaatgttttccaatcactacctctgacattgggaaggttatgcagttttgccttctgtaaaatgagaaagacattacttaggtcatggacttgctggtttaacagtgataaatctggctgggcatggtggctcatgcctataatcccagcacgttgggaggccaaggtaggaggattgcttgagcttaggacttccagaccagcctgggtaacataacaagacctcagaacaaaaacaaaagacatctcagaaaaaaaaacaaaagaaagaaagaaaaaaaagaaaaaatttaattagcaggggacagtagtgtatgcctatggtcccagctactaaggaagctgaaggaggaggattgcttgagcctgggaggtcaaggctgcagtcacccaccctgggtgacagagcaagaccctgttacacacacaaaaatgataaatcccaagaatcagtgactgacataggcattcacataatatcttcagaattgaaaggcaaccagtttttactgcccttacttccagcctattctatttttgtcagttttaggacaacctaccttattagctgttggttattgatcacctgcggagatgatggttgtctgctatgtaacctgccaccatggcagtaaagaagggagtgggggaagggtgataatccttatattctgcagttttctcactttaatcaggtaggttaaataacatatccaacatcagatgtaggttgtagtggttctagtgtacttattctttctgcaaccttatgatgtcttttaaatccaagatcctttcagtaacggagtactgaactgtttttgtagctctatcaaggcttgtcaagcagtgtgctcatcacatggtaaatcatgcagcgtggaacctcataaaatctccaagaaacatcattcacccatactgactagtttcacatctctttggtaagtgatagtaggaaacctttttcccctggtttaaaaaggatggatgcaataacatttataggtaagactgaggagcattttaaaaaccacaggccgggcacagtggctcatgcctgtaaccctagcactttgggaggctgaaacagttggatcacctgaggtcaggagtttgagaccagcctgggcagtgtggtgaaacacggggcatccaccaagagaaataaatcaaagtccaagtacttgaattcataatctgaggagagaggtgtatgtaaacaaaacacattcagtgtgacaatgtcagagagtatatggggttgctttggccctgtagaagaggtacttggcctgttttggagaaagatgggaatgcttcatagtgtgcttcatagtggatgtaaagtttgctgattcttgaagggtgagtaggatttcccctagcaagcactattggaaggcataatcaatgtataaaagcacagagacctggagaggagtgggaagcaagttcagtcagtttaaacaaatgttttgaaaatgttaatctgtgcagttcaaagacattagaatagaacaggttgaaacaatactgattgaatttattggttatgggactatttatggttttcattttttgtgtcagtttttgttttttctccctgagaatcagactgggatcttgtatcagttttgataaattatttttcttctgggaatttcaagtttgtgggcacaaagttgttcgtgatattgtcttatctttttaccatctgtaggatctgtagtgatgtatcatttccattcttgatactggacatttaccctaattcatccctcactccctcatttccattcttgatattggacatttaccctaatattcattctctctctctctctctctctctctctctctctctctctctctctctctctgtctgtctctctctctttctctctctctctctcattctttctttctttttttgagacagagtctcactgtcgccaggctggagtgcagtggcatgatctcagctcactgcaacctctgccgcctcccgggttcaagcgattctcctgccttatcctcctgctgggactacaggcgtgtggcaccacacccagctaattttttatatttttagtagagatggggtttcaccatattggccagactggtctcgagctcctgaccttgtgatccgcctgcttcagcctcccaaagtgctgggattacaggtatgagccatcacacctggcccttctttttttttttcttaaatcaagcacacttacatttttaatttcttcccccccacctgcagaggcagggtctttctctgtcgccctggctagagtgcagtgacatgatcatagctcactgcagcctcaaactcctgggctcaagtgatcttcctgccttagcctcctgagtagctgggactcagctaattttttccattgtttttattattaaaaacaatttttttgagatggagtctcactgtattgcccaggctggtctcaaactcctgggctcaagcagtcttcccgcttcagccttcctaagtattgggattacagtcatgagccaccatgcctggcctaatttttaaattatttttgtagagattgggggttgcactctgttgcccaggctgatctcaaactcctggactcagacaatcctttgcctcggcctttcaaagtgttgggattacaggcatgagccacgggctcagcacgagcatttttaaagactcaattggtattgtggatcctctttgtttcatatttctttgattgctgcttttcccgtttttttccttctagtttctctgggcttctgttttcaaatttattgagatatgtgtaagttcttaatttttagtttgcttttctaagttcaagtttatgaatttttattttcgaatcagggccttgctatgtcgcccaggctagagtgcagtggcataatcacagctcactgcagcctccacctcctaggctcaagtgttcctcccatctcagactcctgaatagttggaccacaggtgcatgccaccacacctggctttttttttttttttttttttttaatagttttaagttaaaaaaatagagacagggtctcactatgttgcctaggctggtctccaaactcctgagctcaagcaatcctcacaccttggcctcagcctcccaaagtgttgggattacaggcattagccactgtgcacagcctaattattattattttttttttctttttttttttttttttgagatggagtctcgctctgtcgcccaggctggagtgcagtggcacgatctcggctcactgcaagctctgcctcccgggttcacgccattctcttgcctcagcctcctgagtagctgggattacaggcgcccgccaccatgcccagctaatttttgtatttttagtagagacggggtttcaccatgttagccagggtggtctcgatcttctgacctcgtgatccgcccgcctcagcctcccacagtgctgggattacaggcgtgagccactgcgcccagccgatttttaaaatttttatttttatagaggcgaggtctcgccatgttgcccaggctggtctcgaactcctagattcaagtaatccactcacctcagcctcccaaagtgctgggattacaggcatgagcaaccacacctggcctaagtttataaatttctaagtcctgctttaattgtatcccacgttttgaaatatcgtatttttatgaacaaactctctatagcctatgtttttttttatttaaaatttattgattgattgattttgaggcagagtgtctgtcagccaggttggagtgcaacactgtgatcatagctcactgaagcctcaaactcctaggttcacatgatcacttcagccttctgagtagctaggacacaggtgcatgcaccatacttagctaacttttaaatttttctgtagagatggtagtcttgctgtgttgcccaggctggtcacgaactcagcctcaagccatctttcctcttcagtctcccaaagtgcagggacccctgagctgtgcccagctcttaatttctaattgatacataattgtacatatttatgggatatattgtgatgtttcagtgcatgtatacatcgtgtatataatatataccccatgttttagatgtatctcttttttttttttttttttttgagatggagtctccgtcacccatgctggagtgcccactgcaacctccacctcctaggttcaagcgattctccagcctcagcctcctgagtagctgggattataggcacccgccaccacacccagctaatttttgtgttttgttgttgttgttgtttttaagtagagatgaggtttcgctgtgttggccaggctggtctcaaactcctgacctcaagtgagccaccacacctggcctagatgtatctcttttatttatttgtttattaatttttttttttttttttttgagaaggagcctccctctgtctcccaggctggaatgcaatggcgttatcttgctacaaccttcgcctctcgagagtttcaagcgattcccctgcctcagcctctaagagcagctgggactacaggcacgcaccaccacacccagctcatttttgtatttttagtagagatgggtttcactgtactggccagggtggttttgagctcctgacctcaggtgatctgcccacctcagcctcccaaagtgctgggattacaggcgtgagcagctgcacccggcctagatgtatctcttttagacagcatgtgatagaatttttttcctttttttaaatttttttttaaattaatacacagtaaaattgactcctttttgtgtatactgttctatgaattttaatacatacatagattcaagtaactaccatcacaactgggacatagaatagttatatcaccttctgcatgttacccttggtaacatacctagcctcccacccctaatctctagcaaccactgttctgttctgagttactacagtttttttttttttttttttttttgagatggagtcttgctctgtcgcccaggctggagtgcattggcgtgatctcagctcactgcaagctcagcctcccgagtagttgggactacaggcgcccaccaccgctcccggctaattttttatatttttagtagagacggggtttcaccgtgttagccaggatggtctcgatctcctgaccttgtgatccatccgcttcggcctcccaaagtgctgggattacaggcgtgagccaccgtgcccaacctcactacagttttatcttttcgtgaatgtcatataaatgaaatcaaacattatgtaatattttgagactggcttatttcattcagcatactgcctctgagattcatcaaagttattgtgtgtgtaaatggttagttcctttttattactgagtagtattccatttatggatagactatagttatttttatccattcactccttgaaggacattttggttttcattctttggtgattatgaatacagttgctgtgaacataacattataggcttttgtggacctaagttttcatttttctagggtaaataactgtgagttggattgctgggtcatatgaaaaatgtacatttaacttatttataaagaagttgccaaactgttttctagaatggctatacagtactattttgcgttcacactagcaatgtatgagtttcagtttttcctcatcttctctagcatctcatcctctttagcatttcaagttaaatattggcagtatttaacttgtaatgttgaaaattttaggtttacagaagttacagatagaatctccatatatgcttccctcagtatatcctaatgttcacatcttgccataaccgtgatatgtcatcaacactaagaaactgggccagtcatggtggctcacacctgttatcccagtaactctggaggccgtggtggggaggattgcttgaggccaggcgtttgagaccaacctggttctcagaagttaggtgggcatggtggcatgtgcctgtagtcctagctacttaggaggctggggcaggaggatcgcttgagcccaggagtttgaggctgctgtgaactgggagagctaggatcacaccattgcactccagcctgggtgacaaagtgagaccccatctctaaaaataaataaataaataaaataattaagaaattaacatcggtataatactattaactaaactacaggctttgtttggattttaccagttgtatcctttttctgttcaaggagccagtccaggataccacattaatttagtcatcatgtctccttagtatcctccagtctgtgaagcttcttagtctgtctttaattttcattacttggaaacttttgaagaagactggtgatgtatgttatagaatgtccttcaatacaggtttgatgttttctcaagattaaattgtggttatggatttttgagaagactaccacagaggtgaagtgcccttctcatcacattatatcaggggcatatgatgtcaaagtgacttaacactagtgatatttcagtaaagtctgccaggtttttctactgtagagttgctatttctccctttccaagcccattggacttaggaatacccttgtaatgaataagcatggaaagggagaaatttaggctctctttccatgcttacttatttcctttccttaaaggagaaaaattgagctccacctcctagattcctcacatgtgcagttcacaatagggttctcctatgagaatctaatgctgttgctgatgggacaggaggcagagctcgggcagtaatgcgagtgactcccgctgctcacctcctgctgtgtagcctggttcctaacaggccatgaactggtacaggcccatggcccggggattggggacccctgatataaatggaagtatacaatatgtaggcttttgtttctggcttcttcacttttaagattcaccatgttggtcaggtgtagcagctcacacctgtaatcctagcactttgggagactgaagccaaaggattacttgaggctagacgtttgagaccagcctgggcaacaaagcgagaccctgtctctaccaaaaaaagaaaaacgattcatccattttgttgcacaaatcagtaatttgttcctttttattgctaagcatcacatggcaaaccatttgtttgttcatgtaactgttggacaccttggttgtttctgttttttcacaattatgaataaagctgccttaaatgtttgtgtataagtttttgtgtagatacgggtttccgtttctcttgagtaaatacctaggagtgggaatgctggttgtatgcttaagtacatgtttaactctataagaaactgccaaactgttttccaaaaccattttgcattcctaccaggaatgtattagttactgttactctgcatccacaccagcttttggtatagttttgttttctgtttttttaaattttagccattttaataaatctgtagtggtagttgtatgatttaatttcattttccctgctgtctggcagtgttgtgtatcttttcatatacttatgtgtatatcttcttttgtggtgtgtatgttcacgtcttttgcccatttttaaattgagctgttttcttattgagttttttaatgttacagatacaagttctttattcgatttgtgatttgcaaatacattcttcttgtgtctggcttattttcttaatagtgtctttcacagagcagaaatattttaacgttgatgaagttcagtttatcagttttacagcccatgcttttagtgtcatgtcttcaaactctgcctaacccctggttgcaagaaggtttgataattttacatttatatctttttttttcccccccagaggtagagtcttgccttgtcacccagcctgggattatacagtcatgagccaccgcatctgacccaagttttacattgatatctgtgattcattatgaattatctttatataaagtgtgagatttagattaaagtttatgattttgcatattgatctccaagtcttccaaaacaatttatagaaaagattattatgcctgtaatcccagcactttgggaggccaaggcaggtggatcagttgagctcagaaatttgagaccagcctaggcaatatggtgaaaccctgtctctactaaaaatacaaaaattagcagggcatagtgacacactcctgtggtcctagctactttggaggctgaggcaggagaatcacttgaacccaggaggcggaggttgcagtgagttgagatcatgcccctgcactccagcgtgggcaccagaggcagaccctatctcgaaaaaaatacataatatatttatatatatatgtatatatgtcctttctccattgaactgcctttgtacctttgtcaaaaattaattggccttgtttgtgtgagtgtatttctgtactctttattctgttcccttgatctatgtattatccttttgccaatacactgttttgacaactatagctttgtaataagtttaagatcagttagtataattcttccagctttattatttttcagaattgtttggattattctggttcatttggatttcttttttaatccagtctgatatgatagtctttgtcttttacctggataatttattccacttatatttaatataattaatcatattccaattcaactttcttcccctatgcttcttatgttctagatttttttcttctcccttcttaacattcttttggattctttttatgattttacttttccctctttctggtttggaaatatatgctatttttattctgtaattagttgtcatacatcttgtgacttgcagctataacttagcaaaacctgatattataattttatcttcttttcatataataaaagacctttagaaagaatactttgaaatctcctcaatacactgtgtttttattgttatgtattctatgttttaaagctcctcaaggtattgttattcttttgtataatcagtgtttgtttggagctgtctgtaaattttcctcttttttgctctttattttttctttcaactcagaccttccaaaatgggattatttttcttttttctttagagacatttgcttgataacagaattttaatttggcggctatttatttttttcagcacactgcaggtattaaactacttggcttcattgttggttttgaaaaatcagctgttctaatgttgctctttgaatataatctgcctttttctgtacttgcttgtctttagttttttgtttttgtttgagacaaggtcttgctgttttgcccaggctggcctccaactcctgggcacaagcaatcttcctgtatcagcctcccaaatagctgggactataggcctgtgccattacacccaactcatctttgttttttcctgctattttgtaattatatgtttggttttggatttctttttattgatcttgtttggaaattgtttgcttctggaatttgattgtgtctgattgcttctgggatattttcaactgtcttcagttactgcctttatcccattctcttttctgctagtaccaattaaaagtatatcaaactggctgggcacggtggcttacgcctataatcacagcactttgggaggccaagatgggcgggtcacttgaggtcagaagttcaagaccagcctggccaaaacatggcaaaaccccctcactactaaaaatacaaaaattagccgggcatggtggcatgcacctgtagtcccagctactctggaggctgaggcaggagaatcacttgaacctgggaggcagaggttgcaatgaactgagatcgtgccactgcactctaacctgggtggcagaacaagactttgtggcaaaaaaaaaaaaaaaaaaaagtatatccaacgatttcactatatttttcctcttgttttttgagatctgctaggacattgtatttaaaaataaataattggctgggtgcggtggctcacacctgtaatcccagcactttgggaggccaaggcgggtggatcacgaggtcaggagatcgagaccgtcctggctaacacggtgaaaccccgtctttacttaaaaaaaaaaaaaaaaaaaattagccgggcgtggtggcggactcctgtagtcccagctactcgggaggctgaggcaggagaatggcgtgaacccaggaagcagagcttgcagtgagctgagatcaggccactgtactccagcctgggtgacagagcgagactctgtctcaaaaaaataaaaaataataaaaataaaaatagatatttgtagtgatcatttgaggcccacagtaaggtactttcctccatggagagcttgcttatatcaggtatgcatgggcactaatccagagaccaccttaaaacaagcttaagatatgatattcccttcagtagggctttaattcctccctggatcttccactccctagtcactctcaccattaggaagtatgcctctgaagtcccaccttatgaagagggcctcctattagactttttgtcttgtgagagccctgggctttggtttatgtgagaacaaaattctaattttcaggatcaacaaaggctttccaggcttccttgcttgcttatatctctgggtttgcattttctattcccttttggctataattacttctctgtcttatttaaagatgagtgggccaggtgtggtgacacatgcctgtagcctcagttacttgggaggctgaggtgggaggattacttgagcccaggaatttgaagtggcagtgagctacgattgtgccactgcactccagcttgggcaacaaggaactgattagtgttggaagtagagaaaagaaaataaagagaaagaattccaaagcttgtgaattaatgatactgtttgttttaagcacaaaatggtaacagtcgagtaaactaatagtctccaaatcagatataaaaaggttgctgacctgatgtgcaaaaaaagcacatcaggtgcttttttacacctgatgccacgttgcatgtggcatccaatgatgtgtttcttatagaagataacaaaatgtgccagcctttggtcattttagggtgcaaaattataggtctttaaaattcttaacttgctttaaagtgttacgctttgcaatttcttgttttaatgttttccatctgaataattcctgtgcgtactttaagtgcagttttttttttctcttacagtttttccccattttaggtactccataaatatttgttgaatgaatgatgggttggtgatagtttaaatacccttcaacgtctgtacaccaccatgacttaattgtttcaagcactgatcacttgagattgtaatggtctgttttctttgtctgagggcagagatactttctccaggaccaagagaaagaatgcctttctggcagtcaggcacacatttcctggtacatagtaaacgttcagtaaatgcttgatgtatgagcattctgctcttgattggaaaggaagaaagaaattaaggttaagtatggacatttgaaataagtaattcaggtaacattagctacttgtgcttttttgtattaagttggccttctaatcagtgccccttttgtaaagggaaatgggcaagtttgactgaatttttctctttgcttctgtagcaaggtagaaaagtatacatatttaaggtctcgctgagttccacaagtcttgtttgtctcttaccagtttatgttgcctgattgcttggaaaaagagttcattctctgcagcagtgcataaaaggtgtcttcctgtatagctgcttttcctctaaacaagcagtcctaaaccatgcagtcagtgcaatctaagcacattcctcattctttgctatagaaatctttgtcctgtcgggatgatgatgagatcttgttcatttgctatggttcatttagggatgagaaggagattttttttttccttttaagatggagactaataaacattagggttaaaaagaactaattatattacagttcaaaaattgacttaaagttctagaatgatcttttccatttctgatactaggaaattcatcaataaaaatacattagcagaaatgactaagcaaacttgtttgtatagttttctggtattggactgttactaagcctctagttttctttttagttgccaaattgaaaaataacaactgaacataagagattagaaggagggactagctaagggcaagaggagtttttattgaaattaattctgctgtattcagtgtatatcagtaaacttatgattttggcaatggacaatttttccttatggtttaatggcattttctttttatttacttatactttattaaagaataggtcatgcagacccatgcagttggcttcgatgtgatcttacttcagtcgggaaaaattcattgacatgatacttttttcgtagctgattaattggcttctgttaggctaaacgttgagcatacaagacctagccatgtcttcaaagtcattctgacggtgttaaggtagatgtagtggtctgaaatggttagccactaaagttacacctccttttatgcaattacatgagaacagtaagcactaagtaagacaatttaaaatggaacttaataagaaaggcagtgcattttgttagattgccttaagatatactagtattatgaacagtggagaggagaattgatcttccaaatatctaggactcaggcactttttccatcttccaaataagctgctataaaaattggtaaaatcaagtttcttcagtattctcttaatttgaattatcgaggggaaaaagacaaatcctagttgtagtcctgtgatttaatagaagctgtagtattgggaaagagagagagggaagggaacaattactcaagaacctttgacttggttttccagttctcctagttgcgtaccagatgacctgaagtatttaggaacaccctatactttggatgcaacttcattttcatttcatttttaaaaaataaaccaagattaatttgatcaccaaatagtgtttactgaacgtgctacaaaatgcaagccttaggctaggtactataaattaaaaaggtaaattaaacatggttcttaactttgtagaacttagggtccaattgagaaattaagatttgaagactggtgtgtgtgtgtgtgaatgtgcagtagaaagtgattgtgttctgtaggagtgagaagacttgaaccttggaggccaactcactgtctttgaatcccagctgtaactgtattggatattcttggtcaagctactgaacttaggctgttcttatttgtagattagagaaactaatgcttgcctcgtagagttgttggaagagttagatacttaaagctgagaaactcttagttccagacttgtaatatctaactgcctattcagaatcttcgtttgaatgattcaaagccattttaaccttaagtccaaaacctatcttgtgcactcttatctccatgaatggcaccaacagtctgtcaagcaagaaatccaagagtcacctcccacttcatacagcattttccagttcactcagagctattgattttacaccataaattttgttcctcatattagtccactgatctccacatgccaccaccttaggtcatcatttctctcacgtgtgctactgttaacagccttctccctaagtcctgtcccacactcagccagagtaaaaattttaaaaacaatatgtatgggtcacttttctgcttaaaacttttcaatgaatttctgttacccttagtccataggtaaaatcttcaatggcatacttgtctcacccctgttctgccttgctcacttatattcctaaggcctaggatagtactttttcatagtagatggttatctatttaagggatggacaaaatcaggaatgtagggaagaatcaaaccaaaaattgagaaatgtaggctgtgtgttttcttcctgttagcttacatgtgatatacatatgcatttgcagaggtataagtgaaatactatttctaaataagataatgtttatcttggttgggcatggtggctcacacctgtaatctcagcacttcgggaggctgaggctggtggatcacttgagtccaggagtttgagaccagcctgggcatcatgacaaaaccttgtctctacaaaaaatacaaatattagctgggcctgatggcgcatagctatagtcccaactactcaggaggctgaggtgggaggattgctcaagcccaggagatgaggtggaggtttcagtgagccgagcgagattgcaccactgcactccagcctgggtgacagcgcaagaccctgtctcctgtctcaaaaaaataataatgataatatttggtctttgacctcccttttctgtcttttcacatcccctcttgtttttgttttttgtttgtttgtttgtttgtttttgagacagggtcttgctctgtcacccaggttggagtgcagtggtgagatcatggctcactgcaaccttgacctcccaggctcaagtgatccttccatctcagcctaccaagtacctgggaccacagttgtactccactacacccagctcatttttatgttatttgtagagaggaggtctcactgtgttgcccagggtggtctcaaactcctgggctcaagtgatcctgccagagtgctgggattataggtatgagccaccacactgggcttcacatcccctttttatcaccatcccttaacccccaatctcttagtacccttttatctatctgagattacagagtcacagttgaagaatcctctgttttattttcccgtataattaatgaaggccagccatttgaaattcatgtgaatacctttcttactataagcagattatttggtatgcgtgacagtaaggtgaagcacctctttgggggtactgcaaaaatagttagcttgttgtcttcccagtggagaatcagatctgctagttcataaattaggtcccagttgatgagccccaaagcttcaagggtcattcagacaagtactggagaatctcaagagtttcattagttattagtcttttcccactcctcacagaggatgccagggccttgaaacagcagaagaagactgggtgatgagaatgtacatgactagtaataggagttggctattctccatatgtcagatggtttccagggagaaatgaggactcattttgtaatgtcatgtatacttgggagttagccctcagtggccgggaattaaccacggctactataatttttgtattttaaagaatgaaggttccagcctgtaaagataggtttctgcttattagctttcactaaggagctaggggatagtaattacttaatacaaatttacatgcatttcatgtttctaagccctttctggaagatcatctcacttcatcttcccttcagtctgcaagcacagttagacaggttttataagtgatgaaccaaagctgggaaaagcccaacagagagatcacttttaagcataggaaaagggctttgagatccacagacgaaggctgtcttacacgtataaaatgttaaccagaagagtaaagtggctgtaaaggttatgtagagaaagatactgtttcctgtcagaggagaggctgagaatttaaaagtttagtatattaaaagtaataaatttctggggacagcatttctgttgggttcatgctgctgtttctactattttggccatattcacacctacacctttctctacggttttcctagtgtctttcattgctgtcaaggcaggcatagtagtcacagagtcaccaatcctacaacatagatgaccttatttctttgggaagaagaaaaattacaagaaaacatctggtttttgcatgtttgatgtgtttgtgtgtgtgtgcgtttacagttttaactgatattaagtgaagatagattaatgtcacccaggttttacaaaatcaaagaaatagaaataattttaaagacttttggtacttgaattactttgttgttttctggtcatttagtacatttatggaacctcagaaggtttgagttgaacagaggcaagttacagcagttttttgggtgggagaattcataagtcagcatgtgaatcttttgatctcatatatttggagtggaatgtcattaattgtgtttgtcacggttaaggaatagagaattaatctccatcccagtcttgctattcttctgaaagcctttagctgccgacaccatgggcataaggaggtatctcttctggcttctctttgggtgtggtagctaagttacagcttaccttggaaagatgagcagcttgtaagcaacaaaaaaacagtatagttaacaaatgcatcgtcaacaaacaaaacaacccaatcaaaaaatggacaacagctttgaatagacattctccaaaacaaatatacaaatggccaataagcatgtaaaaagatgctcaacatcattaatcattagggaaatgcaaattaaaatcacagtcaatgagatacaacttcatactcattaggagggctgttactgaaaaaaaaaaaagaagaagaagaaaagaaaaccaaaaaataggccaggcacagtctattttgagagcactttgggaggccgaggtgggaggatcccttgaggccaggagctcaagaccagcctgggcataagcaagacccctgtctctataaaaacaagcaaaaaacagaaaataacaagtgttagtaaggatgtagagaagttgtagcctttgcactgttcctgggagtgtaaaatgatacagttgctgtataggagtgagccaccgtgcccagcttgttgaaacaatatgctggttcttcaaaaaattaacatagaattactacatggttcagcagttccacttctggatatatacataaaagatttgaaagcgaggtctcaaacagatgtttgtacacctatgttcatagcagcattatttacaatagccaagctgtggaagcaactcaagtgtccatcagcagataaatggataagcaaaatgtggtgtgtgtgtgtgtgtgtgtgtgtgtgtatatatatatacacagtgcaatatcattcagcctttaaaaggattggaattctaacacatgctacaacatggatcagccttgaagacattatgctaaattaaataaacaaaacaaaggacaaatattgtctgattccacttatatgaggttcctagaatagccagctcaggcagaaaatagaatagtggttgcaaagagttgggggagggaaaattagtgtttagtggatacatagttttcatttgggatggtaaaaatttgtagaaatggatgatctggtgattactgcacaagaatgtgaatatacttaatgcaactgagctttaggtttaaatgtggataaaatggcagtttttattttttttagatgaggtctctctcctgtcacccaggctggagtgcagtggtgcaatcacagctcactgtagcctcgacttcctggtctctggtgattctcctgcctcagcctcccaagtagctgggactgcaggcagacaccatcacacctggctaattttttgtattttcagtagagatggggttttaccatgttgcccagactggttgcgaactcctgggttcaagcgatccaccctcttaagcctcccaaagtgagccactgtgcctggccataaagtttatgttatgtatattttaccacaatttaaaaaagtgtttcaacaagctgggtatggtggatcactcctataatcacagtactttgggaggctgtggtgggagcatcacttgaacccaggagtttgagaccagcctgggcaacatagggaaaccccatctttacaaaaaaaaaatttatttaattagccagctgtggtagcccacgcctgtggtcccaactacttgggaggcagaggtgggaggattgattgagcctgggaggtcaaggctgcagtgagctgtgatcagaccactgtactctagcctggcctacagagggagaccttgtttcaaataagaagatttcaacaaaaagtaaataaaaatagtacaaagggcatctctattccctttacgcacgtttacctattgtaatattttacccagcttgttttatcatttgtgagtgtgcagtcatgtgtgctatatatatacacatgtaaacgtgtgggcacatttttttcctgaatcattttagggtagattatatgcatcatggctgtttacttctaattacttcaggaaaatttcttaacaatagacatattcttgggctgggcgaggtggctcacgcctgtaatcctagcactttgggaggccgaggagggcggatcacctgaggtcgggagtttgagaccagcctgaccaacatagagaaaccctatctctactaaaaatacaaaattagccaggcatggtggcgcatgcctgtaatcccagctactcgggaggctgaggcaggagaatcacatgaacctgggaggcggcagaggttgtggtgagccaagatcacgccattgcactccagcctgagcaacaagagcgaaactccatctcaaaaaaaaaaaaaaaagaataggtatattctcttaactattgtgattatgtaccaacttcacaaatttacattgatacaataatttaataccctctgaattccagttctgtcgatattgttttttatagcatccccctccacctcctgcagtatgggatacagtctagagtattgcatttatgcaatgtctctttagcctccatttgtcttttatgctgtggacatgttttagaagtatagtaccccttccccctttttaaatagacacttcctctttttctgaatgtttcctggtaattgaattgaagttatggctgggtgcggtggctcacatctgtgatctcagcactttgggaggctgaggtgggaggattgcttgagcctgggagttcaagaccagcctgggcaacatggtgaaacaccgtctctactgaaaatacagaaaattagctgagggtggtggtgcgtgcctgtagtctcagctacctgggaggctgaggtgaaagaatcaccggagtccaggaagttgaggcttcagtgagccatgatcacaccactgcattccagtctgggcagtggaataagaccctgtcttaaaacacatacacacatacaaattgaagttatgctgtctcagccaggagacttgcatacgtgttatatccttctcacgttatcacaatctggagactcaatacaatttcatctaaatgcataatgaggggaatcagcacatgctgtaggagatagggaagacatcattggaaaggaacctgatttgatagcatatttctaacatcttacttattttcccccggtgtcaaattttgcattagctcagctaatctgtattactgttttataccagtttttaagctcctgtattaaatataaagagaatattactgatttctgtttttaaatttaatgaaaccaagtgtgtctttcaaatggtgatcaaggttctactgattattaccttaaggttcccccaaaagatttggattggtataagatgacatggagctttgatgtatgagaacaagcctttattctcttcctggtttcatcaaatatgagtcagaatggcaagttgtactcttagctttgccgccattctagaaccttttagcacccctacttaagttacagaaagctgctgaaaagaaagtatttttcttgccaataccttttgtagaatatataactagtggtaatgctgatgtatctatcctcaatgccatttttctcttccaggctgtcttacaaaaatcattcaaattttgcctgcagaggtaacaggatatttggcaaaatatgattaaagcaaatatcagtttactgtatttcttgggatttttcttctcatgttataggaagcactggttaacacagttgagctatatttattggctgtaggtaggagagccagaggtatatttcaggccattattatttgtaagattatttccttcccatataccttctgtaaatgattccttggactttgtgcattttgtttctgcagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatgggggtaattgtttttgttgacttcattatactcactcaaagggctgaatcttgtggatctgttgagtagtttttgtcagaaaacctccgtgactctgtatgtgtatacctcaggatcaaagcccaatttgtgttttcttttgagctgaaaatttggttttgcagtgaagaagcagagttgctttggcaagtgaacaattttaatgggcttaccatttaaaaatcattttagtttcttatccttttctatgatgtatatgcagtcgtgcaccacataacaaagtttgaattaatgacagaccacatgtaggacagtggttccataagattataagagagctgaaaaatgtctgtggcctagtgatgtcatcgtaacatcaacagtgcattcattaccttttctacgtttagatacacaaataccattgtgttacaattgcctaaagtatttattacggtacacatttgtatcctaggagccgtaggctataccctaggtatgtaatatgccataccatgtaggtttgtgtaaacactctgatgtttaacacatttctcagaatgtcattaaataacgcatgacggtattctgtatgggcacctggcaacaaaaagttacctatcagcttgcttatcaagccaagggcattgcagatcagtgagaagtgatacttgagagactttgaaaacaccaaagtcttatataaagtatttttgaggtagagaatgttgtttcgtgttaatacaggaggacgaaacagttctccaaagaggtaacttctttctgatgagaaacaattaaattcttaaacatttgcccttatcctgagactaggcatgtcttagcatggaattcagcccaaattctatcttgaacagttgtagtctgcctgaacagctgtgtttgccctcctaattctctgtgcagactcatttggatgtttgcatttcctgtcccaatgtggtagacatttaattgttcagatcatacttttgtgataaaagcattttgacattcaagtgcaaaagaaagcaatttgaaaactaaagctacagctcctgtatgctgtattttatatctgactgcatgtgatttctgtaacctgtaagtggttagtggatggcttccctaaattgtcatagggcgtatttttaatcttgagtatgccatgaatttgtgtatgtgtgtgtgtggaaatgagtcttgctctgttgccctggctgcagtgcagtggtgtgatctcggctcactgcagcctccgcctcctgggttcacgtgattctcccacctcagcctctcgagtagctgggattacaggcaccttccaccctacccagctaatttgagtatgccatgattcttaacagtaaatacattgcctctgaatacagaggcactgtatgctgtaaagacaccattaaatgccagtgtggtttagtaccaataaatgttgttattactgataatctaacaattctcctcttatgtcacaggctttggactctaggtgacactgtgtttactataggaatttcagccgctatcttcaaattgagtgctttgcacttggttctgcttaaatggcactaaagagcccttttgggcttttggcatggttctgtttgcttgctggcatttgttttgtatgccctcccataggaagagaactcaaccagaagtaggagcattcttcccctacacctgccatgattattatgttgtccattgtttttagtaccttttgtcttttcattcactttctttttagctacttgaggaaaatgaatggttgaggtggttgatttggttcatattggatacttagtaggtccagaggattctatccagtaggatagaatttaggccttattggaactgtgtttgtcattcttcagagcaaagcgctctacattggaagcaggcaggggcaggaggaaaatgttggcatttcccttattctacctctgtttattacctctgatgttgcttattggtcacagaatatgggtatatgtagaggaggggatcgctgattatagtttacaatctataatgtgcttcgtactacgcatggactatccccagagcttgccctggagggcaaatagattaagcctatacatttgaaagccatttaccttcaaagaggcctgttaaaaatcagctgctgccaaagtgtggctagattgaaacagtcttgcaaaatgtttttagttcctgctaagtgccaacactggaccaagcactaagggacaagaatatataaaaattattctccggccgggtgcggtggctcacgcctgtaatcccagcactttgggaggccaaggcgggcggatcacaaggtcaggagatcgagaccatcctggctaatgcggtgaaatcccgtctttactaaaaatacaaaaaaattagccgggcgtggtggtgggcgcctgtagtcccagctactaggggaggctgaggcaggagaatggcgtgaacctgggaggcggggcttgcagcgagccgagatcacgccactgcactccagcctgggcgacagagcaagactccgtctcaaaaaaaaaaaaaaaaaaaaaaattattctcttggggaaagctgtctcttgttggagacaaacgtatttagaacaaaccttaatacaagccagctccatgtcatgtgccaataaagatgtaaacagtttgggattagaaagaataattgaaaggtataagtttttctaattctaggatttgaaacacacgtattttaattggcctaatttaaaaaaaaaaaaaatacaatgggccaggcgcggtggctcacgcctgtaatcccagcactttgggaggccgaggcggacgaatcacgaggtcaggagatcgagaccatcctggttaacacggtgaggacccgccgtctctactaaaaattcaaaaaattagccgggcatggtggcaggcgcctgtggtcccagctgctcgggaggctgaggcaggagaatggtgtgaacccgggaggtggagctggcagtcagcagagatcgcgccactgcactctagcctgggcgacagagtgagactccatctccaaaaaaaaaaaaaaaaaaaaaaaaacctatttgggaattgtttgaaatacttcttatttctattacagctgctggtaatagattcctgtaatttgaattgatgctgataatttgaccgtttataagtcattttgtttgtgtccacagaaatcaagatgactaccagctggttcgaaaattaggccgaggtaaatacagtgaagtatttgaagccatcaacatcacaaataatgaaaaagttgttgttaaaattctcaaggtgagtacaagagataatttcagaggtatttggaatatagatttttaaaagtagttttgaagacttttttaaaacagcatttaaaaggtttttggtgccaaagcaaataaataaaattttattgtatcctatgaactcaatagaacaagttctgcttatttgacagatcgggaaactgaagcaagagaagtgatttgagttgactcatatagctaggttgtggcagagtaagggagcaaaggtacagtctcttctctcccagttattgcctaatacttatttcctttacttttcattatataatgaggcttttgttttcaataaataaatcattgcctctactttgtaaagatgaggagtcacaggactcgagggggacagacagatgatattagtgcagctagtcgggtgtaattgcccttgcttaggtgatgtgagtggtagggactgaaacaaactgggaaacacatgcctcttcaaaaggagttagctgcttctcagctgaagctgatgattgccctgcagtaatgcaagtccattgttgcttgatactctgttttgcaaataaaagccagaaatttatatttgtatatgaattttcctgacttttaagtgttggctcaagattttaaaaaaacaatgcacaggccagatttggcctctgggagaccaatatacaacttttaatttagttataactatgctgtgcactgtcatatattgggaacttagcatatagttccttaccacaggaactttttcatatttgacactgaaaagtagaagtttccaaactttctcaatttataacacttatactgtctttaatttttcacggtactcctaagtcaagaaatacctcatagttctctgtattaagtagcaaggtccaaatagctaagtaagttttgttttttttattgtttttgtttttgttttgagaaggagtctcgctctgtcgcccaggctggagtgcagtggcgcgatctcggctcactgcaacctccgcctcctgggttcaagcgattctcctgccttagcctcccaagtagctgggactacagatgcacgccagcaatgcccggctaatttttgtaattttaatagagacggggtttcaccatattggtcaggctggtctcaaactcctgacctcaggtgatccgcccgcctcggcctcccaaagtgctgggattacaggcgtgagccactgcgcctgcccgctaagtatttatatcttagcaacttggtagccatttaaaaagttattcacataaattaaaagaaaaaagttaaatttgttcttatataactataatttgttactgttgggttatgtagacctgttgctgcatagcttttcaaatgttgtcattggttggacaccaccaccctcatttcctgtcattgatttttgtgcagtacttgctttttaccacagcaactactgcaaacccagcttcacaaaaatatgccatcgcgaggagtataacacaatccatcacgaggagtgtaacacaatctaatgttgaaactacgaaccacctcaagctggcagtgcacccagtgtctggcagattcaacgatgggttgatgtgtcttcctcaaaaatgtaaagtgttccacagtattcctgtgcattgctggggtgcttcacatgccctttgagaaccagagagtttaagtatttatatctgtcttgaaatatgtagaaagagaactaggttggaaatcaaaacatgtgggtgactagccatagtagtccttttaacctaggacatgtttatccatctattaaaaagaatgttggctgagcatggtggcatgtgcctttagtcgcaggtcctcgaggggctaaagtgggaggatcgcttgagcctggaagttgaaggttgcacggatctatgatcaaaccactgcactccagcctgggcgatgagaatgagaccctgtctcaaaaaacaaaaaggatcaaacacaaaattgtgtgtatatatacatacgttggagactggagttctttgtgattgtatggtgatattcatatggaaaggtatatgatagaatgaggtgatatattattatttagagccacatgaaaagcatgcatagtgggtctacagttcagaagagggtagtagttaggaaaagctcccaggagctgtcttcaggctgaatgggaggaggatttggataggtgttgggtggaagtggtgaagggaagcaggctgtagagtgcaccaagataagaaaagaggaggagggaaaagtgagagaaatatttcatgtgaaagatgttatgtgaccatacataggagttgaacttggaaagagagattaagttggcgaaggcctggaaaaaataatctctgcatttccttgcagtcttaaaattatatgactatctcttctaggtaattgtgagcccttgatgattttgaatgaagggtgatttagaaagatttttttcagctcagtctttctaactgtattgtatattttactgtaactgtgggtaggtggtgtaagtatagatgaatttcctttgtaaaccatatttaaaatttttaatctcccctatttaataagacaaaagttgcattgatcgcattaaattcgggcctgagtcagctgcctggtctgtcacaaaccagctttttaagtttatagatttgaagcattctgtagagtagttttgtcaaccagaagctttttttttccactaaaaaaccagcagttgggttaatggaaaacaggaggtaagttgttgggttagtctctgcagggtggaaagatctcccagataatataacagtttataaagatctgaatagttgaagcaggaagagaagacttatattatcttgtttcttaggtagatattgtattgggtaagaggtcgtgggttgaattcaatggactacatggaagtcattagtaaaatagcttctgtttattgggtaccactttgcattggacctgttctaactgtggtatgtaaatcactaacaggcgagtatagtccctttcagcagtgagaaacatttaaatgcttttctgaacactgcacaaccacaaagccaggttttgagaactgtcaatgtttccaaaatctgcttgctttctgctatcatgtgcttgaggcttaagacaaagttaaaagaatttatagtattatttggtagtttctggacctggatcatcagcctggaaagtatctaaaaataaatcccccgtttccctctcaagattttgatttagtgaatcttggtgggttctgtgagtctgtatattaaaaaaatccaggtgattgttggtcatcaaactttagtaaccaccaatcttgttaatgaagagatgagatgtacttaacttctaagagttatatgcagtgcatctagtctgaggtgaccaacaccctaggaaaagacctgcacagtccagtacagcaggcacgcaggccacatgaggctgttaagcacttgaaatatggctgggctgaattgagatatgctgtaagagtaaaatacattagatttcaagggtttaatacaaaaaaaggtaaaatagattaataatttttatattgatttatatgttaagattttagattaataaagtacattaattttgtcctttttaaaattttcttgatgtggctactaacacatttaaaattacacatgtggtttgtattatatttcctttgggccagcactgttttagactattcaggagaaggctttataatataagcccaggcacagtggctcatgcctataatcccagcactttggaaggccaaggcaggcggatcatgaggtcaggagttcgagacgatcctgaccaacatgatgaaaccctgtctctactaaaaatacaaaaattagctgggcatggtggctggcgcctgtaatcccagctactcgggaggctgaggcaggagaattgcttgaacccgggaggcggaagttgcagtgagctgagatcatgctactacactccagcctgggcgacagagcaagactctgtctcaaaaaaaaaaaaaggctttataaaggaggtgcagtgggaccaaggccctcctcagaaaaaaatgaaaaggattccatactagaacagatgtggaaagaatgggtaaggacaaaggaatgtttaagatatgctctgcagaatactctttagaatggaggggttcatttataagagtattggcactttgggaggccgaggcaggcagatcacgaggtcaggagatcgagaccatcctggctaacacggtgaaaccccgtctctactaaaaatacaaaaattagcctggcctggtggcgggtgcctgtagtcccagctactcgggaggctgaggcaagagaatggcgtgaacccaggaggcggaggttgcagtgagccaagattgcaccactgcactccagcctgggtgacagagcaagactctgtctcaaaaaaaaaaaaaaaaaaaaaagagcattggtgatcaggctagacagttattattatgttatgtttcagccatattccgaaatctttcgaatacctcatttgattcttgcaacaatcttatgagatgggtactcttgttactcattttacacttaatgaaaggcttagagaggttatgtagtttgccattaacagccagcaggtagtaaaggtaggtttcacattgggcattgtgactccaagactcaccctttaccctcagggttgtgctacacaaagatgttttggccatccttgttgttggccctaattagaggaagaaatggaaagggcccatgtttcatcctaattgataaaaagtttgatatactttagtattactaacgatttaaattgctactttgtaaggttttaagacattaacatgtttaacatgttttaaaacattaacatcaagactgatgattgaaatgctaattctgcagaagtgtctggtctttggaatagaaatctttttttctttcaattcaacatttgtaagtacctgcagaatacctggcacagtgctaggagaaggattcagagacgaatgtgacacattttcttccttcaaggtgtgctcataagtaagccatttatcatttatgtattacactacgtgttgaaatactctgaaaaaattttttttttttttttttgctgatgtacttttcccctttcagccagtaaaaaagaagaaaattaagcgtgaaataaagattttggagaatttgagaggaggtcccaacatcatcacactggcagacattgtaaaagaccctgtggtgagtatagtaggtgttagcaaggcccgccagagctgagatggtgtttgacctggagcacaactggcctctttttgttccctcccccaaccctcatcattaagtcctgctttgaaagtgcttaatcagatataccatttaactagcttgggtctttctttcaaagagacctccacccacagactatttcttattcttctaggctaagagactgatagcactggaaactgaaatgtgttaatccattttgcaaactcaggtccgatgccgatgggcgatgggcgcattgtcgggctgcctagagcctggtgagacttcagctccatgtcttctgtttgaaatccatcccaaaaatgacctaagtgcggtgatgatcagagcggggagggcttgtagcaatagagggtttcttactactgaggcgaggactgccaaatttcaccacgcagcatccgcaaacattgtccccattaaagctgtcagggctattgctaatgtgtgtttttgtttttgttcttttcccctagtcacgaacccccgccttggtttttgaacacgtaaacaacacagacttcaaggtataatatataaccaactgtttcgggctagtgggtttttagaccacatagcctttggggatgatgctgttagaagagcttgcttcgcatttgtttttaaaaagcttttcatccttacagtgcaaattttaagatagaagaactcctatataagcagtgcccactttctgcatcttgatattttgcccatttgtttaatgttctttttaatgaccaacacattgacttctcactacttagttgacagtttctgctgatgtccaacctaatgaaggcagtaacacacgttcacttaggatctggccatatggcaattcgctttaaacaatagtgttcaggaagaaatatattgtatgtataaaagtagggactgcttatttcttaggattcctcataaactgtgggctatagatcttaaaaggcagggatcgaggaaggataatgtcaaattctgccataacacaaacctctataagagatatctcagaattccagtctatccagtggcctacttatttcacacagttccaattttacagaagaatatagctactcttttggagtaaaagtaaaaatcttcgatttgcctttccaccagtccagtatccagaatgttatatattaataaattagtgaattctgttgcagagatagggagaaaggaagaggaactgctttagagtcagaatgataatttcaagaaaaactttgtcagaagacgttgctaaccattaaagagacgtacctgtggctgggcatggtggctttcgcctgtagtcctagctactggggaagctgaggtaggaggatcgcttgagcccaggagtttgaggttgcagtgagttatgattgcagcacggcactccagcctgggcagcagagtgaggaccctgtctcaaaaaaaaaaaaaaaaaaaaaagatatgtccatgtaaaaaacattctgcaactctttggaaactggaaaggatacataacagttgttcagagtttactttccaattggaacaagaatagttttgttaaattgactcaacaggtttggtatcatgccatctgcatacccactggtgatctgcagggccaactatgtaaggcaaagatgagttagttccctactaaggaggcagtatatttgccaaaatgcctcttttgagaaggtctgaagatacatgaaaagcaaactaaattataggtgggtgtcagtgcatattaacgtatctagatcagtatgtttctgacagtggattatagcttccgcaatatatgtttaagtaattcttcatttttaagagttgaagacccaaagtatctctttaaagttaatgtaatgttggagaaatagagggcagtgaatggacagatcttggaacaacggtaaatgagccaagtcttggtttgaattactgtgagtgagggtgaaaaatgcctttctgtcagcattatttcatggctcaaacatttgtctttaacagcaattgtaccagacgttaacagactatgatattcgattttacatgtatgagattctgaaggtaagtgaaccttgaatactaaatattttttaaattggtcttctttttgttaaatagtcaattgatggtagaaaagccagcagattaactttgtaaagtatgttgaaagaagggacctctatataagtttttaataagttaatagtatcatacctgtaatcccagcactttggaaggctgaggcaggaggattgcttgaggccaggagatcaaaagaccagcctgggtgacatagtgagatccccatctctacaaaaaaaaattgtttaattacctgggcatggtggtgtgcacctgtaagtcccagctacttgggaggccaaggcaggaggattgcttgaggccaggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatacataaataaataaaaattaataataatagtatcagaacccttgtgctaagggttatggaatggggtctagtgggagtataatttagaacaatttgaaaaagggtatttgtaagatagctgggactgaccccttaacaaatatttgtaatttctgtggcccctatgtaagttaatattaaattttcaaaactcgtgaaaacacctgacgtgctagcttctggtatactttatctcacttaagagtcagcaaataaaacagtaaactttaactcagttctcaaagggtaattgtcctaaggattgtgtaaatttctgcttatagatgctaattgaaaatttacttacatttctaaagtggggtcaccaaatatcttgttcccagtagccacaagatcagcttcctagaagagagaattgctaaaagttggctaagctttcttactaaacaagagttgacataaagcctgctgttggagccttagaaatcccctgaggagattgtgccagcagagatacttgatctttccattggctcatgcagtttgtggcaagcaaggctttagaaagttacagatatgattgcccagccctgggaactgtaggaacccaagttgcccttcaggaaggacaagaatttggccaacaacgtcggctgactgaaaggctgggattaacaaaccccaaagattatactactcagttccctttagtttgaggttggaaacatttcagattggatttgatgacctaaatcaggcattggcaaacttctttaaagggccaaatagtaaatattttaggctttgtgggccatgtagtgtttgtcacactattcaagtctgctgttgttgcacaagagcaaccataaacaatatgcaaacaaataggcatggctatgttgcaataaaacattatttacaaaagcagacatcaggccaaatttggcctgtggtctgccaacctctgttacagactcttaatggctaaagaattactgttcttagaataagaggtttgtagtaaagatctgttttctttctttgaggggtctgtggaaataatctaggatctggacaagacagaaaaatttgaagtggtgcaatttgggtatactttgggtcttttaggacagaaaacatgttgaaacaactgtgtcagaaaaagatctctaagctcagagagctgagtttgcttgactgtgagatcatgaacaagtctctgaagcattgctgtggaagtgactgtgtcctcagcttgaatcccaggggtattgtgaggctaaaaggaaaatttacatggagggaaaagtaaaggactcttacgtattattcaggctaactcctttctgacccgttcatcccacaggccctggattattgtcacagcatgggaattatgcacagagatgtcaagccccataatgtcatgattgatcatgagcacagaaaggtaaagtgataggctgacaagtgttatttatctacatgatgtagctaattgcccatcttcaacactttatcccttgtgttgtcacaggccctagtacctattcggcagttgagaaatatttggtgaatgaatgtacgaatttacaagtcaacatgtttgaaccattatttatattcctaagaatattcccaagaaggaaacatgagtaaagtgggcaaaatgttcatcttctaagcccggaaacgtggcttctcgccttatttattgagtaactggtttcctgagaaactactttctctccatttgccttctttttcttacgtgtacagtgtgggtaataatagccctgcaggcgactaggtattcgtgagaattaaatgtgcacagttaagtggacgagatatacagaaaatgctgtttctgtttattggatgtcataagggccctgttgtctgcaaatgcttttacatgagagctgtaatggccacatgctttagcatttcagttttttaaggtgacaagctgtgatgacttgcctgttgtggtctctggggaggcaggtgatttatttatgcaactgaattacttttagacacacaccatgtcagaggcaccaccctagggctggggatatgtaagtgaactcaacatacaataaatgcttgtcttttaggagctacatttagggaggctggtgggatagaaagttattttgatgtagaagaaaaaacgaatagggaatggcaagagggtatttgcagttttaaaccagttataagggaaggtttcattggaaaggtgacattttagagagcactgggagggacccagccatgcagtcttatgaagaaacatgtcccaaggcagagtaaatagcaagtacaaaagcccttcaggtaaggatatgtttggcatgttggaagagcagcagcaaggataaagctgggacagaatgaatgcggggaaagaaggaggaaatgaaatcaaagaggtaaaaccaaatcatgtaaaaccttattggtcattgttaggccttttctctgaagatagagagcttttgcatattctaagctttagcatgttctcacttgaaatttaaaagttaactacacatttattagaacagctaaaataaaaaatagtgatggtaccaagtgctggcaaaaatgtgaagaaacttgatctctcatacattgctggtaggaatgcaaagtttggcattttggaaaatgcttaactattgttttatagttggttggtttcttgaaaagctaaacatatgcttaccatacaatcctgcagtggcatttatctcagagcaacaaaatcttaggtccacacaaaagcctatatatgaatgcaactatatttgtaatagcttaaaattggggggaaaagctgggtgcagtggctcacacctgtaatcattttgggaggccaaggcaggcagatgacgagttcaggagttcaagaccagcctggccaacatggtgaaaccctgtctctactaaaaaaatacaaaaattagccgggcctggtggcatgcacctgtaatcccagctactcaggaggctgaggcaggagaattgcttgaaccccggaggcggaggttgcagtgagccgagatcgtgccactgtgctccagcctgggtgacagagcgagactgcgtctcaaaaaaaaaaaaaaaaaaaaatggggaaaagtgcccttcaatgagggaatggttaaacaaactggcatatccataccatataatattattatgaagtagtatttctcagcaataaaaaggaaagaagtatgacacatgcaacaacttggatggatctcatgcttagtgaaaaaaggcagtctcaaaaaaagttatatgccaatgactccatttttgtagcattctcaaaatgatagagataaagagcagaggggttgccaggggttgggctaacacacaggacatgtgtgtggtgatggaacagttctatatcttgttgaggagattatatcaacttacatatgtgatgaaattgcatagaaacacacacacaaacacatgcgtgcatgtaaaactggtgaaacctgaataagatctttctgaattgtgccagtgtcagtttcttgattttgatattgtactgtagttatgtaagatgttactattaggggaaactgggtaaagggtgcagagaatctctactactttggcaatttcctgtgaatctataatctctccatagcaacctgaacaatccttttaaaaagctgtttatatttatttttaaatatttaattatttttaaaataactattaaactatttagtatttattaaactgtttagactagagggcaagagtgaaagcagtgagaccagttaggagaaggggctatggcaatatatcaaacaagaggtggtggtggcttggatcggggcagtggcagtggaggtgatgataatggtcacaatatgatagaaccttcagaattttttgacagattaaatgtgaggtctgagggaaacaagaatccagggtgaatcttaagttttggcttgtatgacaggatgagtatcacctttaaccgaacagggggagactgagtggaggtgcttttgcagggagtaatcaaaggtttagttttgagatacaggcagtaaacttagtgccagagcagtccgatgtttttcctcagggcctactgctggcacttcagatcatggtcatgctatgcacagtgggcagataagcttgcctcttacccctttttccatgtttaggatgcattttggtaaaagctgtattgtatgacttttctgttatttcatctatccagcaaatatttattcatttttctcctgtataccaggcattatgttgaattctgaaaattacaaaggtgaataaaacagtccctacccctaaggagcttgtcgtccatattgaaaaagaaaggtagaaaacataaagagtttaggttctgttaaagaaatatatctaaaattcagggggctgaaggcaatgatcagacttcattgagaagctgacttaaatattccaaaagttaaggaaatgcttaccaataggattataggctgggtagtagggacattttagtcattgagcagtttaagaaatttgtaaaagcacaggtgagattgtgtcttccaggaacaaaatcatggagaaagaggtttgtcaagctaagaagttttattttcattctaaaggctataagtagtcagtggaggggtttcagtaaagagtgacgtgtctggtatattttatcaagagtatgctaatggcacagtgtgggtagcttagagaaagataagattgctcatggtttattctttttcagctacgactaatagactggggtttggctgagttttatcatcctggccaagaatataatgtccgagttgcttcccgatacttcaaaggtcctgagctacttgtagactatcaggtaagaacagaagggcaggcacagttttgatcctgtgtttatttcgcacataatttaccaaaaaaaaaaaagtatcattttgtgcatttaggtaggccacttaatgcacattcacagctgtcctttttatatgaaatgtaaaatataaatcaccttaattcatgtaccatgacttacattacttttattgtcataatgtcggtagaatatgaataggtttgcatttgatcctgacttgagggaaagtagccaaagatatgttctataatcagcagttccagaactgttttgaattgtaagctgttttgtttttgtttttgtttttgttttgagacggagtctcactctgtcgcccaggctgcagtgcagtggcatgatctcggctcactgcaagctccgcctcccaggttcacacctttctcctgcctcagcctcccaagtagctgggactacaggcacccaccaccaccccagctaatttttcttgtatttttagtagagactgggtttcactgtgttagccaggatggtctcgatctcctgccctcgtgagccaccacgcccggccttttgtttgttttctgaggcagggttttgctctgttgcccaggctggagtgcaatgccatgatcatagctgactgcagccccgaacttctgggctcaagtgatccttccagcttagcctcctgagtagctgggactacaggcgtgcactaccacacccagctaatttttaatttttttgtgtgtagagagaaagtctcactatgttgcccaggctgatctcaaactcctgggcacaacccatcctcacaccttggctccccaaagtgctgagattacaggcatgagccaccatgcccatcctgtaactaagtttaaccaatcttcagagtaaattcaagaatgttttcttgttcttctgaattgtatactaaataaaaaggtcttctccccagctcccccaaaaagccttctttctcctcacagaaaaaggagaaaggaaccaaattaataatagatttgccaagtgtttaaaaatctgaagttttcttgggagtatcttttatgcccagtctttccaggttattatcagttgattttaaaagtttcagactttttgttcttgtaggaatttctttcttggggtcttaaggctatagccctgagttcaaaaagcattttatgcataaaaatagtttttacagtattactaataattgtgaaaaacagaacactgtcctattataggaaaattaaagattgaattctgaaacatttatgtaataaaatactaatgatacacattagatggtctccatgggctaacaatttggaggttttttttttttttttttcatgtaagtgaagaaaacaattcaaaatagtatgtatattagctgagcatagtggtgtatgcctgtaatcctacctactcaggaggcctaagcccaggagttggaggctgcagtgagctatgatcacgccactacactccagcctgggcaacagagcaagaccctgtgtctttaaaaaaaaaaaaaaaagagccaggcacagtggctcacgcctataatcccagcacttggaaaggccaaggcaagtggatcacaaggtcaggagctcaagaccagcctggccaagatggtgaaaccctgtctctactaaaaatacaaaaaaattagccaggcgcggtggtgggcgcttgtaatcccagctactcaggaggctgaggcagagaattgcttgaacctgggaagctgagttgcaatgagccaagatcacacccctgcagcctgggcgacagagcaagactctgtctcaaaaaaaaaaaaaaaaagtaaaaattgttttaaaaccgagtgaaagatgcataaaagaaaaaactaaaaaaaaaactaaaaaaaaaaaaaaaagaaaaaactagccaggcacggtgggtcatgcctgtaatcctagcactttgggaacctgaggcgagcagatcatgaggtcaggagtttgagaccactggccaacgtagtgaaaccccgtctctactaaaaatacaaaattagccaggcatggtggcacgcgcctgtagtcccagctagtcaggaggctgaggcaggagaattgcttgaacccgggaggcggaggttgtggtgagccaagattgcgccactgcactccagcatgggcagcagagtgagactctgtctccaaaaaaaaaaaaaagaaagactaaaaagaaatatatgaagatgttattagtgttttgattttgagtcagtggagtgatttttttttaattttaaaaattaattttttattttgaagtgacaagcctgaggattcacagataataacagtgagtttacttttatgcagatgtacgattatagtttggatatgtggagtttgggttgtatgctggcaagtatgatctttcggaaggagccatttttccatggacatgacaattatgatcaggtaatatatgttatacccattgaaaaatgtactggcctaatgcaatgatagccagcactgcctgtaactttcagttcactgtttattcagccaccccgatattgatccttagattgatgtttcgggagctaccagcttagccttttgaaatcagacattcccccctagtctttgtcatttgcattgcttattttattgtgaagaatacatataaattgtcatccagatttttaaaataggacattaccttagaattctcctaataaacccttatctccaatatggtgttttctccaatatgtgagcccatatgtggtatttctgtgatccttttggctctttatatgggttgagttacagatgtttcttaaactaactccacttcccccttgaagatcaaagggctctttcattcacaagaacctggaatgattctaggaccttgtggaaggtaccattgtcttgttccctttgagcaccatgtccaattttaatgagtcaaagaatacaacctgaattccattaaagtcaataactctgtatcaagtgcatgcagtactgaggaatacagaaaaaagaaagaatagttttcttcccctcagatagttcatagctgatcttgtaagggagtcaaacatacaacaaaataggttacagtcataacttcagagtagaaatgtggacaaggcacaaaaggcagtagtggtgagtagtttgagtgtgcaatgggagcttcccaaaagaagtgacatcttcaattgggttttgaggggagaaaaataagggttcaccagggtgacatttcaagaggaagaaaccagtttataaagtagtttgctttttctaacactatcacattgagttgaagtctaaactgttaggaggtagcattcatacctgtagacatgatgacccgtttatgtaaattcaatcattgttaattgttgatttgttaatataatatgcttgtgatatgggtttttgtctttctttaatactagttggtgaggatagccaaggttctggggacagaagatttatatgactatattgacaaatacaacattgaattagatccacgtttcaatgatatcttgggcaggtaagtcatgaaacaaaatatgtgcatctgtggcttaagcactttgagagtgaactggcacttaggatcttcaaaatagttatgttttctttgccagcactgtcaggatgtcagtggtccagtgccacaggatgctgcattgagcaggcctctgataaaggcattggattgaatggccctttattcaaattaacttacaggagtctgatggaggggttatagctagaggattcctacaaaatgaatgtagattctagtagaagggttacagttgaggcaaaaatcaaaatttaccttgcttctttaagtgaaaaacctctctccaagagaaagaaattgaagtagaaaatgcatgctttaagactgatgtgcaggctgggcacggtggctcatatctgtaatcccagaactttaggaggatcacttgagcccaggagttggagaccagcctggacaacataatgagaccctcgactccatgcatggtgatgtgtggcagtagtccagactactaggaagctgaggcaggagcttcccttgagcccaggagggaatgctacagagagcaatgaacatgtggctgcgctccagtctgggcaacagagtgagaccctgtctccaaaaaaaaaaaaaaaaaggctatatgcagacaaccgactcttaacagtagtgactagatatagtacttatacacttaaccactcaacaggaggagatggactttcctgatgcaaaggcttttgctggccaattggcagagatgccaggaatatgtgtggggatgggaaataggcctggtgagctcagccacctgaccctccttgctacacagaagcggtcacgtcctgtcaagtaacctgaattatgtttcttaaaattgagaggactcagatgtcttttttcactctagctatgttgtttccagtctccagttagctttgttgtcccactcagtggcagagcggtgcaagactaccctcttgagtttggatccctctttgcttttgtctgggctgttagccactaagaaaaatgtaggaatgaaatgttgggcttctgtgcccacgtggcccatttctcatgccctcttttggtcctgcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctgtgagtccagatatctagcccacagagtttgtgcaggcgcagagtcctatagaacagagtcgtaatcccagctcctgtcagcttgctgcaaagttaattcacccacactgagcctcagattcttccagtggggatagtgatggcaactacattgcagaattactggaagaattcttctgtaacagaatacatgacacaagagcattcctaaataaactcttttcatactgtgaggatgacacttctcagtgcctcagtctggaatggttgaattagaatacacagccctgtatctttcctgtccctagtaatcattcgttggaaagagctaatgaggcttacaaatcttaaaattgtatgaacaccttgacttagatttgtgagtatagccacctgtgccatcctaagtgaaaataccactgagacccaccccatctgcactgtgatgttagctgcaacatgacatttttccttcggtgtgatggttttgtactgaatcatttatacttttgcccaatacctgaagcagatagataggctgattgggatagagaatgtggtcatagccctaagctacatggacctatagctttggcctacttggtactgggctgtggacacactggtaatatattaccgtctttgccgagttacagtgtcttgtctccattaaacctcaacaggaccagggcttcattaaattcgctctgctataaataattacctcatctttctaccatttgattgaaaggttagcttttaccacagtttgataggaaagctatttctgctttttaccacttgtctaattcatggtgaaggcaattgccaccttaagttctttggggaataatgtagagtatatataaattgcaaagaatgaagctggctgctttcaggcttccagaccattagtttaatctttcaagcaaaacagaacctagcctttttgtctcttttctagacactgttgtgaaggaccaggctcgaatgggttcatctagcatgccagggggcagtacgcccgtcagcagcgccaatatgatgtcaggtcagttcattggtaaattttctttaaaaaaatgtggaagtcaattactgttcttagctttgtggtctgatttcttgtataccttctcttctccgtactggtggccttgtgacttttttttaaccaggtttcagcatgcttgacatttggtatactttagtgatactgtcttgagtagggtatccccttctaggctagaatctcagcattcctggctgaaaatttttggcataggggcttgaaagtgccaagccatgaaaaggaaaaatacaccatttcatcttatagtttgaaatgacagtagttacatggcccttagaaacaatgttaagaaatggggtatagaggtggggtttatacataggtgtgtatgtgtacaaggacagttccgtgacatgtgccagagcaactatagagtgcctatcagttgtaaaaacataagtaaaatggttttccattattggatcattgtgacgcacagtgaatttttatagagtacccagttattccaaaggaactacaggcacatagcataagaattatacatataggcaacatccaagtgggtgcatatctggtagtgaaggcatttacttacatatcctcaaataattgctgttgccctcctcttttttaagaaaagaactaactgccttctagaatttaccccttgagtatcctacctctgtacagagtaatgtatatccaaacttacttgtagccttatttgtaataacaaaacattgagaatagctatcagtaggaaactggttaaatcagttatggtatatccatttaatggaatgtggtgcagccagtagaataagagtttcatgttctgttagatctccaactccaatataataatgtgaaatttaaaacgcaagatgcagggccaggtgcagtggctcatgcctgtaatcccagcactttgggaggctgaggcgggtgggtcacttgaggtcaggagttcgagaccagcctggccagcatggcgaaaccctgtctctactggaaatacaaaaaattagctgggcgtggcggcggcgcctttaatcccagctacttggaggctaaggcaagataatcgcttgaacttgggaggcagaggttgcagtgagccgagatcgcaccgttgccctccagcctgggtgagagtgagactctgtctcaaaagaaaaagtgagatgcagagccatgtctaagaggagtggagaagaatgtataataatgttctcatatatatatatatatatatatatatattttttttttttttttttttttttttttttttttttttttttttggagacaaggtcttgctctgtggccaaggctggagtgcagtggcacaatctcagctgctgcagcctccgcctcccgggttcaagcgattctcccacctcaacctcccaggtagctgggactacaggcgcccgccatgacgcccagctaatttttgtatttttagtagagatggggtttcaccatgttggccaggctggtcttgaactcctgacctcaggtgatccgcccaacttggcctcccaaagtgctggcattacaggcgtgagacactgcacctggcctttgtatacttttttgaaccttttgtattttgaaccatgtgaatgtattacctgtgtgtacacacacacacacacacacacacacacacaaaaacatgattagagaggtggaagaaatcaaatggaaataaattccaaaacacaattttatcttagaaaatgctctttccccattcaaattgactttcagtaattttgaaagctgccagctatcaagacagcatggtgtaagagcacatgagctttgactgcagtcatgtgctgttcagtatggtagtgactagccacgtgaggctatttaattacaattgaataaaatttaaaatgtagttcctcagttgcactagccatatttcaagtgctcagcagccacatgtggttggctactggtcaccagggtggacatctctgccctagacaggcctgggttagaatccaaccatggttgccacttgcttaatcgtgtactttggacaaactccttaaattgtccaagcctagatttctttacctgtctcttaaattgattaggacttgccactttaacttgaatttgtgagggtcagacttgaagtatatgtaaaaatccagctaagaggaagtcttcagtaaagaattattgtgttccttttgcagtgagtgctatgagaaactggtaagattgccatggttggtgtctttggctcactgacagctcttttctttcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcgagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacac

SEQ ID NO: 16474 - DNA, 10013 bp, Human
acattgtcttgaaatcctttgtttacagctcgccttcccctctcggctgcagaaggcctgtctcagtctcattcatggttttcttctactcccagggtcccaagtgtcaaaatctgcctaaggagcaaataaatgaatgagcctacaaggcaagcccctcttcgccttccgggcccagttcacgccttggttggcatctccagttggaggtggaattgggagggggctggacagaggaatttcaagctgcctgagggtcagaagcagagaggagggggagaagggggagaaagcgaaagtgaagtgagctgggagcccctgtgaggaggcgcagacagggaaggaaatctcccggtaataattcatcggctcaggaagcagcagcctggcctggggctgtgtgtgggaccagccctgcggggagggggcccatgctggctgtttccctcctccccaaagcccagcctggctggggtcacggtcaaatgctggcggtggggggatccaggtgtgggaacagactctcccgcagaccctgggtcctaaggggctcctcccccggcagtcatgggaaatccctcgctccctcttcttcccctaattctggcctggatcagggaagccaggaaagcacagcatggcagagctgcaggcatcgtcaggaaaacagacgcccagaggagccaaaatgcacctagaagcctttcaactccactccctgcgctctgtctgctacaccggctgccactcgggcttattttcaaggccaagtggatgctggtttagctagtgcctggagagagctgagcagcaggcacgagtgagatcgagaccccggcaaccacctttggctcagcaattctctgaagaggacacatcaggctgaacaatctaaggtttctagaaggcaagcaggcattgaggaaagatagcccgtgtgtgtgtgatgggatggtggtggtaggattccaagaggtagtgaaaccggacaggctggagctagcgccgccactcccacctgtacgactgaaggccggagctctctgacctgtaactcagggctgccatcctgcagcctcagctgggcgcaatagagtatatagcaccgagtctggtacacagtagttccttaaccaaaacgtcagttccgtgagggtgaagaatttattttgttaatggctgtatcctcagacctaaaaccatgtctgacacatagtagggacccaacgaatatttgttgaaaaaacgaacgaactactggtgtttgtgtattgtggttttgttttgcttttttttttcttcttttttttaagtttgtcttcagggacaagacactgtcgaatcctcatttggaaagattatagcttttctccaagtgttctccacggacaccaccactatcaccaatggcttgttacaaaatgtaggttcctgggcccgttccagaactgctcaatcagaatgggagcaatttgggactctgtaatagcaaaagccccttccccagttcttacgcacgtgaaagctgcagaactacaggattagaattggagggcaggcagacactagctgtttctctgcaatctgaacgttccgaacgaggaaactgaggcccagagaggagaaagggatctgcccgcgtctcccaggtggtccaggctggagacaaaaagttcggatctgggcccaccccggccgaccctcccagacctccagcatctgccgggctagccagccgggaacgggggccttcggggtgggccgccggctcccgggccgctttcaacctgggggacggaggcggtgggagcgtcgccattggccagggcgcggcggacgcctccccattggccgggcggacgcctccccattggccgggcggagccctccgcccccggccggggcggccttgccattggcccctccctcgcctataaggcgggggccggcggggccgtgggagcgcgcgggagcgcacggcggggcgcggccgacgctgggacgcggcgcacggggggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagacgctgcgcctggcgtccagctacatcgcgcacctggccaacgtgctgctgctgggcgactcggccgacgacgggcagccgtgcttccgtgccgcgggcagtgccaagggcgccgtccccgccgccgccgacggcggccgccagccgcgctccatctgcaccttctgcctcagcaaccagcgcaagggggtgagtgtgctgcgtccctcgctgcggccgccaggtcggggtaggcggggggcagcgcctctgcgggaaccggagaggtgcaggggtccccaacgaggccagggggaagcgacgtggaattcgtgctgggtgcggcaccccaagcccagaaccactgacttaatgcccaggcccccaaacagaaggatgcgggaaaacccagagttcgggtctgatttaactgctcagtgtgggatatcccctccaacgaaaggtgtgctggaacttccttcctgctgggaagacggcatgaggactgagtaacaaagacccatcttttatggagtcttcctctgtgccgatgcgctccacatccacttttttgccttcacaagaatcccttcaggcaggtagtttttctgcccattttatcctgatgaggatctgagcatcagagatgggatcacctgcccacatttactcagctgggaagccggggcgctggccctgggcttgcccggtgtgtgttgcccccaccttgaaataattgtcccctgtcctaagatctaacccaagagcaggagactgagaagaaaggaggccacaaaccgccaaccgagagcctgaggtacccagcggatgagcagtaggagtgaagaaggggccctctgagagtccccagcccccaaaaggacgtggtgttgggagagggcactcttgggtcagctggagggagctggtgtgcagctcctgcaatgtgtcctgggcaagaaagtggatcaggctggtaggggtgggcgggggctgtgtggcagcagaggtggcctcttggctgaaaccttgcccaggctccaaggaacctgcttcatcccccgaccgtgtgcctttctggcctgggcttttcctacagtaaagaagcctgtctaacaacttgtattccagcagctaccatttacatccggggaaactgaggctgagagagtactgacttttggtggccaagtggaagggcatggggaattggagttaggcccctgactccctgctgtttggttctcacagctgccgttggtcccttgctccaccctgttctgcggaggcctctgcatcttggcctgagaccaccctctgtctggctcatcagatatccagcctggttgctcaacacttggctgcctcagttgccctgaatcgtcggtcttcttagcctcaggcttgtgccctctccagggtccctgctgctcccagctgtgggcccctgtcagtgccccaggctgggctgagaagccaggagtgggcctttaaggcttcctgggatgggagggcctgaaggggctctcagggatactccctgactgcctttcacccattcattccagttagcaacccttagctacccaacagctgccttctgttggctctgagaaccccagagaagcaggttgtaggtccccacccttccaccagtcaggacctgacagtacagccccagggtcagggcagggagatgaagatgaggatgctgtggtctgatggtgggggaggggaagcacaaagggattctcagagcccagagaaagcctccaacccagggtgagtgctgacagggtttctgtgtctcatttctgaaggatgctttagaacaggggcaggccgatgaaggggtaggaaagggtgttctaggattggggcatacagcaagagctcaggcctagagaaggaagagggaagaggttaaaagtggcaggagtgcagagggggagcacaatggccaataacagcagtgacagcagccttcatgagcactgatctgtgctaagcgctctttatgatttatcattaaaatcctgcaacagccaggaatgaggcgctgtggttatccccacttgcttagaggtgctgccagtggcgcagagacacacagtcagtgatggaaccaggattcaaactcaggcctgcctggttgggacgtgggataggttacagagggaagtccctgtaactgtcatgtgtccacccccatagcaagcaggctgggggacttctctgcaggtctcaggcctgtcccacagctcacaggggcctcccctgggcctggccgcttccctgggatctgtctatgggaccaagaactcagccaaatttggctgtagaaaccatgctctcaaccccacggtctcctctgggaataggcgagaggggcaatcctggccagctatggccccttgaagactctgctggaagaaaactggctggcttggggagctcttgctcccttctgagctttgtgggccagaagagctttaagacccaagaccccgttcctttaccctgagccaccacctccctcccatcctggccagtctggagttggggttgccgtggaaacagtttcctgtagcatctttctgttgaaggaggggttaggtgtggccctctgtggtagaattagcacgtgggaggtggaaagggggttcttgtctctgccctgttttccctttgtcacctgggggtgaggattggacaggatcatcttgtaaggctctcccctgttggtatacccagagggtagctgggaccaggaggcactgtccatagatgatgctgataataatacttatgaacatttattgaacatttactttgttcccaacactgtgccaaggctttacctagattagcttgtgtgatcctgtaaagtaattcccctttacgggggggaaactgaggctcagtgagatgaaatcacttgcctgaggtccagtagttggcccttggcaaagtagggatcgaagcctaggtctgtctcacttgagcctaactcctaaccatggtgcttcccgaagacccttggtgctgagttcctaagggacaaacaaactggggtcttgtcaggacttttttttttttttttttgcgatggagtctcgctctgtcgcccaggctggagtacagtggcacgatctcaactcactgcagcctccgcctcccgggttcaagcagttctcctgccccagcctcccaagtagctgggattacaggtgccagccaccacacctggctaattttttgtatttttagtagagacggggttttgccatgttggccaggctggtctcgaactcctggcctcaggtgatccgcctgcctcggcctcccaaaagtgctgggattacaggcataagccaccatacccggccgtcaagacctcttctaagtacacttagcagcttacacagctgcattcacattcgactgcaccttgagatggcaagtaaaatcattttgtccccatttcatagatgaagaaactgaggttcagggaggtgaacagtcccagcattcttctgggaccctaggtctccagctgacctccagacttggggtgggagggggcggctctccctgtccctgagcacttacagagtaaaagagaggaaggccagttttctaattcaaccttaatattgcaccccctcccctatctgcccttctcagccactcctgccagagtttgtctgagaagcccaagccccaggctctgctgggactgtggcctcagccctcaaaatagccctgcctgtgagtgaacatgctgtccctgggctgcaagagcctcgagggaggctgggctcgcatctggatggatctgccccaacctggacctgggggtggagggggcaggggacagagctcccagatggtcagctgtttctctaagtgggctgagaaagctgcctgttcctccatcatctagccaggctcagggtgatgagcatttacagtgggatttcagacactatcatgtcctggaaacaggacagattgttggacaacatagatttctagcccagctcttttacaactggctgggtgcctctgggccagtcattcagtggctggaggcctcaaaagagggggtgctttaacatctgtgacctctctggcttacggtgaggatgaaacccatgtgtccagtctgaaaatatcaatgagaagagctggtagagacagcccctgtaaggactgatggtttcagggactgccgccattagcccatcttccaatggctgccacttaattcaggcggccttgattggtgcctgctccaagtcaggtcctgggccaagagagcccaggctggaaatgggaccacagagtgaagaactccttttccctaccactccctgagatcccagtccagatggggagacaaaggagagaccctgccttgtccttctgagattcatccccatggaatgtccccagaaaggcaggaagtgctaggcaatttcaggaacagagaaacctttccagggagacaagacctgagagcacattcctgggaaaggggacgccctgagggaagtcaaggaggccagaaaccgagtccccttttaaaggtggacgagtgagccgctaggcatgcagtcaggcagggggaggaccactgtggggtgtgcttgttttgcccgtgtaaaatattatgctttaaaatatattggattttttttaagcaacagatcatatgggaaagaagtagaaaaggtaaaaaagtatagcgtgaatacaaaaattagccgggtgtggcggtgggcccctgtagtccccgctactcgggaggatgaggcaggagaatcacttgaacccgggaggcagaggttgcagtgagctgagattgtgccactgcattccagcctggcaacagagcaagactccatctcaaaaaacagtatagcatgagagagcctccctcccatcctctctccatcatcaaattcctctctgaagaaacccactcacaatttcccgtgtgtgcttctccccagcaatcacagcacacaggcgcattcagcctgccccttgcttttgtccctaaacattgtcatttggcagcagtctgtatcagtccagaaagggtttcttctgctttctgttgcagagaacttgatcgtgtggctgaactgtgatttattgatcaggatccctcttgagggatacagaggttagttccagtgttcacactggcctaatcgaacctctttatactctttctccccctctgcagggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataaaagacgtcgttctgagctgaggagagtcccgtggacatcggaggtcagaggtgggccctcccctggacctagagagaggcacagatgttctgggggctgccctgagccctggaagggtgggggtggggcgggggaaggcaggcagagccccctctccgggcgccataaccaaactttcctcagtctgctgtttatcagatgttcttaacaactgttaggtgtctgatatggttggtaaagaaatcttaattttacttatttttgaataaggcctgtgttcatttcattcacatggttcaaaactcagaaggtaccagagggtatgtgttgaaaagtctccgtgcccctgtcctccagccaccagctctcctctctgcaagcagcctagggcaccagtttcctgtgatgtcccattcactatgaatgatcaggcaaatacacaaatgacagcacatcgtacacacttttggctccttctttttttccttaatctagcttggtatcatcccaagtcagtacctaaagggtatttcatttcttcctgagctgcttattattccattttgtgaacatgccatcctttaacccatccctctttgatgcgatcaccaacaagccatgtggttttccacaagtgcaaatgagtgcatgctaaaggggaatattcttacccctgtgttagctgaaatgctttagaagaccgatgacacccagaggcacgtggcagggtgacaccctgaggtccgtccacctttgaagcccagagcagctccttccttgccctggagatgccccaagtggaaagccagcacctgttaccccaattacactcccaggagccctgggaggtgagagctggtgtcttccccactgcagacccagcagagacagcgatgcgtcagctgatcagtgcagctaggagttcttggctctcgggctggggctgtgtccctgtgaggtcaggatcagagaagctcgagaggcccgagggtgggagagccagggaaaggccagggcagccaggcagccaccctctcctcagcaaggtacattcatatgcctatttcaacagtttatttatttaacaaacacttttatttttatttttttagagacagggtctcactatgttgcccaggctggtctcaaactcctgagctcaagtgatctatttcatgtttactgactgcactctggccccagagtccacgttcgtatcccctctgttctgcctctaccccactcccctgcgtttgaccatctgagcctgaattgtggctccgattttgcaaattgacaaacagattgtcaataccctctgtgtggcaggcactgtgccagatgccacaggaatgagcccgaccaacctggtcttcctcacagatgaaaaccgaggcccagggagatcaagggagttgtggaattgccagtccctaggctggagcaggccatgaaattaccatgcttaattcctttggtgtaagaagtagaggaaggagggccccagggggccggggtcccccacccaggagagctttccaagcaccctctacctcacttccccgctgtttcaggaacactggtcgtgcttatcctgtgtcccagcgtggctgtgcttccccctttgggagctgattaggaaagcacattgctccccctgcgcctaccctcccaggtacagccagcctctggcaaagccacaggaaaaggactgtggccttgtcaatggcaggaagcctgggagtgggggcagagcagacacttgggtgctctggctggaggcccactccgccaccagatttgctgggtgaccccagagatgttgcttgacccctctgggcctccctggctcagtctctaactagtaagagcagctagaacagaaagataagtatttgttttgctttgtgagatagtttttaatagaccctgtatgcactggtaagtaatccaagttgtatcaaatggtatgcagtgaaaagtacagacctcctcaggccc

SEQ ID NO: 16475 - DNA, 10972 bp, Human; identical to SEQ ID NO: 12236

SEQ ID NO: 16476 - DNA, 141560 bp, Human
  misc_feature (1)...(141560): n = A,T,C or G
gtatgaaatggaaaataaagttacttcggagtcaaagagaccttttaaacacttctcaatataaaaaataatatttttaaatattagaatattaatattggaatagaagcattttaattctattgtgatctggggcaagatatttaggcctctctaagttatagtttccttgtcttcctattcatgctaagggatggtgatttttttttcagtgactatcccttagcagtataataagaatgatataaaaaggtcaataatatgacccaataaaaaccacgtaataatataatatgattctgggtccatacttggtgttcatgacatactcctcccaggtttttttaaatgtcaacttccaagttctactcactttgtgtcctcacacctaaaaaagcacctggcatagtgtggatgctaacacatcggtatcgaaggggtgagggagtgagtggagaaatgctgcaattctaaagcaatgctccagctgatccgcgagccctaggaacagccccagcttttgcaagtcctctgagtgaccttgtgaaacttccataacctctccaggcctttgctttcctagtctgcgaaatgggacgggttttcattacacatttgcatttcattgcaaatgtgtgactcggcagcccaccggccccggcggggttcatctttcttctcaagagcgctggccccggcttccaacctgggctctggcgaggccgaaggtgagcgattgcgtcatcatgcctctgggcagctgagggagaagccctccagggacattcagagactgggaccagagtttctgagaggccctgggcacaaggtcagggcaggaggtccaggcagctgaggtctgagcgccaccctcactgccctttcttagtctcgctgcctcccgctgccgctgagcagcagggtagtgaagggcagactcccaggggccgaccctggggcggggctgctcggctccgcggaacccaccgtccgcccccgtccggccgccagcctcctgccctccgcgagcctcctgggccgggttcccggagcccgggcgcgcaggccctggcaccagggggattctgctccctctgccttatgttctttctgaaagggggtggtgcacattttggccagggccacgtgcagagcactttgctgcaaagcatctcgatagacctctttccacggggctgtgggtccccttcccctgggtgctggctggcttagctctgctcgggacctgagggagcgctgctgcaaataccgacagtagaaagcgagcgaacgcgaaaggccccaggaaagccaggccaaggggggtagccgggtgccaaagcaggcagtcggtggggagagccctggtcggccggccgctggctgccttcgcacccacttccgcgccccgccgtcggcctggtcagtctggtggctttacactaacagaaccagacggggagggagaggagaggcgagaagagcgcagaggacagaggggagagggcatgaggagacgaggagggagaggcaagaatgcgaacaaggagacctagagaggaagagatggaagagagaaacgccagatttgtgagagacgtggaagcagagagaaacgagagtaaaaaagaagcgagagagaagtggagagaaggaccaagtgagagcagagctctaggaacggacaaggcctcgtccatgggctctcagccgaggtgtcaccaatgcctcctgcaaagaatcaatcctacgcccggcgcctctcaacccacccgcctctgcacggccccaggtctcccccggccctccctgcccggccagctcacgcttctccccgaccggcccccaccgcaaaccccaaacgccgcgcgggagggagggagggaaggagggaacagcgagagagagagggaggggctgcggtaggaggcaaccatgtggttccagctgaattttttttttccctctctctttcttcactcctttttctttccaaacagggaaaagtgttccacgaagcggtagcgcctttccgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcagctgagcggggaagcgcccgcgtccggggatcgggatgtccctcctccttctcctcttgctaggtgagtgcctctgggagggcgggagtttggatggccgtgggcaaacgcagccctgcgtccgggaaagacgccggttctgaccgggtgtccctgcagcccctggagtcagccggcttttcagtccctgcctcctggccacggaggagcacatctggcaaccgagggccgcccagtcggccatcgagattgtctcgcacatctgggcccttgaacaggcttggggaaccgtttgatgtgcagggtcctctttagggcggtgtttagtttctggtgtatctgggaaaagtggagaattggtggagggaaggtttatccaggaatttttgtgccaggttcctgagggtgggggttttttgttgttgtttcaaacaggcgcctccgaggctcagattagaaacagatgtgttaaagggtgagcagagtgggggataggcagggttggagaggaaaggggagagggaaaaagggcagggcccaaggagcaccaggaagatgcaaatgccccaagtcacacagggaaggaaggaaaaggggaaaggggaagggttgggaaggagagagaaaaagaggagaacaggaatgtaaaacagaagagcaaggctgggggagtccgagcacagagagtgaagaagacttggaaaaaacgcagcagaggaaccagaacagagggaaatagagcaagcaccactttttcctgaaacaggctccagagcaaagggaagagtcctcctgagcgtcccttcctggggtcccccaggcaggactcttggggcctcagaggccctgaggcagaggcaggtttgcaggagaggacatcagggatgtgggtggtaggagcccaccggagtgactggaaatgtctgaggagccagggcaggaaaggcagtcagggagagccaagggcacgtcactatgcaccctgaagcatgggatccactgcagacaggccccacagttagctggagatcagaaaatcaaagagccagccagtggtcaagagtgagcactaccctgaacaccaggccacgggagagctggtcctggttttgaactgactagctgggtggcctcagacaacttactccttatccagggcttccacgtctttagctctggaaagagaatactagatggttcctaagtcccttctagcctacaacaccagaggtttgaaggaggctggtgtctagaagaaccaccaaatcctgaaatacgtggttagagttctctgtcttttttgaaactttacaaaccaattatactgtatgcatacccatcttggccagcctcaggctgataatcacttaagttagagaaatgaaagaggtgggctaagccaaactattgctcaagtaaggcaggtggggaggggttattttctaaactcttttagacttaaccaaatactgcaatactgttcctgtgcacatctggcgcagctggatggcaccttgattccctttactggactctaccactaggttaccaatcaccagatatttagtagaatgaaacttcagggctctcttattaaaaacagctaatagtccttgttatatgaacactttatatgtactatcttggtaattcgtttgttcttcacaacaagcctattggctgcccagccatccttgttggctaccctcattttacagatgaagaaaccaagctgtaaaaaggccaggtaacttgctcaaggccacacactcataattaggggagacggaatttgagcgcaggctgcctgcttccagagaaagcttgctaaagcgcattgctttacagcctcctgtggctgcagagattctcaaagcgcttaccctctgccacacctggctggctcttcgatctcaccatcctcttcatggaatgtaagatgtcagcgtgacctataggagagaggtctgggaaagggaaaaaaaatttgcactttttgagcacctgtccttatttaagaaatggtttggagccatggaatgctcggacactgttcagcaaaggcagaaagaaaacacagcaagttgtctgaatcctgaaatcatcatactggtcctttaaaggggcagttccagggctgcttctgatcctggctggcatggtttttggcttctctttttctaaagattgcacagtatcaaacaggggctgggagggtggagagtgttcatcgtctgaactgtgggacagttgactccatgtttcctggacctgccaatgagtgaggtcaaataacccacctctctgatgtgaatgaataagaagtgctctgagccccatggagaagagagaaggagctccagctcagcccctcttctgacccactatcctgcctcactcccgtaacgttccggccctcattgtgccaccttaacttctctcctggatgactatagtagctgccacgttcctgtcctgcctgtcctctctcctccatcctgcacactgctacccgagtaaccctgtgaggccgctggtagaatgcacgaagctggaacttaagagtctggcaacctctctggttcttattctgactcccttgtctgtacaatgggcataggggtaggggaatgttcaattcaaaatttctataattctatggtttttctcccttcttccaaaaacctttagtagtctcattgcttttagtgttgagtataaacacttcattctgacatcaaagactttacataatgtcattcacagctcttcctctactcacccccagatactcggtagggaacctgaattacttcatgcgcccaaaacatgtcccatgcttctttctaattctatgcttttgtttatgataatccccccaccaaaactgcctccttatttcctgccactgcagatcaaaatcatgttcattccccaagtctcacctcaaatgccacttcctccatacacctgtccatggtttcaccagctgaatatactttttttcttttgagtagtctatttgacctttgaatcccaatagccttcctcttatgctactttgtattatggtgttccaaatgcttatctaacaccccattagaatggaagctccatgaaggcagggacagtgtctcattcacctgtgaaccatgttcagtaccttgcataaacacttgtgaactatttgttaagagataattggatttttgaagtatttgaaatctttaaggtcaagagaggtgaaaaatttggaagatcactaacctttgactgcgggataacccaatagtgaggagcccagttttaattcagcttgctttgagcttccttgtctattaatgcaaataggaccagtcctatttttaaaaaattcacaaagaacattacagggatagggaccagataatatatttgtcatacaaatttattttgtatatcgtgtgtgctagtaccagattaaaaatagacttacctgttgaaacttctgccagcacggggaaggagcctggtttcgcagaaagtgagtttgaagaaggcatgaatgcatagtccattggtctgtaagataacgacaggtctcagtaggattccatgtcctacccttatcttcccactttaatggtgatggtcataataacgatatattccctgtaggcttatatctagtcatatcctatttttgtcttgtgcttatctgggcagggtacacatgagtattatttcatgaatgcatctagtgatgatggatattttttaaaggtagagtcaaagattgccagaactggaggaaaactaagagactgtttaaatcaatcgttcttaaaattttgagtcccagaccctttgtagaatctgatgaaaatcacaaaaccaacttcttagaaaaagacatgtatacatcaaatttgccaataatatttaagacctcattgagacctcctgatacttttccttggaacccaagttaatctttcatctaaatctatgccttcttttaagatgaagaagaaaccaaagttcagagaggtttggctaaggttatacagctagctcagtagaagggccaagactggaacccgaattccatgatcctattacacatttttgaaatagaaaaatgtctctccttccttttcagctcatgtacttaagcttcaagatcacagctgctcttgtgatgcttcagttaagtgagctaaatgctgaataattggcattggtttttattatatgagaaattgcctgaaaaatcaggcaggcgtcataacatttcaattttgccaacgtaactggaagtcctaggaactctgcagtgtcatgtatgtctggtgtattcaggagaaaggaattaatactcaaagtcccaaagatgtgggtgtatgtgtacaaggaacaggactggaaatcaatagctttagctccttaatcatttcttctgggtgagcctaggaaaatcataccactctgagccttagttttctcctttgtaaaatgaaaatatgagattaaggttatctctaagtttccttataccagtaacattctctgaattttttttaattctgagaattttctggctggtccagatgtggttgtcatcaggaacagatgggtgttaccctgcttattgattttttcaggcactgttcactcatggcaattggtagcacatgatgataaaccaagaagggtcaacgaactaattggaagaaaacagtagtaatctccatcctggaactgccctgcggcactgttagccatggagcaccattcaggttcagggtgatggcccgatccccccacccaggaagttcagtaactgaaatactcaccaaaaggacctcatcttaagcagggttacctacagaacagcctcaagcatggacacctaggatagacttcagtgcagaggggctacggtataaaactatttgtaagcaggagctttgttttttttttttttttttttgagacagagtcttgttctgtcacctaggctagagtgcagtggcacagtctccactcactgcaacccctgccttccgagttcaagcgattctcctgcctcagcctcctgagtagctgggattacaggcacccaccatcacgcccagctaattttttgtatttttaatagagatggggtttcaccatgtttgccaggctggtctcaaactcctgaccccaagtgatcatcggcctcccaatgggctgggattacaggcattagccaccgtgcctggccattttcttctacttttaaaattaaggcaaaatgtgcatataaagcatacctagtaaatgtacagcttaatggattccttgcctagatttgaacttgtggttggattttgaaatatgagatgtatatattaccagcccacttgtagtactctgacaggggattatatgggcaggaatattatgacagtataattaatttctaacatttgtacaaggtttagtagtttacgaagtatattaacataccttatctcacctcaaatcactctttgagagtaagtattattattactccatttcacagatacataaatggaggctcagagaagtaaagtgagcttctttctctagaatacactgcgagtaaacagctgagctaggacaccaacccaggactttggattccaaaaaccatgtgttttccacttaccaggagacacatggttattctgaaatcaaggctctgtgttactgagaagagtggatcaggctgaagcagaggcttcatctttaaaccccaaagtggaaagttctgctaaacatttattacccatccccttcccccactccattccaatggttaagaaatgtgtttggatgactattgtttataactgagaactacttctacacacatcatgtatggattactagtgttccttctaatacgtcagaagacccttctagtgtccaagaggtcagatgctttggggtcagatgcatgagcttcccttgctgacactatcctgagactgtggatgatgaggtttatggattgggtatgactcacctcatatgttgctttttctgcttaaagtcctgttttcagcacctctgacttacttgtttcctaaagaaaaaatgcaaaccatagcttcctccccttcaagttctggttatctggatgtctggatactggaaaaataaaagtttatttcctttggcaccacacagaccaaaatgggggagaaagccgagatgaaacctttattttgttagcagcagtcggttgggtcactgtgtgtggagcctcagccaaagcctggcggtgagaagactgaatgctcctttgtttcaacagcaggcaggggagaaagctgtttcctttgtgcccatactgagaagagaaaatgggcaactatcttcagaatagtccctcagtgggtgtggaatattgggggtttttgtaaagagcggcagcaagggggatgtggaaagttcaggtcacgaacggtggcagaggagaagaaaggagaggaggaggaggaggaagaagaggaggaagaggaggaggaagaggaggaggaagaggaggaggaaggcacagagactgtaggggatgaaaaagccaagctaagctgacctcctggtgtttacagagcagcctctgagcgcgttctatttcacggatggcgggagcagctcagtgatgtcccttttaagatcttctttagggcttacatccaagctgtaacatttcctacttcaggcacacgctgtctcacacaaaacaattacagagcgggtgcgcctgctagagttcgggcccctagctgggctctgagaccccgatcgtacaaaaggcaccctttctaccttctaagaattcagctcagtgggagagacgtattcacgaacaaggaatgtcagatacatgaggaggctattttggaggaaagtaccaaggattctagcagtcccaaagaggaagctgcttcattatgtgctggctgctgtgtatttcttctcatgcaggtcttcggggactgtgtctgatattcctgtgcccctcacagcacttgctcattattgagatcacgctaaataagcagttggtgggttgatggatcacccatcagcgtcagaaatgagtagaattaatcagtgcatccttggcattcagccaggagcttcctggagagattgagactcccaatgtccttgcctattgaaggttatggtctcattcttcatcacaacctgccagtgacacagttacctctaagtcctcatctctcatgggatgttttctaaaaaaaagaaagaaaaaaaatgtatctgtgaatttggatctcttaattaagaatggccatctactcaccccaggtttgtatcttattactccacagggaaaatgaataggatcaagccaaagaggaatttttctgttccaggagaaattcactgtactaagcagagactcagccccagtgtagtcatacttcttttcttggtaggggaggaaagagggaaaaatgaaatccctgagagagaaattgctttgtgacttcattgtttaaatataggcttgggtttgtggggatcgttcagacttagagcaataagccttctaacccaacctctgtcacttctcattacttccaatgacagttccaattatttccaatcactcttcaagggaacagcagggaaggcgcacacggcttccatgtagaccagccatggagcaaccgctgtaagaattggcccctgggctccccagaccctgctggaagccaggcttgtctacttgaaaattgtgtgaccttgggcaagttacttcacctccccaaccttaggtttctcatcagccactgcatctagtaacaatgtcatagaggtttttttgtgaaaattacatgaggtgatgcgtaagagttttaacgctctgcttggtacgtaataaatagtaaatgaatgtctgttgttattatcatgagtttcctttctgggggagggtcagttcatgggtatctggagggtctgcttgaagtcagcgaccaccaggccatcagcaccagcatttggggctttggccactgtggttcctcaccctataggtgagtccctagtgtcctttagggaatattgccctgctccaggtccacaacaggctcacagattctggccaggctctggctcatgcctgtaatcctagcactttgggaggccgaggcgggtggatcactggaggtcaggagttcaaaaccagcctggccaacatggcgaaaccctgtctctactaaaaatataaaaatgagcctggtgtggtgacgcacgcctgtaatcccagctactcgggagcttgaggcaggagaatcattcaaacctgggaggcggagattgcagcagtgagttgagatcacgccactgcattccagcctctgggtgacagagtgagacaccatctcaaaaaaaaaaaaaagctcacaaattgtgccccaactctccacagctactctgggagagcaactttttgtgttatttagccctaggcaagaggtgcccttctacgctgcttggcatatcacagctgtgagtcttcttttcctgggttctaccctcttgactcatgcccccgagtgcctgtgccaacttaggctgccccagcctgggcttataactggttggttcgtttctgctttcagtgttaagtaatgtttaactgagcaagtactatggactaggcattgtgctagggacttccagacaagtaatttcttatattcttaaacaacctgtgagattggtattattgtccctatattacaggatacaaaagtgagacataagaggtaaggtattccatcctaggctgtacagcttgaatagagcaaaacagcagacgcgagcagagtttgccctcttcagcactgatctgggaagtaggcatgacgaggcagccaggtcacataggtacagtgacacacagacagacaggaggccactgggaggcctggcctgtgggagctgcaagttcctcacccccagtttccaggcagtcatttgtcctgatcaaaattaaactccaatgagccctacacccaaatacaagatgtgttgaattatgtttgctttttaaataggaggaaaggaaaacctcaaggtgagaagaaaaatctgtttgtttttttcttcccactgacctgaacagcaaagtgcgattttttctcctcattaaagagggctaaactggtgtcccagattcctgcgagcctagaattcccactcagaatgaagtcctgggccaggcaggcagagtccgggttttcagcggaggcctggtacccatctgccttcccctgggggagctctacccgactccactcccaccaatagggaagggcagccggctcccgccttgcctccgctccatccccagggaggggaggccggaaacgaggccacctctccgcagcctccttctctgctccactgcctctcacaccctgttcccggagtcctgcagcttcccaagccctgaggaatgcaggtgaccgtccccacatgctgctgcctcagcctgaccttcctcctgctctctctctctctctctctcccctggcgccaaattggcctgccctcagatctggcacttaacaagacagacagacagagaacaaagaccagcgtgaactccgtcaagctcatctttcatgtattgccccttttcctctctccctccctccccaactctcccaaattctcactgcacaacctctgcgaggcacccactcctgaaagcctttgctctcctcagcctaagctaatagtggtgctttgtcccctggtcccccaccctgttcttgaagacctccacgctgttaccttccatcccctgtgaccagccacctcttcaccacttctaccctgaccagctccctcccatccgccgcctcatctacagaggctttcctgactctccagacacagagctgtgctcgcccctctcagccccgagagcaccttgtccacacctttagaatagtttgtggcatgttatggtacagtttggggttctctgtctttcctggtgactgtgagcagggaacagtgtcgtattgtcaggaataccaagcccggtgagcggctggcacatgttagattcctgccaaatgaatgaatgagggaacaaacaaatgtatgaatgcatgtaaaatcccgttccaggagaaggttggctgattcacttttcacttagtaatttttaggacatgtggcctctcctttcagctttagtttgaactttagccttattagtggtcaaagccctcccagcaatgttgactgactccttctctggcccttttaggtcctctgcagagaatggcaagagtcgtgtatgggctctgagccaattcaggagctccttccgtggtgcatggagtttaaggccctcttcctctcctttcctcttttgcttccgcctcgccaggttcaccctgttcatcactaaccttgcctgggtatcactgaggcagcatgagcagaagaaacacaagtcagctaatgagcacagaaaattttggtgggattttaaaaatattatttcggctgggcacggtggctcatgcttgtaattcctgcatttgggaggccgaggcggcaggatcccctgaggtcagggagttcgagaccagcctggccaacatggtgaaaccccatctctactaaaaatacaaaaattagcctggcgtggtggcacgtgcctgtagtcccagctactcaggaggctgaggcagaataatcacttgaacccgggaggcagaggttgcagtgagctgagatcacaccactgcactccagcctgggcgacaaagcgaaattaatcaaaaaaagtaataattaattaattaaaatatgatttctaggctaagtgcttatccctatgttagcacatttaatcttcaagataacattatgagacagatgacagccttcattttgcagatgaggatcagagaggttaagaaatttttctggtgttaccacagccagttagtcaaatcaaaactcgaagccaggtcttctggctcctgaatcattactcatcctactgccccacatgaccaggagccccattatgagtggcagccacaccccaccgcactcagcagggctctgtgctggcttatggcttctgtgtttcatccccaccccagcacatcgggtgggcagtcagtgagctttccctgaaagatggttgccaggtaaggctgtcttctctgggaagatttgagatttgagatttgtttcacgcatacagtgaccaagcatcctgtttgcccatgtcctgtgggttcctcaggacatggaatgcaggattctcagtgctaaaactgggacagtcccaagaaagccatttaattggtcaccctagtagtagagtatcttgctactcaaagagtgaccctcaggccaggtgcagtggctcacacttgtaattccagcactttgggaggccgaggtaggtgaatcacttgaggtcaggagttcgagaccagtctggccaacatagtgaaaccctgtctttactaaaaatacaaaaattagccaggcatgatggtgggtgcctgtaatcccagctactcaggaggctgaggcaggaaaatcacttgaacccgggagatggaggttgcagtgagccgagatcccgccactgcactctagcctgggcaacagagcaagactctgtcaaacaaacaaacaacagcaaaaaaagtgaccctcagactagcagcagtggtttcaccagggagcttgttggaaatgcagaatctcagacccactaactccagacccactgaaccagaatgcacattttagcaagatccccatggaaggggaaaaacattatagaagagcaagtactgaaggcacatttgacagaagttatggaaatgaagattcatacctgaatcatctgacctgagagaggtgacatcctcacttttctaagcttgcattttatatgttatggctttgctatatacctcaggtgatgcacattggcacaaaagacttaggtttataaactgaggaagaaaggagttaagggtccacattcagtccaaatggaatgaaaggctggagggtgcgtgagtgctgggtgagggtgtgtgggcattgagttatttcacggttaagcctttcttgcgtctttgaaatgatgatgttcttacgaaggccttggagttttctggattcactggcctacacccttttgccgaggtcgggctggagtgtcacagtggacagcaaataaaccagactgtgtgtgaggacagcagtagcctgtgttcttgggcctgaggattcagaaagggaaataaacgcccagagggtaaagcatataataggaaccacgcttggtgaagagtagaccctcagtagttataattgaagaaataattaggccaccaaagaggtattccaagactacatgttttcctgtttgatgcctggctctgaatctaggtctcattttcaccctgtccaaggagagatcagaagggaaaatttgtaggtcccttccctgctgcaagagtctaacccagatttggaaatgagttattcatggttccccagcctgtcctaccctgtggtgatgacctcgctcggatggaaacagaagtgatggaatctgtgctccaggtgagaaagtggttggccagctcttcgcaggatgcttcaccagcttctctagggtcttggcttatctcaaagcaaacttgggtcagagcagttgttcggtcttttaaatcggtgctgtgtgtcatcctgggtcaaagtcactgtaaaagtcttttaaatgggtgctgagtgtcatcttttgttaatgttttgctctaaaaccagactgtcagatgttaaaatagcaggcaccaagcaaggtaggaaaagacatttgtatttctaggattgcggagcagccttgaactaaaagaagcataacccacatttgtcgactttctctctattccaagtcacatgcccagtagggagcccaaaataagggcagcccaggggagggaatgacaggcaggcctggaaatgaatgtgttcatccgttcagttcgagctgtttcagacaaagctgatttctgctgtgatattaatcccacccagacaacaagaaatcgaactgtcacttttctcagaatggggtgaaatgtttctgacctaggtttggttttataacaatttcttctgtgtgtattgttttccctgggatctcaaagggctagctgggggtggatcttagaggaaaacacagatttcacttacagggcaactcccttgcctggtactgtgagtggagatagtgccgtacaagacccgagagcctggtcggggagcagattgacaaaggagagaaactggggaacaaagtaggacggaatggaattcattgccaaaatgtttggtagagataataagtgaaacaaaagttttgggaaaagatagtaagggagatggaagaacttaacttcagctcacagtggagcaagaatatctaccatgaggcgaaagcaatcgcttgagggcattgcattggggtgagccagggcaggagctgcagagagcctgggacctaggaagagagcaggagaaaagacatgtggggatgaggtggagacagttgtgaaattgttcagtctcactctggaaagagaacacattcatagtttataggccaatttggagaccttctcaggctgtgtggcggtgttgggaagtgactgagcaactcacctctgggtctcagttttcaccctgctggaagatagactggaagggagaaggtgtaggttccctctctgctatagaggtcacgctgtgtggtattcatttgtggggagccatagactggattgcgcattgttctttcccctgcaggcagcatgagctgatgctcttgacactgaggttggaggcagagaccctctcacatgcacacaccccgggcccccagtctgcttgctgctgctggctctgcccccagtgctttcctatcactaagaatagagaccttctctccaggcatccagcttcccacacagtctgactctgcccaagcctctgcccttgaagatgccaaagtggtttctgtctcagagtctttgcgcttgtttttcccttgcccaggaatgctctttccccagatggctgcaaggctggctccttgcctttcaggtttcagtgcaaacaccacctcagtgagcgctttcctgaaaccctctctcacccctgccccagctaaccagggactctgcctagtcactatcactttgccttgttatattttctccctaacacttatcagtgtcttttttttttttttttactcctatgcatttctgtttttgtctgttcaggctgcttaacaaattactgtagactgggtgacttataaacaacagaaatgtattcctcacagttctggaggttgggaagtccaagagcaaggcacaacaggttaggtgtctggtgagggcctgcttcctcgttcatagagagccacgtggtggaaggggtaagggagctctctggggcttcgtttctaaggctctgctctcatgacctaatcagtccccaaggccccacctccaaataccagcaccttgagggttaggatttcaacatatgagctttgtgggaaacacacacattagaccgaatgtgccaatgtacttgtttactgcctgtctctgcaatagccaagacttcgtctatatcatttacttcatttacttctgggtccttggtgcttaggacagtgcctgacacagagatgctcatgtactcactgaaggtgacacagctggtaagcaatgaagcctgaatttgaatccaggcagtctgactttagagctggctccataagttaatgttattcaagccatctaagcccctgcttctcagttttagaatttacctggggatcttgtttaaaaatgcaagttctgatttaagtctagggtgaggcctaggactctgaatttccaataagttcctagccagtgttactggtccatggaaaatgcctctcaggaagaaagggagggagggaaggagagaaacagaggctcagagaagttagggtggactttccttaaactataaagctagttggtggcagagttgggactccagccaaggggcctggctcccagcccaaagctctttgaacccccggcaagcccaaggattttaaggcatacttacatcttgtattggtaattgcaaagggggcccaggacactggcctctgccccctgcggatcactggtacttggttgccactggcccttcccactacagggcacaacagttcttgttttgagagacaagagtggtttccccagaatttccaaaccccctcctagcacaaacacaggtatataatctccactctctctgcctcatgaacaagacccctctagcggctctagggtttgccattacagtatttgttataatgagtgtcagctcatttgtgtggactccacccttccccaggcttccttgttcctttctttctgacacaagagatgagagctagacctgttggaaacttttacaaatctctctatcccgcctccacccaatagaaatccctttctgaaagatgatcatgcatcctccatttgagcaaacaacaggaagctcaatacttgcaaagccctttccactctcaggcagctccttccatgagaaaggactttctcctctgaactggagtttcccttcctggcatcttccaccaaccgaggtaacaaatattagtaatggccataactgccttacaagtaaagggtcctccaatttataaagcgatgttttaaaaacatttatcaggctgggtgtagtggctcatgtttgctaatcccagcactttgggaggctgaggcaggaggattgcttgaggccaggagttggagaccagcctgagcaacatagggagacacaatccctaaaaaaacactttttaaatttatctgtaacagacactgtgctagacgttttcatatatgtgaacctcatgtaatacaaccacaccctgaagtacaaagcaccaatcctcattctaccaatacgtaaactgaggctcagaggatttaaatgacttgcccaaagatagaggccctgtaagcttcagaggccatgtcctaagacaccacagccacacatcctcctgctactcaaaaaccctttaaatagagagagtcctttcatttgcatctcccatcctgctcttctcttttacaaatgtaacactcctatccctttaaccttcctttctagttgtcacaataatgctaaccatcatgaatggaggtcatgttatgtcccaggcactcaatatgtagactaagttaatctccataacaaccatcaaataactccattttatagatgagcaaactgctgaaactcagagaagcaatttgtccaatggcactcaattagtgactgtcaaaaagctaggattcagcttgggtgtctttgcgaaaatgagaaaaatgctagagtgaaggaatggaatgaaggcaatgggaatccaagtgaggaatgatgcacacttggatattctcccatttaaaccatctttctggtgatggcacacttgacctctcctacagaatgacttagcacaaaaggaggctcttcaggggagtctaatctgggcagaggagtagagcctgagctatggaggccattgctctatggaggtcatttgacaccaattctaagtacactttttaaaaacaagatttggcccaggcaccatggctcatgcctgtaataccagcactttgggaggctgaggcgggtggatcacctgaggtcaggagttcgagaccagcctggccaacatggtgacacccatctctactaaaaatacaaaaaaaattagcccagcatagtggcacgtgcctgtaatcccagctcctctggaggccgaggtagaagtatcgcttgaacccgggaggcggaggttgcagtgagccgagatcgtgccactgcactccagactccagcctgggcaacagagtgagaccccgtgttaaaaataataaaataattaaataaaaataaataaaaacaagattttttgggatataattaacatacaatgaactgcacatatttaaactatataattggttgagtttcatatatgcccatgaaacatcaccacaatcaagatgttttaaacatgtgtcataaacccaaaaaggatggcatctcaaggctgggcacagtggctcatgcctgcaatctcagctatagtccagactgtatagaacctgtcatcctccctttgcttctggattcccatacaactttgtagtttgatgatttgttttgatcttgaggcccagaatccatgtttacagccctgtttggcttcttcagattcccatgaacccctcatgtgagttcaagaataaatttaccattaagtccttggggctgaaagatgacgtaaatgtaacccaaacgtgttggtcctccagctgagggttcctgattcagcaaggatgaagtgacccaccagagcctccaagaagatgctcaggagacaggaggcacagggccaatgtccactccccaccctcccatctgcttcctattgcctcatttttgcttcctaagaccgcacctcccaaatacacactgcatcaaaggagcaaaaacaccccaaagcagtgaggattttgagggaagggctctgaattcagacagaagcctgctctaggactgcctctaaatggcctaagtaccatctttaccctaagactgtctatattcccctccatcaaattaatctctgtctactctaagctctcatgaactttctgttatggcaacaatcacccgcacctgctacccttcaaaatgtgatgattcacacgtattctttcactttctagaccataagctctctgtaggcatggtgctgatctgattcttctttgcatcctctgtagtggctaacatgtggtactcagtgggtacttgttgaatggacaagtgaatgacccactttgtcctaaacctcaaggcaggacttagagctgagcatagcactacccttgtgtctgtcacaccacatgccacatataaagtattagtatatgacacccaaaatggtgattctctgtgtgtaatataaatagaaccagggagatgcatacactgtctccttcacatgcactgttaactccaagcaaaggtaaggcttggcctgacagattgtcactggtaaggctgcttctggggtcagatatagctcccacctccaacagccccagctggtgctaaggagccaggagagaacaggcattcaaagtgagagggaatagttaccagcatgggggtggaatctcagcaactagggtcccactggctcagtctcaaccttcaaaggaagcctgtggagtagtggtgcctgcgggccaccagcctaccatttcccttccagagatactcattccttgaacaaaacgcccaaatggttaagcttccttgggtcactcaaagaggaatctttatacatcaaagtgtgatttcaaatacagacatgcctaaatgagtgtttctcaattttttttttatttcaggaactagtgtaatttcaaaaataaacttgggcacaaaatcaggggctcacttttagaatattattgactatagttttaaaccaaaatacaaactaccatcctgctgttaaaattattcctaaaaagaagcagaatttcaaaaacaaagataaaaaggcagttggcaaccattcatggacagctctctgtttccaatagctaacacttagtgagtgctaaatgtacactagacactattctaagtattttaataacaccttattttatacacatgcagattacatcatctatattttttcttactcccctgtgaggcaatgaaaatgtcaaggaccagtggcctaagtttacactctagtgctagggaatggctagcatttggtaactaactaaaataagatttcttgaggcaactcacagctgcaggagtcaaaacttctatgaatcttcaagtttccacctgatgcaaaggccaggatgtgatctttcagagtgagctctttctatgcaggatctagatgacaaacatcttcctctcaagtttcttcaatatatggaacccattgagttgacacggagactcataagcttgcagcctttgtcaaccaatgcaatgcctcaaataaataataattgagccaaagctaaaatacttcaaactgtatttttgcataaaagataaaggaaaagcaagctgggcgtggtgactcacacctgtagtcccaactactcaggaggctgaggagggaggatctcttgagcccgtcagcctgggtgatatagtgagaccttgtgatattctttggctctgtgtcctcactcaaatctcatctcaatttgtaatccccacctgtcaagggagggacccgtaatccccacatgttgagggaggaaggtgactggatcatggggtggttccccccatgctgttctcatgatagtgagtgagttctcgtgagatctgttggtcttataagtgtttagaagttccttctttgctcttctctctcttgctgccttgtgaaggtgtctgcttccccttccaccgtgattattagtttcctgaggcctccccagctacgcagaactgtcaattaaacctttctttataaattacccagtctcagggaagttctttatagcagtgtgaaaatggactaatacaccccgtctcttaaaaaaaattttttttaataagtcaggcatggtggtgcaggcccacagtcccggctactagagagacagaggcaggaggatcacttgatctcaggagtttaaggctgcaccaaaccgtgattgcatcaccatactccagctggcgtgacagaacgagatcttgtctctaaaacaccaaagaaaagctaccacttttgcaatagagagcccctttcccctctttccttgcctctgcttccaaaatacaggcattaacattccactagtatgtttcacaatgagcacacaccagatggctttaatccagggaaggaatgctgggttgagtaacagggtgatgaattaaataacccttagataaccatttaaaaaatcctaagtgcttcctaatttctagattaaagaaaattcatggggccttaaaaaagagagaatataaaggacattaggttgccacctctagacagaagggcctttagaagatggatagaccagcaaggtcagccattgcaaaagtctccccagagaccagacacatcttccaaaggaggaaggaggcagcaagtgggcaagtgggaggctcttttatttattttttcagtgcttaacaaaacaactcaaggagacccaatgtcaggcctagatatgaaatattatattttgggagatagagctttagtgtccagatggaagagaagctggattcaggataggatgtcgcctagtccagatgatctttgcctatgccatcccttcccattaaccatcttgtttccctgaataagaaggaaggaaacaatcagaatttcctattatacatagtatgaaacagaacacttttaagctatttcctgttcccaaaagaactgatgtggagggagatatgaggtagcacagtgcagtagaaggagcatgtaattacgtgtaggaagagcttgctctgaaggacaatgtcttggcctctatgtaaggtggaaaggttaaggttaaacttaagaagtttaaatttctaagcctggaatttttattttttgttttattaaaaaaaattttttttgaaacagggtcccacctgttgcccaggctggaatgcagtagcgagatcacagctcactgctgcctcaacttcccagactcaggtggtcctcccacctcagcctcccaagtagctgggactacaggtatgcaccaccatgcccagctaattttttggatttcttgtagagatgagatttcaccatattgcccaggctggtctcgaactcctgagctcaagcgatccacccactttgatctcccaaactgttgagattacaggtctgatccacagcactcagcccaggcctggaatttttttttgatgtggtgaaggagtgcggcatcctggacagagctgttatttatcagctctgtgatcttaggcaagtcacttattcctgagcttcagtttcctcatctgcaaaacaaggacactaactcccattttacagaggaggatgaggctcttagaggttaagaaatgtggccaaagtcacaaactagtatataccttattgccaagcctgtgctcttttccttaatcaccccaaacctcaagatgagatcatatgcattaaaatattttgtaatgagccaggcactatgcagtcattcccttgtggttattacacgcagacttccatctggcatgtataaaaaggaatgtcggcccacatctacatgtgtccatgaatgcattcatgtaagactgtgtgttacaaatagaagtcactttgtggtctgactggcttgagaatacttttggaataacaggatagaacagggactctccaagaaaacccaggctatgtgctggctccagccataaaacagtctcatatcatgggaaattacacatgctgtcatatcagcactgcagctggcactggcttgttcccaacaggggatcttacctaccatcctgtcccagaaccgagctctttgtaagagattaaagcaaaccatatctgcttttactaataattgttctagagaagtctaggaaaagaggatgttaaccttgagagtgaagctctgggtttgtatctaagggtgcaaggtgtgacatctcatgcatcctgaaaaggtgtcatgcaaaatggtgacaaggaaaatactatggcccttatagaaacatccctctggaagtgctcatacattattagtggggtgcaaacagcacaaacctctttaaaaaacatttaaaagtcagcttcaggaattttaaaaccattcatagccttggcccaataattccattgttagaaatctatgctaaggacataataaaatacaatgtaaaaaaatgtttattggctggatgtggtggctcacacctgtaatcctagcactttgggaggccaaggcaggtggatcacttgagcccaagagtttgagaccagcctgggcaacacggctaaaacctgtctctacaaaataattaacaaaaaattagccaagtatagtggctcacgactatagtcccagctacatgggaggccgagatgggaggatcacctgagctcaagaggttgaggctgcagtgagccaaggtggtgccattgcactacagcctggatgactgagagaggccctgtctaaaaaaaagcaaataaataaacaataaaagtttattgcaacataaacactggcacaaattaacatctcaaaataagaaagtggctaagtaggctgggtgcggtggctcaagcctgtaatcccagcacttagggagatcgaggcaggtggatcacaaggtcaggagatcgagaccatcctggctaacatagtgaaacaccgtctctactaaaaacacaaaaaattagccaggcgtggtggtgggtgcctgtagtctcagctactcgggaggctgaggcaggagaatcacttgaccccaggaggcacctgggcaacagagcgagactccatctcaagaaaaataaaatagaaagaaagtggctaagtaaattaggattcatgaatctatataatcaaatataacactgctcgtaaaacagatgacaaagaaattttatgacttggataaatgctcataatataatgttgagtaaaaaaaaaatacagaattgtatatacagtatagtaaaatctctacagtgaatatgtataaatgcttagaaaacagcctggaaggaaatctgcactgaaatgttaagagccaacacagatgattgttattttcttcattatttttgtccttattatccaagttttgtataacaagtatgtataacttctatttttaaagtattactttaaacatctaaatgtctaagtgccactcgtccttaaatggctttctctcttgcttgaattagtacgacagtcttccaacaggccgagcgcggtggctcatgcctgcaatcccagcactttgggagaccgaggaaggcggatcgcttgaggccaggagttcgagaccagcctggccaacatggtgaaaccctgtctctactaaaaaacaaaaattggccggctgtgttggcacgcacctgttaatcccagctactcggaaggctgaggcaagggaattgcttgaacccaagaggtggaagtcgcagtgagctaagatcacaccactgcactccagcctgggtgacagagctagactccgtctcaaaaaaaaaaaaaagaaaagaaaagaaaagaaaaaaaaaaatcttagggaatagtctcccaaataccctcccttctccagtcccactccctttccagcctgctgtctccaaggttaccttctgtggactctaagggaccagctagcccttagcttaatgcagactttgtctacttggtgtctttaaactaggagaaccctttagactccctggtgtgacttgctgttccccacacaggccagaccctttcagatcttctggtcttcatgcttgttcttccctctacttagaatgacaccctttccccatttttctacctgggaaatgcttacttggcatttaaggccaagctcagaggttagcccctctgggaaaccttgcccgtcaaccccaagcagagctggttgctttttgctgtggtccccagagaccttgctcataccctggttttaacaaatatcataatatgttgtgataaatgtattcgaacgtctccccacataagatcatatgatcctaaggatgaagtcttgagactcattcgtcttggtttgcccagtgcctggcacagagtcctcgccccgtgatgaacagataaagaaactggttattaagctgtgaccaaggaggcagcagggagtattaatgccagcaaacagtctttataggatgacaacgagctgatcttcatgcctcacagcagcaagaaaaagcaggcttcggctgggcgtggtggctcacgcctgtaatcccagcacattgggaggccgagcggggtggatcacttgagctcagtagttcgagaccagcttggccaacatggtgaaaccccatctgtactaaaaataccaaaaattagccagatgtggtggcctgcgcgtatagtaccagctactccggaggcagaggcaggagaatcacttgatcctgggaggtggaggttgcagtgagccaagatcgtgccacctcactccagcttgggcaacagagtgagactccatttcaaaaaaaaaaaaaaagcaggtttcatgtgcaacacaacacttaagttagccaaaaggaggaacttccacagatcgttattgaggactaaactctgacctgttttcttctctttcccaaattactacctaagaggcctggggagtttgccctacaaaccatgaagtctcatcagagggatttgatttaaccctgtataatgtggcctgctttccaacctgactcgggcacatcacataacaaataaggaaggaaatgaaaatattttaaccccaaatatatttccttgccagatcttgaaattgccctacaaagtcatctcttggggttaaaagtctacattctatagagaatttccttttcctcttccagacccttttcctgatcaaagagagaatccactaaaagtctggcacctttttaagtctgataagaaatttacaatcaattgtctctgaagccgtacctggagactttatctgcataataagaaccttggtctttacaaccccttaactcagacacttctattgattgcaggtctttagataaactctttcaaccaactgccaatcagaaaaattttaaatctacctataacttggaggcaccgcccacaaaccccccaacaccggcttcctctgcttcgagttgtcccacctttctggaccaaaccaatgtacatcttaaatgtatcctaaaatgataaaaccaagctgtgcccctacaaccttgagcatatgttgtcagggtctcctgagagctgtgttatgggccatggtcactcttatttggttcagaatatgtttcttcaaatgttttacaaagtttgactctctttattgacactatgattgcaatggatgaaaaatggggtaagagggaagtcttaggagtggagtaaaaacctccctatctaagaggggttggacactgtccttcttggagactggaagatggacaagatgacctcagtcagacctaggctcagtgtcttgtccaaggaagcagggtggaagctttctcctggagcccacggtgattctgccgtaggcctgggcaggtttccatgtcagctgcgctaaaaaaacccagatctgcaatttgaacctgaagccttgcagacaaagaagactgtgtgaagagtaggcccagttacttgcaaacccagcagggctcttggctcctcaatgctcattagcatcttaagttcacataaatatatatgaggcttgtggattcctctgggaatcccagaggccctcagagccaaagcaaaatctcttcctctttgcacctcctcctggacatttggagcccagctgctttggggagcccagctgcctccagggattccccagcagggacctgacacctcattttcagagtgcaaaaatagacacttggtcttttgagggaccagagctttgttctgtccctccctctcttatggtggtctttcatattcatgggtccctgaagagcagggtttccccactaccctctcatatgccccaatcctgagtgaatgcttggatgccgcacgttctgtgcaaagccgggagtagatgctgcataacccagggagggcaggtgcaagagcgttgaggggaatgagacccagaacattttattcttaaaggactcctaatctaatgcaatatgcaaaatagagaaggaacagcagaaagtatacacttaagatgcagcatccacctcacataatcagcagcatttgaaccttgtaaattccacagagatgaggcaggacaagaaagagttgctgctggatccgattgcagaggacttcttggaggaggtggcttttgacaagaaaaggatgggttttggagggttctgactattggtcagggttagccgaccctgtcctacccggctcccaggggacactgcaaggcaattgagtggcaaggagaaaagcagccccaaggcttcctcattccccgtgaatatccctgcctcattcccaactaacttgcccaactatctcagttatttccaaatctggaaggaagagagggctttcagagaaaagccacaaaaagaagacagtggaatccagatgtagataggaagaaccagggggggcagctgccctagatgctgtctggtcaaagctggagtgccgtggccccagctctggggtgtaacgctgcagccctagccctgccctggccagatacatggccttccctctgcagcctgctttgtggaaaaagcataggtaccacttagtggacctggggtgggggtggggggacaggcagtgaataaacgtggaaaaggaaatgatggtggcagatgtttaaccccaatcatgcttttcagctcagattcttaggacaggatttccccggtcccaattcctttgttgaccatggcaggctggcatccctccgtcagtttaagaacaagctttcagcttctggaaatatcgttcatgctaagtagcctgtctgtctgtctgtctgtctgtctgtctttccttcctgggcttgataagagagactgcactctctccatttgcttctcaggaactcaacaatcctccctcatccacacaagcttccttctggacagggaaggaggcatgttcccaactagggaagagcttcccctttccttgagatcttcaacttgaagtcacagcaggtgagattggaagagtcctttgaggtcattaacttcaactcctactacaagcccagagtgaggaggtgacgtattcagagctggggctataatccagggtcattgctttgccagtagggtaagaggtagcatggaacggaggctgcagcacaatatctgcagccaaactggccaagcttcactaaaaagacatctgtctttcggcggggcgtggtggctcatgcctgtaatcccagcactttgggaggccaaggcaggcggatcacgaggtcaggagatcgagaccatcctggttaacacagtgaaaccccgtctctactaaaaatacaaaaaattagccaggcgtggtggtgggcgcctgtagtcccagctactcaggaggctgaggcaggagaatggtgtgaacccaggaggtggagcttgcagtgagccgagatcgtgccactgcgttccagccagggtgacagagtgaaactccgtctcaaaagaaagaaagaaagaaataaaagacatctgtctttctaactggatggtgtcaaggtttcaaaaccttgaacaagttgaacttctctgtatgtgtgtttcctcagcttcccaaaacaaaggacgataataatgatacctcttcatagagtgatctataagattattgatagtaatcgctatcactcatcaaatacctactatgtgccaagcactgcgctaaacactgtatgtgcccattaccccaaggtacctagtgccatgcctggcatgttaactgtaatgattgattactacactcagaacacaatgatccacattagccaaggatatctctcctttggtggcagatttttttttttagttttattttgtttctaattgacacgtaataattgtacatatttatggagtgcaatgagatgtttcgatgcatgtatatgatacgtaacgatcaaatccgggtgataagcattttcatcaccccaaacatgtatcatttccttgtggtgagaacattcaaaatcctctcttctaactattttgaaatatacaatacactgttgtcaaccatagtcaccctgccgtgcaacagaacctgaactatttcctcctattggcagcagacttctgagatggtggagctcttatggcccccagtttctgaaagtcaggaagacctaaaagcaagagagcagctcacattcaggctgcaccatgtcttgctgacctgttctcccacactggggaagggtcacgggccttctagtccaaacacggcctgctctcatcttgtttaaacaaggcccaagaggcaggcaggctgtctgtggttagggaggaagatacaaggctgtttgggattccacgcagcagactctgggctattgaagccgtcaggctgatacacaagctctgtcaggcttgcagctcttggcattctgactgcttcccccatgaccatttatagtcaatctctctgaagagggtgtagccctggggcttggcgaaagagataaggctggagaagaggcacctggatgtagggatgcccacagtaactactagaaacctcgctacatccaacactaccagtgccccagaacttgggctcgactgctcccccttcaggcctgcgaggtatgaagcctcacgatgcggaaaggaggttggaaggtggaatgaatggaaggattgtggctgcaaatcatgaatttttggtggcattttgatgtaggatgagtccatatggctttgtagtagagaattcagatcttatgcctgttgaattttaaaattttctcttgaaatttaagacctttttaagcatactggaagtagcaaaaccttaatagaacttgggaaaatgaaagatggcttgacagtgttgacagtccaatctggttgctgactgtgggaaggccggcctctctacatcaccttgcttcccgtggtatcttcctggggagagggcactaggtctcacttgtcctgcttgtcctgggtagaccctgtgctctcttagtccctaggctgatgaaagattaagggagggtttgggaaaggtccctacagtctttgggctgggtacaaagaacactgcttttgaagctggctcggtgaatttctagcaagtcaggaaactgaaaataatgatgctaaaaagaggaaagcttttagtggcgagctgctaaggcctggggaatcagtactttaagatggtcaccatggacaccatggacctttgtgcacctgccaggatgcagaaaaataataatgtccttgttaactatgagagggacatctgggcatggagggaagggatggtcaggaacagggctagagtattaatattatgcggtaggtaccagatactggatcatggacttcatatacactattttgttgttttaatgtcataactgttagtttcatccttatgaatgaagctaaagttgtaataggtcaagtaaattgctcaaggttttagacttaccatatggtggagctgggattcaaacttctccctactttcaggctgtttttagcagcctgtttataccaaggttagctacgtgtttggaacactccctcctgggggatgccttgtcatcagagggcagctgacagatcagaagatgctatggtggatatgaggatccttccatcaggctggtaaaaactggaaaagttgtctctggtctgaagaggtgtctatttttatcagacgcgtagcctgtcccatgcacaatgtagaatgatactgtcaaaatcgcgtttttacagtcctttttctagaactttgtagagagcatgacccttctgttacgacatcctttctttcttggacatattagaatatacttgattatgttataacattctttggttagtttcaattccaatgattctaaggtcacttttcctaactttaggagtgtattatcatgttttaaaaacatgttagtgcaaactacaaactcatttattcatctaaatgttttgagcacttactttattgaggctgacactaggttcagactgggaacaggaagatggataagctcatctcttcccatgtgagacagatgcataaacaagtacaatgttgtgtgctaaattgtcacggtgtttaaagtgctatacagatagctactctcacttgattagtttttcattcatttaaaaaaaaaaaaatcaagccaggcatggtggctcacatctttaactccagcactttgggaggccgagatgggtcaatcaactgaggtcaggaattagagaccagcctgaccaacatgacgaaaccctgtctctactaaaaatacaaaaactagctaggcgtggtggcacgtgcctgtaatcccagctactggggaggctagggtgggagaattgcttgaacccgggaggcagaagttgcagtgagctgagagtgggccactgcactccagccttggtgacagagcaagacttcctctcaggaaataaaataaaaataaaaataacaataactaaatcaatgagttcctactaattgtgaggccctattttaggtaccaggaaatccaaggggagtctattaaggcagacagacaaagaaatagataaattatatgatacgaatgggggtaaatataacagataaggacaatttttggtaggtatttactattgattttcgtagaagcaaattatttagtacttcccctggaacagagcaaacactgataaataaatggtaggccatgttgttgttaatatcactatcatcactactggaaaataaatagttggccaattaatttggatttttttaataaaacaaaatgtgggcactattgtcattgttgcattttacagagggaacctgtagacgatgtgattgagcggctccactgtacaatgatttgcagtaaagattcgaaatttaagcagagacactctagctcccaacatctccctctagctgtgggcctcagaacccataagctggtcattagtctggccctctcagcctccacgcaaattaattctgactctacctctaacccctaggatccagtccttgaaagatctgacattaccttaggaccttctccctctcctgttccctacacttagtaagttgccaggccctaggggccagtggttctccccttttactgaaggctcctggcaaaatgcagattctgatttagtagggatctgggtggggctctaggttctacttttctaacaagttcccaggtactgctgctggtccccaggccacgctttgagtagcaagccatagattacagctccatagtgtctctttcaactctcttcctttctcttgctcctgctatctccagctcaggccatgcttacttctcctctggagtctagaccaggtttcagcctcctgaatggtctccctacctgtagcctgtctttctgctccatgctacatgtgtctgctaaattaatctttctaaagtatgacttccccatgttaattcctagctgaaacaccttcagtcactcctcactgactagcaaacaggacacaaatttctccaactgaagtgaagaccctctaagatctagccgtggcattttcaatgggaactctcaggattcccattgatttatcctgttctttgtctcccttgcctctttgcttagggaatttgtggacacccttctttctcctgactcttcttcctgcttccagctgtagccctaatctccccttccttcagcccccaaaccctctcccttcttcaaggtacaggtacccactttcctagctgggaatgatctctcctgccttgaatctgccatggctctttgcctaaatatggttatttatgctgattttttattttttggttttcttctctcttttttttttgagacagggtctcactctatcacccaggctggagtgcggtggtgccgtcttgactcacaggcagcttttgagcctcccgggctcaagtgatcctcctgcctcagccccccaagcagctgggactacaggcacttgccaccatgcctggctgcttttttttgtatttttttttttagagacaatgtttcgtcatgttgcccaggctgttctcaaactcctgagctcaagcgatccgcccaccttgacctcccaaagtgcttggattacaggtgtgagccatcacacctggccatttatgcaacttttatcttcccttgtggactataagctccttcatctctctcagcaaaccccatagcacctctgacggtgtcttgctcccagcaagccctcaattaattcatcccaggtgcctgaaagatttatttcccagttcctcttaatggatctctgttctatttgcattatacatgcattatacattatacacgttcctgttttggatgtgttttaacattataaaccacctcaaatcattttggaaactggtgtgttataaatcataaataatcagctgaagagtagactctcaggaaatgtttgttaaatgaataaatggatgctttcttcaaagctgagtcgctgtctgttcttcccactttctcctgcctcgggtccttctgctcatctattcctctgagagatcttcctgtagctctttagaatcctgttcaactctaaaatgagctctgtgtcctccaggaacttccccttagactgagctgttctgtggcactcagtggcatttggtttaacattgtccactaaactgtgagcttcttcaggttggggccatgttctctgcatctctgcatctttcctgttgccagcacaggggttctcaatcctagctccacatcaaggttctctgtgcaggtattcaggagctcaaagcctcatattgtacatgaggcctactgaatcaagtggttctccaatttgagagccagtgcatcgttagcacctgcagggcttgtgaagacacagattgctggaatccaccccaagggagtttaggtccaagagtctgcatgtgtaatacgtgaccagatgatggtgatgctcgtccaaaaactactcttgggggactgctgttctgaggggtgacgcccagccattctgtatttatttttgtatatttgtttgtttatttatttatttatttattttgagacagaatcttgttccgttgccaggctggaatgctgtggtgcaatcttggctcactgcaacctttctttcccgggctcaagaaatcctcccatctcagctacccaagtagctggtactgcaggcacattgccaccatgcttggctaattctttgtatttttttctttttttagagatggggtttcaccatgttgcctaggctggtatcgaactcctgggctcaagcagtccactcaccttggcctcctaaagtgctgggattacaggcatgagccaccatacccgaacccattctgcatttaaagaaaaaaaaaatcagtgcttctcacatgcaggctgagcatgactggtttagtgcatggtaagggcttgatacatatttaacaggttaaattatttgctccatctgtctcagttctacagtctcaaatagattataagtaacttgtgattagaaaccaagtcttaaagcactgctcttacaaatctcactgggcagaacccagggctaggcccagggctgggcacgtagtaggcacctggtacatacctagtacatacctttggacaagtaattgcctttcctgtccctttccagtgctgctgtcaaaggaaggccaaggaaatctaatgctgcctgtttcaatcaataaataggaaggcaagtttcttgtcacctttttttttttttttttgaggcagggtctcactctgtcacccaggctggagtgcagtggtgtgatcttggctcactgcaacctccacctcctgggttcaagcaattctcctgcctcagcctcctgagtagctgggattacaggcatgcaccaccacgcctggctaatttttgtatttttagtagagatggggttttgccaggttagccaggctggtcttgaactcctgacctcaggtgatccgcccacctcagcctcccaaagttctgggattacaggcttgagtcactgcacccctcccccttgtcaacttctttgaagaattcatgcctgagatgtttatagaggaagaggcttcaaaaggaagagaatggaaataggactaagctattatacatcttagaaaacaagtcaatcagagacttgtctctaacttgagccaatccaaataattctgcataattcagctcctttcccaagtttctcgttgcatatctgctgcactctgatttccccttgaaattaactgcgtccatgtgagccagcatttaggaaatcattaataagtgcagtgaagacatgcagcaaaacatgcttctaagcactgtccttctgaaaatgtcagtatctatcttctcaggaaaaagttcagggtataattggattattgaaataaattcttttactttccttttttttttttttttttttttttttgagacagagtctcgctctgttgcccaggctggagtgcagtggtgcaatcttggctcactgcaacctttgcctcccgggttcaagtgattctcctgcttcagcctcccaagtagctgagactacagggacgtgacaccatgaccggctaattttcgtattttttagtagagacagggtttcaccatgttgaccaggctggcctcaaactcctgacctccggtgatcctcccgcctcagcctcccaaactgctgggattgcaggcgtgggccaccgcacccagccgggattattgaaacaaattcttaccaccagggtctgttttgtggttctccgagcatttaacagcttgttacaaaaataaaattatcatcatcatcaggcaggaggtcttaaaaacaaaccaatgtgctagatgtaaaccaaaaaaattgatacattcctcattgttcttccttttggctagaaattgaaaataattttttaaagcaacaactattaattgactgagaggattggcagagaattatggaaaacacctactcatccctgcagactcaaggtgccacagccatcctccaaaaaccacccttcctgtgtgccccctgggcctcccgccacctcactgccttgtacgtgtcagttgcccctcccttattctgttaagtgtgagataattatgccaagattgaaatagtaaggctaacataaattaaaactgacacagcacaccaattttatgcattccttgactccaaccagtaagtgacaggttctcatgttctcattcagatgctgcccacactcatatgctgcctggagggtaccccaggcttgcctgcccacaggagacctgagaagacacactgtagcctcctcacccaccgcacctgtttcttcctcctccttcctgtcacatgcaggcttgccccatcgccgggccaagcgcagctccgtcttagtagcctgcaagctcccacgtggactaattccgtaatctactatgagcacattctggaaggctgatatttaccttctcactgaaagtaactgttaaactatttccgggagagactgggtttttgctgggctttccaaacaccattttaggtattttttaaataacatacacacatccaattttaagcacaatgatttctttaatgctttgacggatctttggcttttctcacattttcgaaatgtcttagaactaggcctacatagcaactacttcatgaactgcttaagggaggtctgacttatatttgactcccaagtgcctagcacaatccctggcacatagaaaggggttcagtgcattagacatagaatagcaatggtcatagataatattcactgaacattctctctatgccacacatcgaagccctcgatgcaattatattattcaatcttagtaatgactaccttgtgtgctgtgtatcactagcaccaccctttgtaaatgaaaacaacctggggctcacaggggtgaagaaacttgcccaagttcaacagccaggaagtgacaaatcagatttcaaacccaggtctgtctagttccaaagcccctgtgttaaactcagcacagcataaggacaacagttgaactaaccctgattttagagactgtaaataatcagatagtctcctggctttgtggtctactgcaaaactaaaataatacacccaacagcatgacaagtgtgggaaaacaacgagcagtgcccttttaaagggggagacagtgaggcccatagaggagggcaggtccacccagggctgcaaaggcatcaggccagagcagcacagtccctggagtccccaagactgatttctaacattggaggagactggcactcaaaccttccgccgatcctgaattcgccaccactgttctagccattaaacagccttctccaggagagaagcattttattaagattgcagcattctattatctagacgcattgagagttagctggataactcattaaaaaggattgcatccactgattgatgggatggcagactataattggaagggcacttagaggctgagaggcagtacgtgacttgcctgagatcccagtgcagaccagtggccaatattagagccccagcctaaccgtgcaataggggcactttgcatcttcctgccctgacaaaggcttgctgggtgtcggagtttgagtgaagcagtacagagtacttttcgggtggattgagtaatgtgtgtgaaagcctgggagagcgaaactgggggttttgtgcagaagagaatgggttggaagcagcaggaaaaaaataatgtaataaagaaatggctgtggggaaggcaatggggcagtactgtgttggttccaaaatatcacttagaagaagaaaacggcccccaactctctccccagtgctgaagggcaatggaaccacttgcacttaacatccaaagaccagcgtcccggtctctgctccgttacttacacgccgtgaacccaggccggtaactccactttgggccttcactacttcttttttttttttttttttttttttgagtttcactcttttgcccaggctagagtgaagtggcgagatcttggctcactgccacctctgcctcctgccccactcggggttcaagtgattctcctgcctcagcctccggagtagctgggattataggcaactaccaccatgcccagctaattttgggggttttgttgagacagggtttcgctcttgttgcacaggctgaagtgcaatggcgcgatctcggctcactgcaacctctgcctcctgggttcaagtgatttgcctgcctcagcctctggagtagctggattagaggcatgtgccaccacgccggggtaattttgtatttttagtagagatggggtttctccacattggccaggcagatttcgaattcctgacctcaagtgatccacccacctcgacctcccaaagtgctgggattacaggcataagccaccacgccacgccctcatttcttctttattcatgatataaagaggttgccctgggtgacttctaagatatcctggttctgacactcaagtattctcctggactgggatgactgaaggttacatctgatgtcctaaaactactcagaatattccacccttctgtggctactctgtgatggtcacctctccaagtgcctctgagttttgttttggaattcagagccaggtgataaattggccccaagcttttaacctctgggattcctctgttttcctgggagtaaatgtatccctcagtgtttctgttcctaatgctgttaaatgttattttggtcacaagcctcagccactgaatagaaatcttaaccaaaataattgcttaacaaagtaaaaggcagagtcctggaaagaaagtgtccaagcagtgattggtatccatggaggttttccctgcagccatgtgcactgctgctggggaagcttagcaaagctttctgggaagaagaaggaagcacatttgtgagatttttatctgtgggatggagcaaagctgggcatctccccctcacatttctccacctttttgtatagctgaaagaagaaagcatttccctaccacaggtaaagactcgcaaatgacgcttccttcttccagctgtacaaaatggcaatgggctttaatgcttgggacaaaagaccctctccctcacttcttccatcagttatctatcactaccaaaaaaatccccccgaccaccacttaatggcgtaaaacaacaaacatttattatttcacagtttctatgaatcgggaattcagaagcagcttagctaggcggtcctggctcaagatcatgcccgagtttgcagccaagattgggctacagtcctctgaagacttggttggggctaaaggatctgcttctgttctggcctgtatgctcaggctgtcataaaatgacacagcctgggtgacttaaataacagacatttattttctggaagctaaaattcataagcaaggtgctgacaaattcagtgtcaggtgaggtctatcttcctggcttgtggatggttgccttcttgttgtatcctcacacggcctttcctcagtgcctgtgcgtgaggggagagagagtgagctctctggtgtttcttctcataaggacagtaatcttattggatcagggccccacccatttaaccttaattacttccttaatggccccatctccaaatatagccacattgagggttagaacttcaacatatgaatttttggggggacataaacactcattctatcacagttcctaagatggtatatttacaggttttggttgttggcaggaagcctcagttcctccccatgtgggcctccccttgggctgctttgtcattctcatgccatggtacctggcttcccgcagacagcaattcaagatagcaaaggagaagccataatatgttttatgactgagtctcggaagtcacacactatcatttctgcaaaatcctactggttacaaagctcagtcttattcaatatagggactatacaaggacatgaataccaggaggcaagagtccctgaggaccatcttggaggctggctatcacatctctggatgaaaggacattatggtatcagaaaaagaatgtatgttttgaaaaccagtagacctggaactaaaataaaattctagctcgacctcttgtaagatgcaaaactaacccctctgagctggtttctccatcactaaaataataataccttcctcacacgatgggcgtaagtaccaaatgagagaacgaatttactgtgtcgcaactagcaatcatctggtaaacactctttccctcccctgccttccctagtctctcaccacctcgctgttcccaccttcagcacttgcccaggcttcagcacttcccttgtgcaatggtaatacaagtcaagaattctagaatgccagagtcagaaaggtcttccgaggccaagcatggtggctcatgcccataatctcagcactttgggaggccaaggcaggaggaccccttcaggccaggagtttgagaccagcctggtgaacatagtaagaccatatctctacaaaacaaattttaaagttagctgggtatggtggcacatgcctgtagtcccagctactcaggaggctaagtcaggacgatcacttgagcccagaagatcgaggctgcagtgagctgagatcgtgtcactgcactacaacctgggcaacagaatgagaccctgtctcaaaaaacaaagcgatttctgtatcatctattctaaccacctaactaactttttaaccaccaaggctctttctattattttcctcccaatgagccccatattttgaaatagttctgaccaccaaacaaattacagtaactacatatttcatttcccattatattcatcaaaaggatgtataactgcccatcagaacatctgatcagcgagtgaaaatctgggccttcacaatggattataatcatttcagtggaaagtaaagcagttattattttagggacccagaaaaatgagggggatttatccaaggtcattcagattagctgctgataaaactagggctcaatcctggacctcctgactccaaatcagtgatcatcccctagtcctaagtggtcaccttatttatttgacatgacatgccgtgtcatgatatctcttatgtcatgatatctgacataagagatttaaatcccttctagccaaacagtataaaacttcagaataaaatatctactttttcaaggccctacttgcatgactaacacaagtgggcaagccctctgcacccctaaatgtggctcatcaacaccacagaacaggccattgcctaggtggcctccatgctgggctgtctccccagccaatgtgcctataggttctacagctatttagcagagctataggatagggggcaagttttgcatgttcaggctttctggtccataccagcttctcattgacgagtaagagtcaagtcagagtagggtgcaaggaagtcatccttgagcctacctgcatggaggagggggtgagagagggcacggtttggcattgactccgtcttgccatggagagcaagagctgagaagtatgagggctccatactcatcctggtgtgggccatcaacctcatttattggctggaaggtcagcattatgataggtgtccaatcccaacaccttctataaaagggaacaaaaaagaaccaaaggaagaaaagcctaagaattaaaagggaggccaggagaggtggctcacgcctgtaatcctagcactttgggaggttgaggcaggtgaatcgcttgagctcaagagttcgagaccagcctggccaacatggtgaaaccccatctcttaaaaaaaaaaaaaaaaaaaaagtgaggcatggtggcatgcacctgtagtcccagctactaagaaggctgaggtgggaggatcacatgaacccaggaggtcgaggctggagtgagctgagatcgtgccactgcactccagcctgggggacaaagtgagaccctatctcagaaaaaaataaaattaaaattaaaaagcattaaaagggaatccctccggccgtgcaatggaaataattagtgcctatgagtaagttaagtgagcctgttgtttaaaaaccaatacttcacaaaatgtgtatgctctttatgtgtgtgtgtttggggcagtccctccctttagttcatagtagagttccttttgaatgctgccgcccaccttagctttattaaggggcacaaggaaggaggattttgtcttttccatacttgggccaaaattttaggtggaagaggtaaatctttagggacaaatatggtcacggcaataggatgcaaaggagagaagctggcaagagagaaaaggaaattcagagaaccagattagataaaagttttcagttgagccctccgtcttggagagaaaatatctgaaacttgtatttgctcaaacgctggaagccattctatgcctgggggagaggagaagagttcagtgttccagatgactggcaagcttgaatgtcagccttgctgcaacacagacccggaaaccttgggagttccatcggcgtggtccagagagatgccgtaatgtcaattacatttaatgtcactgctctgtactcgctcagccagatgtgttccatggcaagagatgttgtttcctaaggaaacctttaggaaaaaagaataaacgtcctcaatgagcttcctctgggggcaatttgtatccgccagtggctgaaccactttatccaacatccttctctccctccagatattacgcacacaacctctatgctcaagatccttcaccaggccctcctgagtatgtttgggacatatatgatataaatgggaaaggatacagggggcaatgtggacacaaagggaaaaagtggcaaggtccttggcaaataattacctatattgagctaaaattacctaaatcaaaagttacctgtccttgaggggtgtattttttcccctgggggtgccaaaacaaagtaccacagactgggtgacggaaacaacagaaatgtattttctcacaattctggaagctggaagtctgagatcaagtttttggtagggttggtttcctctaaggcctctctccttagctttcattttatttattttttatttatttatttatttatttatttatttatttatttattttgagatggagtctcactctgtcatccaggctagagtgcagtggcacgatctcggctcactgcaacctctacctcccgggttcaagtgattctcctgcctcagcctcctgagtagctgggattacaggtgcccaccaacatgcccagctacatttttgtatttttagtagagacggggttttaccatgttggccaggatggtgttggtctcttgacctcgtgatccacccatctcagcctcccaaagtgctgggattacaggcatgagccaccgtgcccggccaccacgaacactttttagctgggcagtgaacatagcagtaataatatatgtgtatagctccttataattattaagatttttcatcaacgatctcattttcatcactacaaatactcagtgaaagcatcagggcatcactggaatcattccataatgattattataggaaattgaggggaagagagtttaaattgctttaccagcagattcgagggctgcaatcagaactgtgctataggcaaattcatctgacagacttgtgaagaatgctctggagagggaagaggaaggaggcagggagctattcaagattagaacaggagtgaagtgataaaagctggaattaggggagtggtactagaactagaaaaatgccttagaggaaaccagccctaccaacaacttgatgttgccttggataataaacatgctaaaaatgaacatgctatgaaataagcaaaaaggcccctggaagggtaatgcatttatttggttcctatcatacttcatatctcagcaggaattaattgatcagattcttccctgcctttgctaagtaggaacacgaagaaggtgcagctctgttcccacatgtctttcacaggcatttagtatattaccctgtaatcatgtattcatatattgtctttcccactagagtatgagttcctccgctggaaaagtggcagtacagcattgtattcatttttgtatacctgatacacagcaaaatgcttctgtagttagacgcttaataaatacctttggaatgaatgaatgagtgggcaggtgaatgagtgaacataaatagcagaggctaagaccttaaggacaagtgccagtggcttagagccatcaggtaaatctgtcctgaaagacatctctctaagatccagaaacttaaagccaggaccgaatactaggtcacttcaggtgacagccatttccatatgtggactttatcatagagaactgccagggaaatggcaaagatgatctgaaataacttgttccacagaataggtttctaggtagaaaccaatggttccctctccatggccctgccctggtagtggtccaggggtcctttcttgtaagctcacagacagcacgctggtcctccttcctgctgccattctcacatcactgcctggcacgtggcaggagccaccgaaacacctgttgaatgaacaagtctggcagtaacagaaaagtggtgagataagatggaaagacccaggccaggcacagtggctcgcgcctgtaatcccagcactttgggaggccaaggtgggcagatcacttgaggccaggagttcaagactagcctggacaacatggcaaaaccccgtctctaatatgctaggagtggtggcatgtgcctgtaatcccagctactcgagaggctgaggtatgagactcacttgaacccaaaaggcagaggttgcagtgagccgagatcgtgcccctgcactccaccctgagcgacagagtgagactccatctcaaaacaaaacaaaaaaagaagtcatgactttcagaatttgtgggagagtgggatggtattctacctcctatccactttctccccacacctaccttccttccttccttcctttccttccttccttccttcattccttccttccttccttcctttccttccttccttccttcctttccttccttctttccttccttgcttgtttctttccttccttccttccttccttccttccttccttccttccttccttcctttctttctttctttctttctttctttctttctttctttctttctttctttctttctttctttcttaccttccttccttcttttgttcatctttttggctctaatttaacctgcccctgtgtcaaacccccacacctttctgaccatggaagatcttccttggaactcccagtaactacaattctcacctcttagtctattgttctcaagcctatctgtctcacctgtcacagccctctatgatctaatccctgtgtgtgtgtgtgtgtgtgtgtgtgtgtttagtgtgtgtgtagcatttttttccaactacttctgacaataacatctctcctacttttacctcccttcagttttccttctgagaaacctttcagagtctgggcacagtgtctcatacctgtaatctcagcactttgggaggctgagatgggaggatcacctgaggtcaggagttcaagaccagcctggccaacatagtgaaaccccatctctaccaaaaatacaaaaattagccaggcatggtggcgagcgcctgtaatcccagctactcaggagccaggagaatcatttaaacccgggagcggaggttgcagtgaggtgagattgcaccactaaactgcagcctggatgacagagtgagtctctgcctaaaaaaaaaaagagagaaagaaacaaagaaagaaagaaaggaagaaagaaagaaagaaagaaaaccttttgaggacctcttttccctttgagaacctctcttctcccatttccccacttgttcccagttccagggatgcacaaagttctcaggcctagccagttacagcactccatccctatggtggcaggaactggtttggcaatggacacagaactcaagattgaccaaacccaggctttttacaactaaattggtcaaagttaagcctggaatttatattctggggccattttgctccccttgggaagagctcacctgaaatgaagtcaactccaagataaacagaacccagagatggtgactggtatatttctgatgacatgatatgtataagcacctgcatttaaccatgcctaaagccagaaatccctggattttcagatataaaaatgtatcagtttcccagggctgctgcgggaaatcaccacaacctgggtagcctcaaacaacagaaatatatcctgtcacagttctggaggccagacatctgaaatcaaggtatagcagagtggtgtttcctctgaaggctctagggaagaattctttcctgcctcttcctagattctgtaaacactttcttagcatggctcagtgggctctgcagatgaacacgtggcatgtaatttacagccatctcctctggtggtaatttagacacccgcttcctgaaaattcagggcctttgatattttgcccacccctcaccacatcccagcccatctctccttgcttgagcccatgttttgactaaacagaaaacagattctaattcctgtcttgagaagcaatgagtgaatgctccgtaaggatatacccatgacacggtagaggtagcatttgatgtgctcttctaaaagaggcagatgtttctagaagccgaggcattaggcacaccctagacctcagtctttatggaatataacagaggcagtaagttggagaagaagtcttgctcatatacatttcttagcaatgactagaacctgggccatgcacgcaattgactagcttcccactgtaaatgttaggcaggtacagatgaggcttctaggacatgagggcagaagtttaggggggttgacattcagacttgaagttcttcaagggagaatctgttcatctcttagaaggtctgaagtctggaggtaaagattcctactgtccaaggaaaatcttgggcatccaatacccttcccatctgctaatctaagtcaagagaggatctgtgactagtatgagacagaagaaaaatagaacgggaaccaacttattttgtggacatgtaaatttaggctattcctgttcatggggttggattttctcctcattcttttgccataggcaggtacattcttgcatgctaagctctatgctgccacaactgcggaccactgatgctcttctccccttcttcttcagattccatccaaatgcccttgtgcagaattcagacaaatctgtgacagcagggcatagtgaaaacagcataagctttgaggtcagaaagacctggaccaaatgccagctttgaaagccacttaaaagccctgcggccctaaacataacagctacacttacgtagcacttaaaacacgccacgtactattctatgtgccctacacatgttaacttacttaattctcaccactaactcatgaggttgtgtactattagcatcctattttatagatgggggtgttcaggtatggaaaggtcaagtaacttgcatctaggtaagctgcagaacgaagatgtgaatttacacagtctggctccaaagtcagtgtctaagccacgcacggtggctcatgcctatcattccagcactttgggaggccaaggtgggagggtctcttgaggtcagcagttcgaggctgcagtgagccatgatcacaccactgatccagcctgggcaacagaacaagaccctgtctcaaaaaaaaaaaaaaaagtcagtgtctttaaccactaaggcaagtttcattacctccctccattcatttcttcaacaactgtttcctgagtgcctactctgtacccagcactgcacaagatgctgaagatgcagtcaaggacatggtcctgaccctgcaggcactgacattctagtgggagaggcatcacaatacacagtgtgggttgcaggtgtgctatgggaatccagagtaggggcagtcaagaaaggctcgctgctgggcatggtggctcacacctgtaatcctagcactttgggaggctgaggcaggaggatcacttcagcccacatgttcaagagcaatctgggcaacacggtgagaccccatctgtaaagaaaaaactatctttttaattttttaaaaaagaaaggctcattggaggatgtgacctctgagtcttatggggccagtgaaaggtagaccatggggccacaggcaggataaaagagaaggacaggtttttccaggtggagaaaatagtgaatgcaaagataattgtgtgacggttcatgtgcagaatagaaggcaactcagtgtagctggaacagagcatggcaatgggacagctacacgagatgaggttggagagccaagcaaagtcatatttccaagggtctttctaccgtactaaatttgaagttgaacttgaaaaaaaatgacatttttagaaaacatagtgaatacactggaaaatatgaaactgaaggcaaagagtccattttacacaaagatgtgagagtttgcattaagcaggttaacagggatagagaaaggtcagagtcaaaggtattcaggagctcgaatatatagaaccagggctggctgaatgtgaagcaaaggaagagcgagggatcaaacatgcctcgctggttcttggtaagtagggagtagccccattcaatccgataagtgatgcaggaggcacagcgctgaatttgaggtgcttgtgagacctccaagggaagccaccttgtctggttatactggtctttgaggaggaggtctggtggtagatttggaagttgttggcatctaggtgtgcacaggtctgggggtgacaatgataccaggggaactggggaggagagatgaaagagagctgaagtcagaaccaatgttcacaacacacgcccatggaaaaagaaccaatggcaggtagcaggaaggaggaaattctagagaagagggtgtcatgcaggctgaggccagaattttaagaatgaggatgtgtcacagagctgaggagtgggccgacctctacttgtaggtgggtctgcacatctaactccccaccaagactgtgatcgaagagcagagtggtgtctgatgcatctgttttcccaaaacagcaggtgcttaatatgtaaggaataaggaaataataagagccaatatttattgagtgtgtacatgtgccaagcactagacactttgcatgggtaatctcattcagttctcacaaccatggtattaggtggatgctgtttatatatatactcccaaaatgctgggattacagacgcgagccaccacactcagtcctgatagctgaattttaacagggaagaaatcctttgaatggctaatctgacagaattttcagcatcactattagaactgagaagaaatgatgcctggaggtgtgccagcatcttggttctgcagcttacctagatgcaagttacttgatctttccatacctgaacatccccatctataaaatagggatgctaacagcagccatggtgcacacagctggccctgccctaccctgagcccctgtgcagcgttaatgagcagctgggagctatctgcgcaggcccagaccccgcctgctggggttatgggccttcccctccagggagggctataggtgggagctgaagagcaggaggagataagtaaagtagcagatggcgctaatttcctagtgcacttatcaagctcactaaggcagggaagtgcgggactattcagccttacacagtgaggagcacagctcagtcagcacattaaaaccagccgcaaggccgggcacagtggctcacgcctataatcccagcagtttgggagtccaaggccagcagatcacttgagatcagcagctcgataccagcctggccaacatggtgaaactccgtctctactaaaaataaaaaaaattagccaggcatagtggcgggcacctgtaggcccagctactcgggaagctgaggcaggaaaatagcttgaatccgggaggcggaggttgcattgagtccagatcgcgccgctgcactccagcttgggcaacagggcaagactcccgtctcaaaaaaaaaaaaaaaaaaaaaaaaaaacagccgcagagctgaacccactcatggagcacacgctgacaaagtctgtgacgtgcaagtaaaaggagtgtcctcttacttcagtttctggtgacccagaactagaccttgggcagtagttctcaacctgtgagtcacagaggttggcacgaaaacagacgagagcacaaagttaaccctttaatagcactctagagcaatgcagtccagtagaaaatatagaaatagaaatagaatgtgagcccccatggaatttaaaattttctagtagtcatgtcaaaaagaccaaagagaaacaggggaaattaattttaatatattttcatttaaccctaaatatataaaatattatttcaacatataatcaatggaaaaattactaacaagattttttacactctttttattatactaagtctttaaaatctggtgggtgttttacattcactatgcatttcaattccagttagccacatttcaattgctccattgccacatgtagtggctggtgcagcactcgagcctgtaagtctgaaaaaccgggacagcaggaaagtcaggcccctgacacacaatcagccagtgaaatctgaggaatggggtcgaaagggatccaccagcttgtacctgaggtccatatgcaatcagctgataaatctgcaagatagaagatatccctgcacttcaaaaactctgtctactgctttatatgacttcttttctgtcacaatgctcaccttcatgtccatttagcctcagtttaccaaaaaaaatcattatccccgctgggagtggtggctcatgcctgtaatcccagcactttgggaggccaaggtaggaggatcacctgaggtcgggagttcgagaccagcctgaccaacatggagaaacttcgtctctactaaaaatacaaaattagtgggcatggtggcacatgcctgtaatgccagctactcaggaagctgagacaggagaatcgcttgaacccaggaggcggaggttgcagtgagccgagattgcaccattgcactctagcctgggcaacaagagcgaaagtcggtctcaaaaaaatattatccccaaatatttattgagagtacagcatgcctgcactgtgctagatattggatccagtaatgtattctgcatctacaatgcattgcagattacaaagccctcaacacaaatcaaagaagttggtgtatcaattatctattactatgtaacaaatggctacaaatttagcagcttaaaactacacacactatttcatcatctctgtgggttaggagttccagctatggctcagcaggatcctctgcttagaatctcacaaggctgtcaggtgcagtggctcttgcctgtaatcctagcactctgggagacggatctgaggcagacggatcacttgaggccaagagtttgagaccagcctgtccaacatggtgaaaccccatctctactaaaaatacaaaacttagccaagagtggtggtgcacacctgtagtccctgctattcaggaggctgaggtaggaggatcgcttggacctgggaggtaggggttgcagtgagccaagattgcaccactgtactccagcctgagtaacagagtgagactccatctcaaaaaaaaaaaaaatctcacaagactatagtcaaggtgttggcaagggctgggtcctcatctggaggctcagctggggcttgtcatggacatgcaagtcgttgaaatgcaagttgttgaagctgttgaaatgtgagcctaagatcaggcagcttaatctgtgaggatgtgaggacgtacttccaccctcatcactcacgtgattgttagcagtattgagttctttgtggttgtaggacagagagtcagctctctgctggattttgatcagaggccacccactgttccctgtctcatgccccccccgccccccataggcggttcacatggcagctaacttcttcaaggctggcagtacttctaattccagtctgctgcaaggttgttttatacaatttaacataatcatggaattgacagcccatcaccttggccatattctattggttgaaagctcataaatgtgcaagacagaagatatccctgcacttcaaaaaacctgtgacttggttgaaagtgagggtcggggacaatgattggcaacagtcactcagcttgtaggagaaaaattcatcactaaggtccacggatgctgattccatggccaatgtcccttctaacacagagtgacagtgaaacgtggctcctgctctcaggcagctggctaaataattggggatggcagctagaaataagcttacccagaactccacagtgtccccacacatgtgagagacttggcccagggaataggttgtaaggaacctccactgggttcttaaactgtcccttcctggagctaggcaggaacatcagagatgagacatgagactttggcctggcaagaagaaatcatgggctcatgtctaggagtaggactgcctgttttaagaaacctcatcggccgggcgcggtggctcacgcctgtagtcccagcactttgggaggccgaggtgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcacagagcgagactccgtctcaaaaaaaaaaaaaaaaagaaacctcatccagccaagaacctcatccacaactgttcctaggagattttgcactgtaactcctaagttcccccttctctcacttagggcttaactgtaggatgctaaggtcaaagccgcttactataggtttcccactttctctgccaggcactgtggaaactgccctgatcttaggctcatatttcaacagcttcaacaacttgcatttcaacgacaagtccctagtggtatatcggaaagcagtgcctggacaatcggatctcctaatgcctctgttaccccatccccaacatgtagaatcaaggtcaaacttaaggaattttggctagatcagccaggcgcagtgacttacgcctgtaatgccagcactttgggaggccgaggcaggaggaattgcttgagctcagaagtttgaaaccaacctgggcaacatggcaaaactccatctctacaaaaagtacaaaaattagtcaggtatagtggcatgaacctgtattcccagctactcaggaggctgagacaggaggatcgcttgaccctgggaggtcgagggtccagtgggccgtgctcacaccactgtactccagcctgggggacaaagtgagaccctgtcaaaaaaaaaaaaaaaaaaaggctggggggattttggttagctcaatttaattctctctggctctaccagagattgtagcccatctgctggggccacagtggagaggagaaattttgagtgaaattttctcatacaaaagcgaaggagttataaaacgttcaccatgttttggggggcgagatatgcacactgcaagtgatgaatgcaagacaatataagccacttcataaacattattaaaaataataaattaattaagtttatatcgttaagtaaaaagttactatatacactaaacaccttagcatttcacagacagaagagcccattctgaaccagaatcaggtaacttgatttgggcttaggaagagacctaggtttagagcagtggttctcaggtgacggcaattttgtttcccaggaaacatttggcaatatctgaaaacatttttgactgtcacagcacaaggaaggaggaagggttgtattagtctattttgcattgctatcaaggaatgcctggccgggcgcggtggctcacacctgtaatcccagcactttgggaggccaaggcgggtggatcacgaggtcaggagatcgagaccatccttggtaacacggtgaaaccccgtctctactaaaaatacaaaaaattagcctggcgtggtggcgggtgcctgtagtcccagctactcgggaggctgaggcaggagaatggtgtgaacctgggaggcggaggttgcagtgagccgagatcgtatcactgcactccagcctgggcgacaaagtgagacttcgtctcaaaaaaaaaaaaaaaaaaaaaaaaaaaggaatgcctgagattggataatgtacaaagaaaagaggtttgttggttcatggctctgccggctgtacatgaagcacagtgctaggcatctgcttctaatgaaggccttgggaagcttgcaatcatggtggaaggcaaaggggaagcccatatatcacatggcaaaagagggagcaagaggtgagggatgccaggctcctttcaataactcactctcacattaattaacagatgatccagaactcactaccagaggggaggagccaagacattcatgagggatccacccccaagacccaaacatctcccactagcccacctccaacattagaggtcatatttcagcatgagatttggaggggaccaaacatctaaatcatatcgggggtatggataggtgcaactagcatgtagggaatagaggccactgtacactggacgctgttatacatcccacaatgcacgaaaccctcccacagcaaggaattccctggccagaaaagtcggtagtgctgaggttgaggatccctggcctagagttggcagagagaaagagaggaaagctttgggcaaaggttgtgtgtgggagtgtgagggttcgggggtagaggggaggtataagatggaggcaggtggaagaacaatagaaacaccaggacacccccccacattgtcatctggaggaagattccctccaccaactaatgataacttatcttctgacttactgatctccattagcaacaaatataagaatcccttttacatttcacctttcattcctgttcaccttttattcctgcatgaaacaagatctaataacctttcagaggtttcttcagaccgcgacaaaattacctttcacccctactatacaaccaaagatattttaggtttaatttttctcctcctcctactagtaaccctagtactattttcacctgacctcctgagcgacccagataactacgctttagccaaccccatcaacaccgcatcccacattaagccagagtggtacttcctgtttgcctatgcaactttacgatccatccctaacaaactaggaggcgtactggcccttgtattctccattctcattctagcagttattcctgtacttcacacgtctaaacaacaaaccataatattccaaccattgagtcagtgcctattctgaatcttaatggccgaactatttacactcacatgaattgggggacagcccgttgaatacccttttatcgccatcggacagacagcatctattatgtacttctctaccatccattttattttattttatattttttattttattttattttattctattttattttattttactttatttcgagacggtgtctcgctctgttgcccaggctggagtgcagtagcgcaatctcggctcactgcaacctccacctgccaggttcaaacaattcttccgcctcagcctcccaagtagctggaactacaggcatgcgccaccatgcccagctaattttagtagagacgaggtttcaccatgttggccaggctggtctctaactcctgaccttgtgatccacctgcttcagcctcccaatgtgctggcattacaggcgtgagccacagcgcccgacccttctaccatccattttagaatcttaaaatgttaccactgaagcttagagatccagcccaactcctttgtattgcagatgtggaaactgaaccctaaaaagacagaattgattgctcaaggccacagaggtttctaaatagcagaaccagctgcagaacgcaggcccctaactcactggccagtcctgtttcttctgttttatttttgacatctaacagcccagtaaccttttgaacatctcacattcaaacctctgagctacagaatagttttcaattcaataggaatctcaggaggttcctgttgagttgaaaactattctgtagttcagaggtttgtaaagcttttctgcaaaggaccgcagagtaaatattttaggctttataagccagacgatttcagtcacaaatactcaatgctgctgctgtagtgtgaaagccgccatacaccatacataaatgaatgggtatagctgtgttccagtagaatttatttatagacacggaacttaaattttatacaatgtatgtgtcagaaaacagtaacttttcttttaatttttttcacccatttaaaaatgttagaagagtccaggcgcagtggctcacgccctgtaataccagaactttgggaggccatggtgggtggatcacctgaggtcaggagttcgaggtcagcctggctaacacagtgaaaccccatctctactaaaaatacaaaaaattagctgggtgtggtggtgcacacctgtaatcccagctacttgggaggctgagacaggaaaattgcttgaacccgggaggcagaggttgcagtgagctgagatcgtgccatcgcactccagcttgggtgacagagcaagacttcatctcaaataaataagtaagaattgttcttagctccagaccacaccaaatggtggcaggggagggggaggggggtggggggcaggtgggagcagggaggatgttaccagatttggactctacatcaaaattgctgatatgctgctatcagaaagtagatctctgtaaccagcaggaaaaaattttaaaaacctccagaaaagtgcaataattgcaaacaatacataccataaatactgttgttgctaaatgtaagataaagtttcatatttctatgtgtacacacacatacacataagcaccagagaaagatccagaaggatcttcataaaattcgtaacaggaattacttgggggaggggaggaggcttgatgggaataggtgaaggaaggccttgcagtgtttccatgtgttttataatgagaatatatttatgtcttagtcctgtaactttttaaagttttaaatttaaaaacagtccatgtgtatcttatactagtttaatgaatttgcctcacccctcacaaatcaacttcatccctccttgctgtctcatccgagggaattagggacagagctggagaagcccaggacagagcttctgcccctgcttagcgagtcgccaggaggcagccccgggccctgagggtttccggtcattttatggtttgggggagggaggggagaaatgctatttcgtcaaattaaaaaaaaaataaaattactactctttctgctgggatactggtggtctagttagaggatctgactttggaaaccccaaggacaaaggagacgtaaaaagcagccgcagccagtcccctggtgtctgggtcgctgctcttgaaacctccagcacatgtggtttcaatcaccgagcctggcgccttccgccactcagaaggccagcagcttcggggcgcccaactgacttctttgtttgcgaggagctgggcctggcagggtggccgccttcgagagaggttttaggctcagccttcccctttctataaaattccggaaatatcagggcagccccaggcgacaggctgcaggcagcctgcagcctgctcgggggagctctcatctctggggacagcctaaccctgagacctcttggccagcgccgtccaaagcaaacagtgagcagatggtccaagctcggcctctggtgaaactgtttattcttaggagatggccatctcccctctgggaccctgtcggctccaccaggctttgctcctctttcccttccgcatctcctccttcctccttctaaacgcgagtcctctgaatttgatgccatttttgagctttaagaaaggtctaccccgtctctactaaaaatacaaaaaattagccgggcgtggtggcgggtgcctgtagtcccagctactcgggaggctgaggcaggagaatggcgtgaacccgggaggcggagcttgcagtgagccgagatcgcgccactgcactccagcctgggcgacagagcgagactccatctcaaaaaaaaaaaaaaaaaaaaaaaagaaaaagaaaaaaagagaaaggtctgcaaggaaaagtcagcattctttccattgtggaaggttcatttggtttcctagaggagaagggttgaatggaaacatacggggctcgggaaactggacatgggaggtttacatacccagtttggaatgaggacaaaccttgtttacctatgttggcagcctgtcacatctaaaaccaaatgccattagccagccccataagtaagattccatttttggtaaattactaaagttatactttcagaaaatcaaaggtgacagggcgtcgtggctcacacctgcaatctcaacacttgggaggccgaggcaggtggatcctgtgagctcaggagttcgagaccaacctggccaacatggtaaaaccaccctctctactgaaaatgcaaaaactagccaggcagggtggcatgtgcctgtaatcccagctacttgggaggttgagggaggagaatcgcttgaacctgggaggcggagattacagtgagccaagatcgcgccactgcactccagcctgggcgacagagcgagactcagtctcaaaaaaaaaaaaaaaaaaaaaaaaattacttaaaagtaataacccaagttccagccatgaaatattacactggagagaccatagacttccatcttggcctagagcggcccttaaagcgccagggagaggagggtggggtggggggggacaaggagggcggggtgggggggaccaccctagaactggccaccggcggtatcatggcaacctgaacccggctccccaagaatatgaaagtgaggacgactcttacgaagtgttggatttaactgagtatgcgcgaagacaccagtggtggaatccagtgtttggccacagttcgggatctatggtggaaaaatacgcagtagctacccagattgtaatgggtggtgttcctggctggtttgcaggatttttgttccagaaagtttgaaaacttgcagcaactgcagtaggtggtgactttcttgccgtcagattgctagtcatagtggctacgtgcagattaactggaagagagttgaaaaagattcaaacaaagcaaaaaggcagatgaagaaacgagcgaacaaagcagcaccggaaatcaacaatttaattgaagaagcaatagaatttatcaagcagcacattgtgatacccggtagatttgtgggaggctttttgctcggacttgcatcttaaggacgtgaatgttctcccatagtggattcaactatgagaagaaaagtggcagcaataaggggtctttcaacagtacatgctgccagagtctgtagggcaaggagaaacaactagctggaaaatactgaattcacagcttagcattttgccacccgaggctaggcaaactagtatctgcgacaatagtattcctgagcaaaacatggctctcatcatttttgcaaaaatttggatctgtttagaaattagcctataaaatatcaccattggatttagatatgcagagaaaagaaatatgctggatttattgcctagtgaaatattattctctttttatgtaaataaaatgttcttcattgtgaaaaaaaatagaaatactacagtggaaatacaaacctacaggcaatcatcttaccttaacccaattcctagcctggactcctgaaatatctatgacagacacctcattcaggacttcgtttttcactgttccctcttgggacattgtcagtccttagctttgaccatatatacatgtacatatggtatacaggctctataaatcagggtcccctccccccaccttttttttaacttttgagaacaccacaaacactgcaaagatatttgacaattttctcaggttttttttttttttttgagacggagtctttttctatcacccaggctagagtgcaatggcatggtcttggctcactgcaacctctgtctcccgggttcaagccattctcctgcctcagcctcacaagtaactgggattacaggcgcctgccaccatgtctggctaatttttgtatttttagtagagacggggtttcaccatgttggccaggttagtctcgaactcctgacctcaggtgatccacctccttcagcctcccaaagtgctgggattacaggcatgagccaccacacctggcctattttgttgttcttgaagtaaataaggaaaaaaattttcaaaaccagttaatttgtttattgctgctcttggatttatgacagctggtatccatgaagccaaacgctgtcctgacagtgtgctggcacactgacaagctcacgtgctagagagcaatttttttttttttgagacggagtctcactctgttgcccgggctggagtgcagtggcacaatctcagttcactgtaacctccacctcctgggttcaagcgattcttgtgcctcagcctcctgagtagctgggactacaagcatgcactaccatgctgggcttttatatttttagtagaaatggggtttcaccatgttggtcaggctggtctcgaactcctgacctcacgtgatcccccacccccgcctcagcctccaaaagtgctgggattacaggtgtgagccaccgtgcccagtctagagtgcaaatttgaacatgaaatgcccttgcttaaaaaccccaatggctcccctttgcctaagtaccagggacaaattttaatcttcttagtatgctattgtgaaagaaaaaattaatcataatacttgttaaagatggtaagaaatattcaaggggagtgtaggagaaagaaaaaatcttttccttctaccctttttggtcctttgctggggctctgtaacaaaagacagattaataagagaaaagcatactttttttttttttaagacagagtctcactgtcgcccaggctggagtgcagtggcgagatctcggctcactgcaacctccccctcccaggttccagtgattctcatgcctcagcctcccgagtagctgggattacaggtgtgtgccaccacgcctggcgaatttttgtatttttagtagagacagggtttcaccgtgttggccagactggtcttgaactcctggcctcaagtgatccgcccaccttggcctcccaaagtgctgggattatagacaggagccactgcctacaaatttatttaatataagtcttatgtgacatgagagccttcataaggaaaagaagccccagaaaaatagttagacatgtttttactaggtttgatgaagagtaaaaaatcatgggaaaagggtatgatctaagggtaataagctgggggagacagcaaggcctccccgctcagattcgtctcagtgttcctgtcttcacagacaagaacactccttcctctgggcataaggaggttgcctctcatatcaggggcttatgaccttcttgaggggaaggtcagacagtccttcctgcacctgctctttctcagatttcttcggcttaaaatactcaatatgccaaggtgtcatattttggggtaggatgttctgaaccgcatcatagtagtggctactacaatggggttttgtagtatgggctagagatggggctcaaatctagggacaataagcgaaagtggaagtttatagccaagaaacaaggtaggggaatcaatggatgcaaaatcactaggaagtagggtaactctttgctaaactgacttaacaagatttctgctaaaaggaagcaagggtaagaagatgttgacggtggtcagaccgagaggaggattccactaaactctctcagtaggattcttaataaaactggagtaagcagacctagacagagccaaagattgggcctagtcaaaaggaggacccagaggagcctgactagggcccggtcaaggagtctgtgttcatgtgaacttctgattttgctccattacgcttttccagcctcatttccagtcattagagcctgtggattctatactgatgtcattgcaaacttcccgtctttccctgaacatatctccaggtcatcccaacaattctagaattccttagtgggcagttataatctcagaggccaggcatagtgacacacccctataaccccagcctttgggaggccgaggcaggcagatcgcttgaggtcagtaatttgagaccagcctggccaacatggtgaaaccctgcctctaccaaaaaatacaaaaattagctgggcatggtggtgcacgcctacttgcaaggctgaggtgggagaatcacttgagcctgggaggtggaggttgcagtgagcggagatcacaccactggccctccagcctgagccacagagtgagaccctgtctcaaaaaaaaataaataaataaaaataaaataaaaaacagggccaggcacagtgtctcacacctgtaatcccagcactttgggaggctgaggtgggtgaatcacttgaggtcaggagttccagactagcctggccaacatggtgaaactccatctctactaaaaatacaaaaattagctgggtgtggtggcaggcgcctgtaatcccagctactcagaaggctgaggcaggagaatcacttgaacccaagaggcggaggttgccgtgagccaagattgcaccactgcactccagcctgagcaacagagcaagactctgtctcaaaaataaaacaaaataaaataaaatgagagagacaaaaataagagaaaaaaaaggaaaaagttatcacctcagagcacagaggaatagaaaacattggggaaactgtgatttaggaaacagccatctccatgtgggccttccgaatagctttccgtatttgacagttccccaaagtaatcattcctttgctgagtccttaatagggcagctgcccactcaccggccgtgtgccctggcatgggactgaatcagcctgcaggaagttaggaatcatatccttctgcaatttgctaaaaagaaaaaaaatgctatttgtagagcagaggttctgcctcagcacttggttcagttctgctccttcctgagaggtttcttacacatagacccccccgcaaagattattactttccttcacttttgtacttcttactataatagctaagataaattttatacaacgtgctttaaacaagattgcatttaatccttatgagagccatgtgaaaagatggctcattttatagatgataaacgtaggtttagaaaaattaaggatcttggtcaggtgcagtggctcacgcctgtaatcccagcactttgggaggctaaggcaggtggattgcctgaggttaggagttcgaaaccagcctggccaacatggtgaaaccacgtctctactaaaaatacaaaaattagccggacgtggtggcgcatacctgtaatcccagctactcgggaggctgaggcaggagaatcactcaaacccgggagacaggggttgcagtgaaccgagatcacaccattgcactccagcctgggcaacaagagcgaaactccatttcaaaaaaaatagaaaagaaaagaaaaaagaaagaaagatagattaaggtcagaatcaggactccaatgtgacccaaacccactcaagtaaccatcctccacactgtgttttgaaacccagtatttaagagtttggaaaaggttagttttgggcttatttttggttattgttcatttgttttgttttgcttctaatcttaaatatataaaattaaagtaagaagagttagaaattccctccaagagtcaaaatatttctttgtcaaaatattctttctatattttttcttttttttctgtatttttttctaatctttgtggctaccaggaaatatttctcaatggaattgatggagcaagagaaatttctaggctctttatatttgagggatgagaaaaagatctaaaactaaacagtcatactatttggggggaaagaaaaatgatcacctaagtactattttggaatgacagatattatttttgaaatccggctgggcacggtggctcacgcctgtaatcccagcactttaagagcccaaggggggtggatcacttgaggtcaggagttcaagaccagcctggccaacatggtgaacccctgtctctactaaaaatacaaaaattagccaggcatggtggtgcacacctgtaatcccagctacttgggaggctgaggcaggagaatcatttgaacccgggaggcaggggttgcagtaagctgagatagcgccactgcactccagcctgggtgacagagtgagactccgtctcaaaaaaaaaaaaaaaaaaaggaaaagaaaaaaacgattccatttggggaaggaaaacaaagaacttaccacactttttgctatgacggtgtttagaagcagctctgaatggaattttagatttgtgaactattttctgactcctgaactacttttttttccccaacccttttccacagctcaaccctcaccctcccagaatgcctgctgtccattccctggcatgtgcaggaggcaggaacaatgcagttcccagtgggtgcctgccagtgaaggtgggcttctgtccatctgggcgaggacatcacttaggggccatcagcttgtgtcaaaggaagggtgttaaaatttttcttctccctcctgacttgcttaaaaaccatccagaccataccatttttcttaatttgcactgggtggacgataaataatctttcttcctttttaattttgccgaaccctgcccagaaagcagggcaaagccttgatggtcctggggccatttcccagcacctcccagggagctctaccagaccacggtgactctgagtgacaatgatgggaagtgatcttcatccacgaaagggccagtttgaggcctctcggggcagttacatcccttggactcccctgtaaagttcccagagtttcaaatttctgaaagatgaataccatgcagtgttctccagccccaacactaattttctttacctccttttcccttgaatatttttactctttctcaccatctgcattcctatgaagagaggtttccactcaattctgctttaacatgctcttttctgagtgtgggcagagtcttctctgtggcttagtggttttgaatgctaaacagagcaggagacaaaagttgatccctggctctgtaacttatatttatttctctagtttcttacgtctggagcctccaggaaaaaaaaaaagtgtgttttgataaaaaggaaggagtaggtggattagatgtgaaacaccgtttctgaaagcaacaaggtgtcagaagtcagaaggcctgggttccagtcccaactttgccattaacttgcatcagtgtggcttgtcatttagctgcctgatgtataagataaagtggtcaaatgagaagtggtactgaactatatctatatattatataatatataatattattttatataaatataatatttatatatataaaatttatatactgaactatatatcatataatatatattatattatataaatataatatatattatatactatataattacaatatatattatataattatataatatattcaattatttttgaaattgaatattcaattttgaattagaatatatttgaaatttttgaaattaattatatataatctataatatatcatatgatatattttatataatatatcatatgatatatattttatataatatatcatatgatatatattttatataatatatcatatgatatatattttatataatatatcatatgatatattttatatatatgtatattaagacagagtttcactcattgcccaggctggagtgcaatggtacaatctcggctcactgcaacctctgcctcccggattcaagcaattctcctgcctcagcctcctgagtagctgggattacaggcacccaccaccacgccaaactaattttttgtatttttgtgtctttgctagagatggggtttcaccatgttggccagcgtggtctccaacctgacctcaggtgatccacctgcctcgacctcccaaagtgctgggattacaggtatgagctactgctcctggccctgaacaacatttagaagcacaaattttaaagcagacagatcttcagtttaacaccggctgtgctaattattggctgtatttctgcagtcaatttctttgacttccctaagcctcagtttcatcatctataaaatgggaataaaaatcatacctattgtatggggttgtgtaaggattaaaaaagatgctgttcacagagctcttagccagtgttccatataagtagctattagtataaaagtttcataaaattcttcccacctctatatattttaatattcaatttgagaaaaaggtcaaattagttgtttgacagatactgatgattaaacttttaattatttttcactttttaacttgcagtctttttctttttttttgagacatggtctcaccatgttgctcaggctagaatgcagtgacgtgatcatagctcactgcagcctctacctcctgggctcaagcaaaaatctcacatcagcctcccaagtagctgagactacaggcttgtgccaccacatctggctactttttatttttggtagaggcaagatctcgctatgttgctcaggctggtctcaaactcctgggctcaagcgatcctcccacctcggaattacaggcctgagccaccatgccaggattacaggcctgagctaccatgctggcattacaggcctgggccaccatgccaggattacaggcctgagccaccatgcccgccttgtagtcctactttgtttttgtttttttaaagaagtcccctttcttcctggttggctgagttgttttttttttttctttttttaatcatgaatgggtattcaatttgttaaagtctttttcttcattcttcatctcctgaaatgatactgcttttctccttcatcctataaatatggggaattactatgattaattgattttttattgttaaaccaaccttatattctgaggataaaacctacttggtctgatgtattacctttttttttttttttttgagacagagtctcattctgtcaccaggctggagtgcaatggtgcgatcttggcttactgcaacctttgcctccctggttcaagtgattctcctgcctcagcctcctgagtctgggattacaggcttgcaccaccacgcccggctaatttttttgtattttcagtagagacagggttttgccatgttggccaggctggtgtcgaactcctaacctcaggtaatccgcccaccttggcctcccaaagtgctggaattacaggcgtgagccaccgtgcccggccacgttactctttatatctactacttggtttgattttgttaagggatgattgcatgtaagttcatgagtggtactggtctgtgattttcttttgtgtgtatgtcatatctttatctgggttgttgggattggagtaatgctgataaaatgaaaaggaagtgctccttttctattttctcaaagagtttgggtagaatcactatcatttctcctctccgaaggatttagttctggcttttaaatgtggaacaaactgccccttttagtcctccctccctccacgtaataagtcttaattactaatatggaaaataagtcattataaaaagaggtgggctgggcgctgtggctcacgcctgtaatcccagtactttgggaggccgaggtgtgtggatcacttgaggttaggagttcgagaccagtctggtcaacatggtgaaaccccgtctctactaaagatacaaaaattagctgggcatgatggtacatacttgtaatcccagctactcaggaggttgaggcaggagaatcacttgaatccaggaggcgcaggttgcagcgagctgagatcacgccactgcactccagcctgggtgacagagagagactctgtctcaaaaaaacaagaaagaaaagaaaaaaaaagaaattatttaaagatggaattatatgttcatagtttcctgtacttttcctttatagcatttatcacatttatacacttaattatatttaacttatcacatttaatataattaaattcttataattatttctctcattactatgagtctttttcatacaattataagtgtcatgagggaagagactagttctgttttctttcttttttttttttaagatggagtctcgcactctcgcccaggctggagtgcagtagcgccatcctggttcactgcaagctccgcctcccaggttcgtgccattctcctgcctgagtctcccaagtagctgggactacaggcgcccaccaccacgcctggctaattttttgtatttttagtagagacggggtttcaccgtgtttgccaggatggtctcgatcttctgaccttgtgatccacccacctcggcctcccaaagtgctgggattacaggcgtgagctactgcacccagcctagttctgttttcttattactgtcttcataaacttagctcaagagtagaaaggcaggagaccaggtgcagtggctcacacctttaatcctcacacactgaaacgctgaggctggagcattcttgagtccaggagttcaagaccagcctgagcaacacactgagactcccgtctctacaaaaaataggactggtaaatagttgattaatatattgataaattaattaatacattacttaatattttcagatgaacttcccagagaatttgcatgtctctctgaaaacttaattaattcggcttacatccattgagggcctatttggtgacaagcactgtgtaaatacaaagaagaattgaaaagaatggccctgcctggggaatttaacatgcagtaggagaaaagatgagacactatataggcatgacaaaatgtaagatctattacagaagtgtctacagagtattataggaaaatggataaaaaagaaattcatgctattcaggcgaagcaatatattcaggctggccccttggaagagaggaaaagattttctaagcagggagggtgaggcaatgagcagtgtgagtagcacatggtgggtgtggctaagaagttgtctttgttatactctagcccagcacattgtccagtgggtgcttcctatgtgctcctgctgtgcgaagagagagcagaaagcaaagagagtgggctgggcgcagtggctcatgcctgtaatccaagcactttgggaggcggaggcgggcagatcacatgaggtcaggagtttgagaccagcctggccaacacggtgaaaccccgtctctactaaaaatacaaaaaaattagccaggcgtggtggcacatgcctgtaatcacagctacttgggaggctgaggcaggagaatcacttgaacccgggaggcagaggttgcagtgagctgagatcgtgccactgcactccaggctgggcaacagagcaagactctgtctcaaaaaaaagaaagaaagaaaagaaaagaagaaagaaaggagggagggagggagggaggaagggagggaggggaggggagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaagagtgaagtgctggggaacgtggccccggtccacatcctgaagaaccttgagtgttcatgcaggagtctcctcttgatcttgtaggcagtggtaaggccactcaagattaagtagggcagtgctttgcaaacttctccatgagtgcttctaaaggcagaggagtgtacatgcggaccttggagatttgggacatagcccagaacaaattgcatttctttaaagtcttgctttagcttaaaaatgcatataaggccaggtgtggtggctcttgctcttaatctcagcactgtaggaggccgaggcaggcggattgcctgagctcaggagttcaagacccatctaggcaacatggtgaaaccctgtctctgctaaaaatacagaaaattagctaggcatggtagtgcacacctattgtcccagctactcaggaggctaaggtgggaggatcacttgagcttaggaggcaaatgttgcagtgaaccgggatctcaccactgcactccagcctgggtgacagagccagaccctgtctcaaaaaagaaatgcatttaaattttgtattccactccatatgtatatatttaaatacagggcagtgttttcaattacttatttagtaaactgacactccaagaaaatattgattacataattattttagaatgctatatgtttctgtctcactgcccaagaccctcagggatatgtacgcatttctgagaaggacaaaataaggagaatatccgttttgttcactgctgtatgcccagcgctgcagatggtgactgacatatagcaagtgttcaataagtatttattaaatgaatgaacgacattaaatgactggttattctaaaaagtgatgtaagcagatggttgttagattattgcagaggcaaaatccagagaagtaggatttggcccttctagtctctgctgccagatagtcctgcatgctgaatgaaatacatccaactacctaatgatttcaattcactcacctgtgacaccacagcccaccaaaaatcttggatatttaagaggggttttgtggggtaggggtgaaatagatctctgcttgcctctggattaatctcaaagattagcaaaccaatcaactgggaaaaccgtaagctgtgcgtggtagttcatgcctgtaatcccaacactttgggaggccaaagcaagaggatcacttgaggccaggagttcgagaccagcctagggaacatagcaagacccccatctctacaaaaaaagaaagaaaaagaaaattatagataaaagcggacacttgttgttaaactaaaaataacaaccaaaaaaatataacagggctgttctctgtaggccaattccaataatatttacctagaagtttccttctcctaactctcccatcaaatgaatcgctctctcctcactgctccttttctctttcccttgcagtctaaccctgagtaatgagttcattcccacccaatcatccagagctcgttcctgcctttctcctttgcattttccctccatttgtctctcatgtctcatttcctgcactgattttcatcatttatgggtcgccatctcctctgagctgccacagcattagaggtagtgtcaattttgtgctgtcttaaagtatttgctaattttttcacatgccttacaactacactggatgctacatgaggacaggagtcaggaattgtgtatggattgtgtctattctcacattttccacaaaatccctgtacaatgctgtacataatacatggtctcattgcgggttccctgattgacacaggaactaatggtgaaggaaatctgcctgtgtgtacgccgcacttcctcatgggactcgccaccaatttctcatgtacaaaaaccttggccaggcacagtgggattacccctgtaatcccagcactttgggaggctgaggtgggcagatcacttgaggccagcagttcaagaccagcctagccaacatggtgaagcactgtctctacaaaaattcaaaaattagccagtgtggtggcacatgcctgtaatcccagctacttgggaggctgatccacgagaatggcttgaacccgggaggtggaggctgcagtgagccaagatcacaccactgcactccaacctgagtgacagagcaagactctgtcttaaaaaaaaaaaaaaaaaaggaaagaaagaaagaaagaaaagaaaaaaatcttcagatctctgctagaattctgcagagttcacgtgcctggaagggtcacagctgggcaatatgatacgcccagaaaagctgattcctggactagaaaccagagtggcttagtggcttttaaagaccacagagaaagcgaaagatttaaacaaatatttttcctaagaaggcctcggtgtctggtagggtttccaagctgcaaacacagcaaaagggatgagggtgcaagaacgagttattttgagcagagcaggccttcgtttctattggacatgaaggcttcatcctgagcatttgtgtacttctttaatttgttccgaaagccttgattcatttcccttagtctgaaccaaaatagcttaaatacaacatgcctggtgagtagaaagaaaggaagaaggaaaggagggaagacagggaggaagagagggggaaagtaagaaaaacacaagacatgaaaacaaaatcccacacacgttttctctttgggtttcataggtcaaaattagcaaaatgagtggcaatttcctcattcctgatgaaacttgctttcacgtttctctgctacctttttcccagataaggttctcgggataagagagagcctattgggaaataaaagctttttctccttttctatcatgctgagcagagggtgtcgcaacagaaaagctttccagtaggagtgtggccaccgtgtatcccacatgagcttcctgagtacacggacaagctgttctgtttcccggaggactgtcctatctgtcccagggttagagagccaatatcacagtcagtatcgcagtcgacagacacaaccctgccaatgatgactgtctgttgaacaggggaagtgggaggataaaaagccacagatctaattaaatattttgttgctttcaaaaatggagcagagtacctggcacagtggctcacgcctgtaatcccagtactaggaaagcttgagagggtctcttgaacccaagagttcaagaccagcctgggcaacatagcaagaccctatctctaaaaaaattaaaaaataaaaacggagcagagaaaatgtctatagtctagaagacagtacctgccccctaaatcacttacggatattttaggtaatgtggtagattgaacacatgtatttttctctgtttcctccccaaaacccactaaaatgaaagtaaagggccagacacagtggttcccaatcccagcactttgggaggccgtaggcaggcggattgcttgagtccaggagttcaagactagcctggcaacatggcaaaaccccatctctacaaaaaatacaaaaattagccggacgcaagggcacgtgcctgtagtcagtaccagctactcaggtggctgaaaatggggaaggaaataaaggtgaaagagaaatgtcaacaaatgtttggctgatgaaagcaggtggaagagaggtaactgacttaccaaaacacagtggctgaaaccccagtggttataagccagtttattaaaaggctcaaggactggaatctgtataggtatactcctgacccactaaacccacccagctcagagaacattggcagccattacccacctcccactgacagatatgtgattttaaaatttttctctggccaggtgaggtggctcacacctgtaatcccagcactttgggaggccaaggcaggcagatcacttgaggccaggaattccagaccagcctggccaacatggtgaaaccccgtctctactaaaaatacaaaaattagatgggcctggtggcacatgcctgtagtcccagatactcaggaggctgaggcaggagaattgcttgaacctgggaggtggagattgcagtgacccgagattgtgccactgcactctagcctggacgacagaacgagacaccatctcaaaaacaaaacaaaacaaaacaaaacaaaaacaagaatttttctctggagtaattcaacagcttcagaaaaaaggcctacagacactgacgttgggaatcccacaatcaaacagcctacaaagaagcccactgtacaagtcctgctcattctcagcatatccaaacagcttttttttttttttttttttgagacggagtctcgctctgtcgcccaggctggagtgcagtggcgggatcttggctcactgcaagcttcacctccagattcatgtcattctcctgcctcagcctcccaagtagctgggactacaggctcctgccacaccatgcccagctaattttttgtagttttagtagagagggggtttcaccatgttaccaaggatggtctcgatctcctgacctcgtgatcctcccacctcggcctcccaaagtgctgggattacaagcgtgagccaccgcgcccggccccaaacagctttttagtatctctgaatataacatgagacgtttgagaaaagtaagagaaaagcgaatagaaacaaagactatgcaaggaaccctgtgattaatatcctgagagacataatggaagacactgtatccatcaaacaagaataggataataataacaacaataatagcaaaatttattgaacatttactatgtttcagacatgtattaaaactaactcgattctcataacatgctttaataatcatcatttaatcatcaaataattgaatacaattatttcctccattttatagacaagaaaactaagagaggataaagaacttgcccaagcttgtagaactagaaaataatttttctggtatttgaattgctgattttaacaattatcttataatgccatccaagagatctcttgacaaactcttggaacaactcaaccaaacaacatgagagaaaagatctaaaaaaaaatagaggatcaatccaggaggtccaacatctgaaagatgggtgtatgaaaaagaagggaaaatgacatgaattatttgtatttttatttagtattacttttatatttttgtggagatggggtctcactgtgttgcccaggttggtctcaatctcctgggctcaagcaatccttacacctttgcctcccaaagcactgggattagaggcttgagtcactgaactcagcagaattatttttaaatagtacaacaacatttcctgacatttaaatgagtctttagattaaaaggcacatcaaaataagtgaatgggaaaaagtcttataccaaaacccatcatagtaaaattttacaactccaggaataaagataagaccctatgccaggcgcggtggctcacacctgtaattccagcagtttgggaggccagagtgggtggatcacctgaggtcaggagttcgagaccagcctagccaacatggtgaaaccttgtctctaataaaaatacaaaaattagctgggcttggtggcgtgtgcctctaatcccaactactggggaggctgagacaggagaatcgcttgaatccaggaggcagagattgctgtgagcagacattgcaccgctgtactccagtctgagcaacaaagccagactcagtctcaaaaaaaaaacaacaaaataatgtgagacataaaatgcatatgaactggtaggaggaaaactgagggtcactgtgagacagacttacttttcactgtatactattttgttctgtttgaatgtttaccatatgcttacattacgttattcgaaaaagctttttaagggatgctaataattaattagatttgtgaactgcccatcttagatattaaagtacttgggtgatttcttgttcttcgttacccctgtaagcacaccaggtctacaggaaaggcagtcagccagaactggtttgatgctctgatgaaaacgcaaagatcagccgggcatggtgaataatgcctgtaatcccagcactttgggaggccgaggcaggcggatcacctgaggtcgggagtttgagaccagtctgaccaacatggagaaaccccctctctactaaaaatacaaaattagctgggtgtggtggcgcgtgcctgtaattccagctactcgggaggctgaggcaggggaatcgcttgatcccgggaggtggaggttgtggtgagccaagatcatgccattgcactccagcctgggcaacaagagtgaaactccatctcaaaaaaagaaagagagagagagagagagagagagagagagagagagagggagagggagagagagagagagagagagagagagagagagagagagagagagaaagaaagaaagaaagaaagaaagaaagaaagaaagaaagaaagaaagaaagaaagaaagaaagaaagaaaagaaaagaaaatgcaaagatcacctggaagacaatcccctggcaagacaaactcaagactcatagttaggtcatttgagtaaatacatgagtgaatgaatgagtacgtgagtgtgaggcagccatttgagtcatttgggtgtgagggaaggacaggaagaaagtaaagtcaggggaaatgacttggcattacaaatcctcccttgctgagacgcgacattttctgctgggatataaactgggtgtcggagccaaattgcaatgccaggtctattcttgccactttaatgagaaaagtggaagtctgggttagtccatttatctgcataccatcatttagttgcatacagatcgaggtccaggtttttaattgccctgatctgtctctggcagaaaagaagctccaatattttctttgtcaagcatgagctaagtttgattatagttctgctcacacatttgatgtaagaagcagattaaagtttattgcagtcttggctgggcttggtggcttatgcctgtaatcccagcactttgggaggccaaggcaggaagatcacctgaggtcaggagttcgagactagcctggccaacatgttgaaaccttgtctctattaaaaatacaaaagaaaaattagccaggcatggtggtgcatgcctataatcccagctacttgggaggctgagacaggagaatcgcttgaactccggaggcagaggttgcagtgagccaagattgtgctactgcactccagcctgggcaacagagagagactccatctcaaaaaaagaaaaaaaagtttattgcagtctttgcgaacctatacactggttgttttaaagccacttaaaaagtgtatattaaatgaatggtatgatgcatatggtcagctttccatgaacacattcataagaatatattccaaagatttctccccagtgatcataggtgagtagcatcagtgtcttggaggaagaccgccacattctttagtgctgtacacaaatgccataaagagagtgaattactgcctttcatattctacctgccatactctttgaagataattccttttttcctgctaagatcaggatggtacagcttttgtaaaaattgccctatgacaaattacaggaaaatttattatcagggtggcacgcacagcattatagtttattgtatttatagcggatgaaaggtctcagccaggcatggtggctcacgcctgtaatcccagtgctttgggaggccaaggcgagtggatcacctgaggttaggagttcgagaccagcctggccaacatggtgaaaccccatctctactaaaaatacaaaaattagccaggcatggtggcgagtgcctgtaatcccagctacttgggaggctgaagcaggagaattgcttgaactcaggaggcagaggctgcagtgagctgagatcgtaccactgcactccagcctgggcagcagggcaacactctggctaaaaaataataataaaaaataaaaaataaaaaattttttaaaaaagataaaaggtctcaagtcaaacttagttgaaattttggctctaccaattattatctcttagatcttagcaaataggcctttctaagtctcaggttttactctgtaaaatgaggcaaaattttgctttgtaggattgttctgattaaatgaaattatatatatacatatatatttatatcccttagtgcacagtgactggtatattatatgcattttacaattttcagagtattatcagataatactgtgaaattagtatttcagagtattcagggtggcacccgccaccactcctggctaatttttgtatttttagtagagatggtgtttcaccatgttggccaggctggtctcgaactcctaacctcaggtgatccactcgccttggcctcccaaagtgctgggattacaggtgtgagttaccatgcctggctgagaccttttatcctctataaataatataaactataacgttgttcatgccaccctgataatatattttcctggaatttgtcatagggaaataacactaaactacaattctcacttattctgcataataaaactcaaaatatgtatgaaaaagaattgtgaaatctgaaaagtgctttgcaaacataaaagtggtcatatcaagcttattacatttctgtaaaacagaaagaagaattcatgtcataacctactcttacgagatgttgtggttgccaaaaatctagtgaattgtgaaagcatttttaattctataagaagacaatgattgttattgtgagtggggaggcagaggacacatatggataatttttaaggctttatttatttatttatttttgagatggagtttcactcttattgcccaggctggcatgcagtggtgtgatctcggctcaatgtgacctccacctcctgggttcaagcgattctcctgcctcagtctcctgagtagctgggattacaggtgcctgccaccatgcctggctaattttttgtacttttagtatacacagggtttcatcatgttggccaggctgctctcgaactactgatctcaggtgatccgcctgtctcggcatcccagagtgctgggattacaggcgtgagccaccatgccaggcctttaaggctttattaaagtgtgtggtaggcagcctttaagattgcacctaatgattcctgcctcttaatattcctctcttcttgagtgtgggctggaattattgaattgcttataacaagtagaatacggcagcagagattagacgtctcctctgagacgtctcatcttgtgctcttttttgcatcacctaccctgggggaagccagctgccgtgtggtgaggcagccctgtggagaggtccatatggtgaggattgaaagctgctaacaacctcatgagtgagtttagaagtaaatctccctccacctcatgcgagccttcagatgagactacaaccccatccaacagtttgtatttcatgagagaccctgagtcagagccacccagctaagccatgctcagattcctgacccacagaaactatgagataacacgtttattgtttcgagctgctaagttctgggacaatttggtatgcagcaatagataatataaaatataatatacatacagaagaacacagccatcataaagagctcaacaaatttcgtgaaatggtcacacccaagtaacaagcacccaaatcaagaaatagaaccggcaccttggaaggccccaccatgttcccttatattcactactgcttactccaggagtaaccactacctagacttctaacagcacagattttttttttctgtttctgtaccctggaatcatatagaatggaatcctatagaatgtactcttttgtgtctacttgtttctgatcagcattacattaatgacatgtagtttctgaaagcctactctaaaatgccattgttgaatcataatatttaatctattccaaataacagtaaagaagactgtgagtttatatatatgtaaaaaatgggagtctaagtaaagaaaaataaattgaaaaacatttctaggccaggtgcagtggctcacacctgtaatcccagcactttgagagcctagaaaagaggatcgcttgagcccaggagttggagaccagcctgggcaacacagcaagaccttgtctctaccaaaaaaaaaaaaatttaaattagccaggtgtgctggtgcacacttgtagttccagatgctcaggaggctgaggcaggaggatcgcttgagcctaggagattcaggctgcagtgagctatgatcacaccactgcacttcagcctgggcaacagagcgagaccctgtctcaatatatacttttttgtagatgaccaagagtagaaaacatgaaggtgaaagctttaaggggaatccagagcaaaaaatttgtgttagctacctatactgggtagcagtccaatatactgttcagggtataggtcttagagttaaatggctggattagaatagtggctcaattcctcgtaatctgtgcgatcttgggcaagttaatctttctgcatttcagtatctgtctgtagaatgaagataatagtgcttacttcacaagattattgagaagatgaagaaatggaaatgaatataaatcaagtaccaatgctttgcacataataagtcctcaaaaattactattattaagaagtgttacatttgggggttttaaaaattataggttgccaaatttgtactatctgtgatttttatcatgtaggacatgattttcctgtgagtagaaaatgcagggctgggagtggtgtctcacgcctgtaatccttgccctttggaaggccaaggaggaagaattgcttgagcctaggagttcaagaccagcctgggcaacacagtgagactcccccatctcaaaaaaaaaaaaaggaaggaaggaagggagggagagagggagggagggagggagggagggaaagaaaatgcagctccttcaattctttgtttcatggctcttctgcccctccttagggagagtgaatgagaggagcagggatgaagttcaaaccagtcatcttctctcttcgttattagctttgataggaaagtggaaggggcaggataaaactaaaggctgaattgaggatttgtcagtggattttaattatcaacataatctcaattcttcctggccatggatccctaacaatcgattattttctttttcatagtaagtctgtgtctatttttaattcccgccccctctgcctctgttcgaatctctctgacgaaggtaataaaagatttagatttagaaagcgacttcacatttggaacgagacagcgactataaatagacatgtcaatgaaataggttagcatgagatctggatctctgagagtctcggaatcaaaagcatacattcttgcctgatctgtgtactggcacaggcattcttgccagggtgttcaagcagttgtgtgtgtgtgtttctgcatgtgtaaacatgaatacatgcatggaaccataaatagcatattatcaaggacagaattcagagaggtacctgctgtatttctgaatggtggagtgatctttgtggaccagattgttatccttatcctgacaattattactggagaaatcaacacaaaacattactcccaaatagtcaacccccagtctgtagaatagcagtgcagcttccaggcacagtatgttttattactgaccatcctccttcccaccaccagactttgagaacctatcaggacgaagggtccacagtgatgttccgatctgccaaacgcagaagtcagcttggcaactggtttgctaatcactaaggctgccattcagtctggaaggtcatcgcctgccaggtatagctgctaaaattctaacgtactcttcaaggtctgggataaacatttcttttactatgaagccatccctgatcacattagtgatcttcctccactaaattcctaaaacagtttgactcttacacaatactgacgatcgtacactgccttgaactgggtgcctgttttgtgtctctatttgattgtgatctcttgatacacaaaagacaatgtcattcatttctgtatccctggcagcacctagaatggtaacaggtgctgctcacatttattgaacaaatatgcactccaggttactcacctctgggtgccaattattttgtcaatgtacctgctaatttgtggtacccacaactggaagcataaggggtgtttaagaaaatgttgtagcatcagtatccttgaatatgttatgatatacaataattaaaaattgggtactgggtgagtgtggtggctcacgcctgtaatcccagtactttgggaggtcgaggcgggcagatcacaaggtcaggagatcgagaccatcctgcctaacacggtgaaaccccgtctctactaaaaatacaaaaaattagcagggcgtggtggcgggcacctgtagtcccagctatgcaggaggctgaggcaggagaatggcgtgaacccgggaggcggagcttgcagtgagccaagattgcgccactgcactccagcctgggtgacagagcgagacttcgtctcaaaaaaaaaaaaaaaaaaaaatgggtactaacagacctgtcaagatcttggaaccgttttgccgtgatttcagatccccagtgacaataagagaatgtaaataacttgatacatttcagctgcctagttttaaatatgaaattggcctgcagatggccgagcacagcggctcacgcctgcgatcccagcactttgggaggccgaggtgggggggctcacctgaggtcaggagttcgggaccagcctaaccaacatagtgaaaccccatctctactgaaaacacaaaattagccaagcgtggtagcgggcacctgtaatcccagctacttgggaggctgaggcaggagaatcacttcaaccctggaggcggaggttgccgtgagccgagatcacaccactgcactccagcctgggcgacaagagcaaaactccgtctcaaaaaaaaaaaaaaaagaaaaagaaaaagaaagaaagaaattggcctgaaggcaagatagtgaccaaatgaccttctgtgggcctgcccaagcttgagattctacattacatatagtcagagcattccagggtttcgtaatttactggcctagaacaaaaactaaactttaagcttgaaagagccttcagagttattttgccaattccttaatctccctgaagccattggggcagacgtgttccgttcctcgttgccttttcttattaactatctagaggccatagttgaccacatctgatgaattgatttgtttcataataaattccacaattaaaataagtttttttccgagccaggggcatcacttgagacccagagttcaagaccaacctggccaacatggtgaaataccgtctctaaaaaaataaataagtcttttttggtcttagacaaacaaagtaaacatctgcttcagttggaataagttaaaacagtgatcttaagttattaaagtagtgtacgtttctatttcctgggaaaagttcctctcaaatgcctaaccgtattttctaagattttcattttttccatgggcctttgaacattcaatgcacgtggttggaaatttagcacataaccacaaatggcagcaaagtgcttataagcttaaatccaaagtagtctgtcattctttgtccattagaatccttgttactaagaataactaccttaaaggtgaggcctggctaatcctccctaagtaaattctgcccccttgtggattaaaagagcaacagaaaggaaagaaatgctgtagttggatgggccagttcttttcagttctttgaaaaagcgcttcaacaatcttgaaaagtcccttcaacaatcttgaaaagtcatgttaataatggaacaaaactatggccgggcatggtggctcacacctgtaatcccagcactttgggaggctgcggtgggccgatcacctgaggtcaggagttccatgccagccaggccaacacggtgaaactccgtctctactaaaaacacaaaaatgagctgggtgtggtggtgtgcatctgtaatcccagctacttggaaggctgaggcacttgaacccaggaggcagaagttgcagtgagcccagatcgtgccactgcactccagctgaggcacacacacacaaaaaccacacacacaatggcacaaaactagaccttttgtataaattgtgtaagcgctcactgatggtgacaaaatacaccgacagtattttacacttgtattttatatttcgcatcacattcaactaagacagggccttgaatatactgagcactcataattattagtagttcatagaatattatagttagaaaagacattaaatattgggtttaacatccacatataaggacccctttacagctactcacacactctcatttgaatgactccagtaatggaaaactcactaaacagtagagctctttctcttatcagacagcgctgttacagagtcagtcaacatattaagcccaaatggcataagccctttccttcctttccctcaacttctcccttttccctcactccttttccccatctttctcctcctctaaaactaacccacagactgggaaggaagtagatgctcaatatccggccccccttgactgacgcccgcagctcaggttgtcaccttggtctttgtaccaacaccatttttttttctttgagaagtttcggtctgttgctcaggctggagtgccgtgttgtgatcttggctcgctacagcctgcacttcctgagttccagcaattctcctgtctaagcctccctagtagctgggattacaagcaggagttaccacacctggctaattttttttttttttttctgacggagtctcgctctgtcacccaggctggtgtgcagtgacacaatcagggctcatggcaacttccacctctcgggttcaagcgattctcccatctcagcctcccaagtagctggaattacaagtgcctgccaacacggccggctaatttttgtgtttttagtagagacggggtttcaccatgttgggcaggctggtctcgaactcctgaccttgtgatctgcccacctcagccccccaaagtgctgggattacaggcgtgagccatcgcatgggcaacaccacttatttcaaggactccaggaagaaatatcccctttggagggatggaaggaaataactaggcaccataatgattccgtaattctgaccaaaggaacaaaatgcagtaaacctattacttgttttgtggccttttaaatgatggaaggtagctacaatgctgccccttggtcttccatcttcataatttgttcacctataactgcattagctgttcctcatatatttttctcaccctatcatttgccggtcatgactccccgaatgcccctttttgtcaatgtccttcccagttttcagcatctaaaactgaacacagttgctctggatatgctaggttggctagtataaagtacaatggagatgttactcggtgtttggaacatcgaacctctataaatgcggccacatcatactggtggtcaataaatctcttggttccccatgtcctccaggtctttcccaccctggacttgtgtctcactgaaactttaacatttgcttccattcaatttcttcttgctttgggtcagaatcccagccagcaggataactatgtacctcaggtgtgtccaaccagattagctctgctacctagctctgtgccatccacatttacaaacatgatctctgtgtttccaatctgccggtttcaaggaaaagacaatcatcttcggtgtggggaaggaaaaataataaaaactagtgatggaatatcggcagtgtggccttagctgtgtggtcatcctcagtcttctcttctctaaaagagttgataacattggctctcacgggctcagatcgataacaaatgataacatttgagtcacgggttcacatgagatcatgcagttgaatcagttaattgttcattgttaaattaatatcaggtgtcaacgatcctcttttgaaggatttgaaggagtaggagagactatcatcacctttgtattcttaacaccatccttgcctgataggtgaaaagctcagtgcagttttttaatgtggataaacacttgcaaagttcctactgagacagtttttcacagaggggaagggaggcaactcaaccattttttttctttctttctttttttttttttttttttttgagacagagtttcactcttgttgcccaggctggagtacaatggcgtgatcttggctcactgcaacctccgcctcctgggtttaagcgattctcctgcctcagcctcccaagtagctgggattataggcatgcgccatcacaacctgctaattttgtatttttagtagagacagggtttctccttctccatgctagtcaggctggtctcgaactcccgacctcaggtgatccgcccgcctcagcctcccaaagtgctgggattacaggcatgagccaccgcgcccagccaagttgatcatttttaatcagtttgtgtttaatctgaaaacttctccaactatcttccatcagtgtcaggttctcccttttcctcattctcctccctcccactctcctcctttttccttctcccatcccccacttcccttcctcttcctttcctttccctcaccttctcccttttccctcattccctttccccatccttctcctcccctaaaaccaacccacaggctgggaaggaggtagaagctcaatatccggcccccctgactgaagcccaaagctcaggctgtcacctgggtccttgtatccacacccctaatattaaggactctaggaacaaatatcctccttggaggggtgggaggagataactaggcactgtattgactcccagatgtctgaaattccactgataacttgcaagcttcattcctttggctttaggctttaaactgtttaagtaccaaatatatgtttgtatttaaaaagacagtaaaatgtcagggatttagcagctcatagtaaatatggtcttcttcttctgaagactctcataaaaggagtggactggagaggttctggggttgggctgggtgtgggattgggaaagcaaatggcagaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgccccttccatctagatcctcaacctcttttcatatctgtcttttcctctaaacaatacttttttttttttttgagacggagtcttgctctgtcacccaggctggagtgcagtggcacaatcttggctcactgcaagctccgcctcccgggttcacaccattctcctgcctcagcctcccgagtagctgggactacaggcgcccaccacctcgccgggctaattttttgtatttttagtagagacggggtttcactgtgttagccaggatggtctcgatctcctgacctcgtgatccgcccacctcgacctcccaacgtgctgggattacaggcgtgagccactgcacccagccacaagtacaattattaatagtagttgccatttgctgagtgtgtgctacataccatgcgccagtgctagacactttcatgcatcatatgtaatgcttacaataacttccaaagttgatgtttttattttccttttacggaaaagtaaacaacttggagcaatcagggaattaattggtcttacagccactactcaagtccagacctctcagactccaaagctcatcctctttctattgcatcatgctgtgtcttgaactgcatacagtgttccataaacaatctggaaggcaggcacgtgcgcgcgcgcgcgcgcacacacacacacacacacacacacacacacacacacacacacctcctacagaattatatatgtagctggggtgaagggaaaacttcccgtctgcccgctgaaggttcattgaaaagcactgacaagaggcagattaataggagaaaaggcatacaaatttaataaactgttcaagagtgtccaatctttttgcttccctgagccacactggaagaagaagaattatcttgggccacacataaaatacactaacaacagctgatgagctaaaaaaaaaaatagaataaaatcacaataaaatctcataatagcagggcatggtggctcacagctgtaattccagcacttcagaagtctgaggtgggtggatcactgaggtcaggagttcgagaccagcctggccaacatggtgaaaccccgtctctactaaaaatacaaaaattagccaggcgtggtggcgtgggcctgtaatcccagctactcgggaggctgaggcacaagaatcgctggaacccgggaggcggaggttgcagtgagctgagattgcgctactgtactccagcctgggtgacagagcaagattgtctcaaaaaaaaaaaaacaaaaaacaaacaaacaaaaaccacagttcctcctgcccatctctttgaagggggtcttaaggttcaggagaatctatgagaaaatgtaaatacggcttggcacagtggctcacacctataatcccagcactttgggagtccaagataggcagatcacctgaggtcaggagtttgagacaaacctgacaaacgtggcaaaaccctgtctctactaaaaatacaaaattaaccaggtgtggtggcgcatgcctgtaatcccagctattcacgtggctgaggcaggagaatcgcttgaacccaggaggcggaggttgtggtgagccaagattgtgccactgcactccagcctgggcgacagagcaagactccatctcaaaaaaaaagaaagaaagaaaagaagaaagaaagagagagagaggaaggaaggaaggaaggaagggagggagggagggagggagggagggagggaagggaaggaaataaatgtaaataccttttagaggataaaactttaaactactcttaattgagtgtaggcagcagtcatgtgagaaaaagtcccttctagcagagatgagcaggggaagagaactaacattttaatgggagactcctatgtgctttcacaatgctagctgctttcctcagtgtcttctttaattcccattttgcggatggaaacactaaggctcagaaggtaattttctcaagctcccagaggtcctttgataagtgcctgaggtgcatgcaaaagctcccacttagggagagcttgcggcttccctgaaggcattctgcctgtgcctaaggaggcagtccttaccactgccaccactcagcacctcttcccataggtaaatgctgcaacagaatcctagcagagactattcccttacttgcaattctgccactaattagttttgtgacgtgacatctcaattctctggggtgcaatctcctcataagttaaactgatgatctctaaagtctttcctaacaaagatgaatcttccagtgcccacgcaatccaaggctagccacaggatggtcagactgcccctttcctctcacccatcagatggcagacaagctcagcagcccccatgagcactgctaagccttggagttaaagacagaggccggacgcggtggctcacacctgtaatcccagcactttgggaggctgaggcgggtggatcataaggggtcaggaattcgagacgagcctggccaacatggtgaaaccccgtctctactaaagatacaaaaaattagctgagcatggtggcgcctgcctgtaatcccagctacttgaaaggctgaggcaggagaatcgtttgaacctgggaggcggaggttacagcgagctgagatgacgccattgcattccagcctgagcaacagggcgagactccgtctggggaaaaaaaaaatagaacccaggaccgggcgcggtggctcatgcctgtaatcctagactttgggaggctgaggcgggcagatcacttgaggccaggagtttgagaccagcctggtcaacatggagaaaccccatctctactaaaaaaaatagctcggtgggtggtgcaaccctgtaatcccagttactcatgaacccgagatcacagcactgcactccagcctgggctacagagggagaatctggattaaaaaaaaaaaaaaaaaaaaaaaaagccaggcatggtggctcaggcctgtaatcccagcactttgggaggccgaggcgggctgatcacctgaggtcaggagtttgaaaccagcttggccaacgcagtgaaatcccgtctctactaaaaatacaaaaattagccaggcatggtggtgcatgcctgtaatccccgctactcaggaggctgaggcacaacaatcactttaacctgggaggcagaggttgcagtgagccgagattgcgcgactgcactctagcctgggcaacagagtgacactctgtctcaaaaaaaaaaaaaaagagacagaacccaggcccctctctgcttaggtgggtttaaaaaagaaaagaaaaaaaagtacagaagaccctttgagcaatgtaaaaaaatgtaaaagctttaatgtaaaaaaaaagaaagaaagaaagaaaaaaaaagggacagaaggagaaggaccttagaaatctgtagaaatctcagtggcctcctggagtctaacgaactgaagttcaaggaagactagaagtgtatgcgccctgatctcatggctccctgccttgatgaagccatttgtattcacagaggggctcctccctgcactgctgtatttaattctggatatggtataaataggacttggctgactgtcaaagcacaccacccgccacaatgttccagttttttggggacatcagacgaatctgagcctttgattccctctagtggcttaaattggcaactttcatagctggctcttggcatttgttattgaatgtttaagtatctattgtatgcactaaattggtgctgggttctctagctctgcctggaatgtagggcactggtttcatttgagcatttttgtgtccggtggaaagtgatcagggttaagccagagctccttcttacaaagctccttcttaacaaagcttagcttagtacagtgcaaaccagtgaatttcccagctattctaaagctgctttatagtaattctgggaggatgggttattatatgggttatttctgccgctaaatgagttgtaggaccttgggctgtctcttttacccctgggtcttagtttgctcattggtaaaaatgagcgtgtgggttacactcagataaattcaacaaatattaattgaacacctgcagtgtgagaccctgggctgagtactatgagaaggcagcaatgaatggtacttgatgtcaaagagcttacaggataatgggagaaccagacatcctggaagccacataaaattgggcaggaggaggctgggcgtggtagctcacacctgtaattccagcactttgggaggctgaggcgggtggatcacttgaggccaagagttcgagaccagcctgaccaacatggtgaaatcctgtctctactaaaaatacaaaaaaaaaaaaaaaaaaaaagctactcgggaggctgaggcaggagaatcactggaacctgggaggcggaggttgcagtgagaggagatcgagccactgcactccagcctgggtgacagagcaagactatctcaaaaaaaaaaaaaacctggctgggcacggtggctgtcacctgtaatcccatcactttgggaggccgaggtgggcggatcacgaggtcaggagattgagaccatcttggccaacgtggtgaaaccctgtctctactaaaaatacaaaaattagctgggtgtggtggcacatgcctgtagtcccagctactcaggaggctgaggcaggagaatcacttgaaccggggagtcggaggttgcactgagccaagattgtgccactgcactccagcctggcgacagagagacactccatctcaaaaaaaaaaaaaaaaaaaacctggaaagatagctcaaagggccaatcttaggttctacaatagtgttatttgcaggaataactagggaagttgcatatcttattttttttttttagagacagggtcttactctgtcacccatgctggagtgcagtggtgcaatcatggctcacaacagcctcgactttccaagctcaggtgatcctcccacctcagccccccaagtagctgggactacaggctgggccgccatgcctggctaatttttgcatttttagtggagatagggtttggccatgttgcccaggctggtctcaaaactcctggactcaagcagtccacccactctggcctcccaaagtgctgggattacaggcatgagccaccgcacccggcctggaagttgcataacttataaccttggagtaatggctgacaatggcttatgcctgtgccttaccaggatttagtctctccttcccagcctgatggcctcccattagctttgcaaaagcggttgagttttgggcaaggcctgttatcatttaaactgtaacctaaatgtcttccaaagttagcttggcccaatagcccaggaataattaagggaaagggaagatccagggagggttagtttagcttactgttataattttcccactgatataacacttgccaaggccgtttcagatgcctctgagggctcctccccagcagtctcagcccaagcagccttgctgcagaatgaagcacaatctcccctgctccattcttcttcatctcatttccctgaaagcaagaataccggaagccattttccttcccacagattggctgctaatcaattttggtaaataaacagggaattagagaattagaaaataaacagggaggccgggtttggtggctcatgcctgtaatcccagcactttgggaggccgaggcaggcggatcacctgaggtcagaagtttgagaccagcctggctaacatggtgaagccccgtctctattaaaaatacagaaaaatcagccggtgtggcacacgcctataatcccagctactccagagactgagacaggagaatgccttgaacccaggaggcagaggtcgcagtgagctgagatcgcgccactgcactccagcctgggtgacagagcgagactccatctcaaaagaaaagaaaaaggctgtttcatattttgaaaccatctgacaggaaactacagagaatggaagatagaacttggggggatacaagaataggtgtctctaagggaggcaggaactccttgtaagagcccacttgttccccaaggtatttctgcactcacagagaggtcgggggcaggcggtgggggaggagggtagtaacctgtctctaggaaggctctaaggagcaacctggaacccagcccgtgacctggtattgaagcctgttttggggaggatgccaagccctgacttcctgtctcagtgggaggaaaaaaaaagtgtttttgggaaaaagcagagaaattaagggacctgagacagtttagcccaggcacaatggatggaacagaagtgtttccaagagcttcatttagaggcacaagagaaatgaaaaataaagaaataaagcaaagcagggctgtgacttcctctaacacaacaactgagggtggacactatttgcagagctgtgtgagcatcagcagtggaaagggaggcgccgcctggggaaagaacacagggatgcctgttggacagatgcctgcatcacaatggacttgaatctaaactcagtgcctaccctccccagctcacccccaaataaaacacatcgtactcctggcttccccatcactgctactgcgatcaccatcctaccagtcatgcaagcttgaaaacaatctttggtttttttttttttttctgagagggagtctcgctctgtcacccaggctggagtgcaatggtgcgatctcggctcactgcaacctctgcctcctgggttcaagcgattctccagcctcagcctctggagtagctgggattacaggcacccacacacaggcccagctaaatgttgtatttttagtagagatggggtttcaccatgttggccatggttggccaggctggtctcaaactcctgacctcagttgatctgccctcctcagcctcccaaagtgctgggattacaggcgtgagccaccgtgccgggcccagtcttcgcttttgaatcctttttctttctcctcttagatccagtcagttactatattccgtagttttgactatcacattacctcgcaaatccatcatttgctttttactgccttcaccactatcctagagcagtatctcttacttggaaaaatctaatagcattttcacaaatgtatgtctcaatatttcccttttcctgtgcattcaacacacaactcctaaattatctcttccttaagcaagagatcatgtcactgtgctcactgcggcaagaaaggacttttatcccatcaactgcttcacttttcccgcataatttgttttatttttccacatttcttcttcacaccagccaagctgaactattaccattcactgaatatctgccccccaccgcctctcccatcctgtgcttttgatcccatcatctcccccaacatctcaacacctttcctcctcctctattctatccacatgaattccattttccaagctccatatcaaatgtcaccttctccataataaaataaattgccttttattcagagccactcagtgctaaacactatgctagatgatttacatactctgtttctaatatttacaaaaccctggaaggatttcagcttttcctgaaccctataattaattgcctataatttctctcctctaaatttgcatagccctttgatcataaataatttccctttatactacagtatttgtgtaattgtcttttcatccttctaaatacatgctactggtcagcaacaactgttactagacttaaagaaagtaagaaggttcatctctaaggttttctccagcttcaaatgactatgactctataacttaagaacatgagtttctgggcaacttagtgcagtttccatgagtatcatcttcttggaagcctctgctaatagaagacagaaagatcaaaaacacagttgtttccaggcacggtggctcatgcctgcaattctagcactttgtgaggccaaggttggagaatcgcttcagcccagaagtaacctgggacctggcataataacagagcaagaccctgtctctacaaaaaattagccagcacggccggacgcggtggctcacgcctgcaatcccagcactttgggaggctgaggagggtggatggtgaggtcaagagttcaagactagcctggccaagatggtgaaaccccgtctctactaaaaagtacaaaaattacagcgtgcctgtaatcccagctacttgggaggctgaggcacgagaatcgcttgaacctgggggacggaggttgcagtgagccgagatcgcaccactgcactccagcctgggtgacagagcgagactctatctcaaaaaaaaaaaaaaaaaaaaaaattagccaggatggtggcatgtgcctatagtcttagcttctctggagcctgaggtgggaggatctcttgaattggtgaggtcgagggtgcaatgagccatgattgcaccactgaactccagcctggtcatcagagagacactcaatctctctaaaaacaaacaaacaaacaaacaggccgggcacagtggctcatgcttataataccagcactttgggagaccaaggcgggtggatcacctgaagttaggagttcgagaccagcctggccaacatggtgaaaccctgtctctactaaaaatacaaaaattagctgggtgtggtggcatgcgcctgtagttccagctactcacgaggctaaggcaggagaatcacttgaactcaggaggcagaggttgcagtgagccgagatcatgccattgcactccagcctgggcgacaagagcaaaactccatctcaaaaaaaaaaagttaacatgagcaatttcattgttcataaagaccaagtaaggtaagaaagacaggcactagtaggatgtaatttggggtggttaaagaagatgtgatgaattcagttaacggaggagccagtgtgagaccaggacttctagtacacctggtctaggactcttgcaacccctccacatgcacttgcccacgggaacatcccataattctttgttgtcatatttgctccccacacattgccatccagtctctgcattactcattaaagattttcctcttccagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtaagtagacacctggctggagtccctcctccttcttgtcctcctgcatttgcctttcttcagtcttccagtctttctttctggctctgaaagagctggagttcctttttcatctggcttctacttgaaagactttagatacaaaactatagagaagaaagagtattgctgggtgtggtggctcacacctataatctcagcattttgggaggccaaggtgggtggatcacctgaggtcaggagttcgagaccagcctggccaacatggtgaaaccttgtctctactaataatagccgggtgtggtggcctatgcctgtaaacctagctacttgggaggctgaggcaggagaattgcttaaaccccagaggtggaggttgcagtgagctgagatcatgccactgcactccagcctgggtgacacagcaagactccatctcaaaaaaaaagaaagaaagaaaaattagccagatgtggtggcacatatctgtagtgtcagccacttgggaggctgaggtgggaggatcacttgagcccaggagtgccaggctgcagtgagctatgatcacacctgtaaatagccactgcacttgagcctgggcaatacagcaagaccctgtctctaaataaataagaagttgtcaggccgggtgcagtgactcacacctgcaatcccaacactttgggagcctgaggggggtgaactgcttgagcccaggagttcaagaccagcctgggcaacaaagtgagactccctctgtaccaaaaaaatttttttaattagccagatgtgatgccacatgcccatagtcccagcttctcacgaggctgaagcaggaggatcgcttgagtgcaggaggatcgcctgagtgcagaaggatcgcttgagcccaggaggtcaaggctgcagtgagctgagatcacaccactgtactccagcctgggcaacagacccagacactgtttctaaaaaaacaaaaacaaaacaaaagcaaaagaaagaaaaaagttgtcctttcctcttctctgtctacaccactaattttataacatggtttatgttgggaagagctaaggttttcactgaaaacagatttcaggatcactattatagtgtaacttgcttaaatagctgtctacatcacctcattatattgatattgcttgtcattttgttctcatacagcaacatcctaagatactatctgttctctgtagagcgaggtcactttaacctgagtaggtttattgatttatttatttttttattttgggacagagtctcactttgttgtccaggctggagtgcaatggctcaatcttagctcactgcaacctccactcacagggttcaagcgattctcccgcttcagcctcttgagcagctgggattacagacgtgcaccaccacgcctggctgatttttgttgttgttgttgtttgagatgaagtctcactctgtcgcccaggctggagtgctgtggtgccatctcagctcactgccacctccgcctcctgggttcaagcgattctcatgcctccaactcctgagtagctgggattacaggcatccaccaccacgcccagctaatttttgtttttttagtagagattgagtgtcgccatgctggtctcgaactcctgacctcaggtgttcggcctgcctcggcctcccaaagtgctgggattacaggcgtgagccactgtgccagacctctgagtatgtttattttaacagcttcttggtcagcctagatttgatactctcagttctgaatgaagtgatgttcatgtttattacagcccatgttcctgtaataaaaatccaagaatgactctgatagattctcttctttgatcacacttgaggcaggttcttgcggtctttctgactagagctaatcttggacttccctctctgccctcgtagaatacattttgagcaagaatgctgctaagtcaggttagtgaaaatgctccactcttggtatcttattaccctatcctgcctacaataataatcctatcaagcaggttcaatcagaaaccccctcatctctgatgttccctcttagtaatttcatgaccctcaccctgctccttggttgtaaactccccttgtacttgctggaatcagagtcaagcccaatctctgactcacaggtcttcatacctattaccatggcgcctcttgaatagtctgttttactatctttaacaagttttggccaggtgcggtggctcacacctgtaatcccagcactttgggaggccaaggtgggtggataacctgaggttaggagttcaagatcaggctgggcaacatggtgaaactctgtctctactaaaaatacaaaaaataagccaagcctggtggcatctgcccgtaatcccagctactcaggaggccaaggcaggagaatagcttggagctgagatcgagccattgcactccagcctgggcaacagagcaagactgtctcaaaaaaaaaaaagtttcactggataattttctcattagcaatttcacacatctaactttcacccaagtattttcatttgaattaaagaaaaaaagacttgcttggttatatagccaagtgaatataaggattaggatgttaattattgatttcaaaaagcccttgatatggctttaagcagtcacaattccctgcttgtcttcagttgatactgtgaagcaaggatgtccatttattcaatcattcagattacacaaacttatttagcacttactgtatgccatgctaggtaccaggatacaatagtgaagaagacatcatagtccttgccttcttagaggttatagtgagaagacatttaataattttttacaaagagcctggcacagtggctagtgtctgcaatctcagctactcaggaggctgaggtgggtagattgcttgaacccaggagtttgagaccagcctgggtgacacagtgagattctatctcttaaataatttttcttttaagaaaggaggggaaggggtagttagaaaggtaggaacaaagaaaccaataaatatgccaggtgcaaatctgtttagcacgtattatctcatgttatttaatatgtgccagttgcagtagcttgtgcctgtagtcccagctactcgggaggttgaggtgggaggactacttgaggccaggagttccagatggcctgagcaacagagtgagaactcccatttctaaaacaatttttaaaatttgttaatgtaatactgataactaggattaatgggcccattttacaaataaggagctgaggtatgcccacatgtgtgtaaacacacaaacatagtgaacaaattgcctaaggtcacctaatttgcattttcaaattaggcaccctgggctgggccgggcgggcacagtggctcatgcctgtaatcccagcagtttgggaggcccaggcaggaggtccacttgagctcaggagttcaagaccagcctgggcaacatggtgaaaccccacctctactaaaattacaaaaattagctgggcatggtggcgcaggcctataatctcagccacttatgaggctaaggtgggagaatggctgagcatgggaagtcgaggctgcagtgagcagagatggcgccactgcactccagcctgggtgacaggagaccatttcaaaacaacacaaatgaacaaaaaacaaattaggcaccctgacctcagtgcctggtctgagaaccactagctgtattaccttcataaataatgtgaaagtgtaatatgtgctatgtaggctgcttctctgagaaaacaccaaatggcggaaaaatcctgatctaaaacatcaagagagatctgcatccatctccattcagagcagttttacgactgctctgcaggcgatggcacagcagaatgactgccagaaagttgagctgctccatctgttctatataagtcctaacaaattgttccaggtccaccaggaatgacaaacagccccaaaccactgaaattcatatttttaatttttttatttgtttgcaaaaggactaaattgatgttcatttttctcccatcacaccctgatgaactgcttagtctcaacactacacttcttaggataaaaaacaaaataggctgggcacagtggctcacacctgtaatcctagcactttgggaggcccaaagtataatactagcactttgggtgggcagatcatttgaggtcaagagtttgaaaccagcctgcccaacatggtgaaaccctctctcgactaaaaacacaaaaaattagccaggcatggtggtaggcacctgtaatcccagctacttgggagactgaggcaggagaattgcttgaacctgtgaggcggaggtcacagtgagccgagatcgcaccactgcactccagtctgggtgacagagtgagactccatccccaccccgcaaaaaatagtatcttgcaattgtataatttcacctttccaaagatgtcagatgcttgcctgcatgttatcccttttttcttcattaaatattgagacagtcttggcctgggcaacacagtgagacctgtctcttaaaagtaggtgtgtgatggccgggcgtggtggttcacacctgtaattccagcactttgggaggctgaggccagtggatcacaaggtcaggagtttgagaccaacctgaccaacatggtgaaaccccgtctctactaaaaatacaaaaattagccaggagtgatggcgggtgcctgtagtcccagttactcaggaggctgaggcaggagaatcgcttgaacctgggatgaggaggttgcagtgagcagagatcataccgctgcactccagcctgggcgacagcatgagacaacatctcaaaaaaaaaaaaaaaaaagtgtgtgtcaggccaggcacagtggctcacacctgtaatctcagcactttgggaggccgaggtgggcagatcacgaggtcaggagctcaagggcagcttgaccaatatggtgaaaccccatctctactaaaaatacaaaaaaattagccgggcatggtggcacacacatgtagttccagctacttgggaggctgaggcagaagaatcacttgaacccaggaggcgaaggttgcagggagctgagattgcatcactgtactccagcctgggcaaaagagagagtctctgtctcaaaaaagaaaagaaaaatgtggccaggcacagtggctcacgcctgtaatcccagcactttgggaggccaaggcgggtggatcacaaggtcaagagttcaagaccaacctggccaatatggtgacacccagtctctactaaaaatacaaaaattagccgggcgtggtggtgtgtgcctgtagtcccagctactcgagaggctgaggcagaagaatcgcttgaacccgggaggtggaggttgcagtgggccaagattgtgccactgcactccaacctgggcgacagagctaggctccgtctcaaaaagaaaaaaaagtgtgtgtctttgtgtgtgtgtgtgtgtgtgtggagacaagattttagggaaagcgaggaaaagcagatggagtcagacctacctgaacgtactgtgcactatggtagcagtatgccccaaacaccacaggttgaagcagggagtcaccattctaactggggagtcgagaaaggctatatacagaaagtggtccttgagcttgatcttgaggccttatataggtgttgttgaggcaaaaatagaagaggaaaaggcatttcagaaagaaaaaactgtgtaatcaaagccgagatctatcagaagacactattcagaatcaagaaacatcaggtttggggacaacgagattcagagatgtgagggcaggagtcaaaaatgaggcatggtccagactgcgctggcataggtgtaaccttcagaagccaagccttcatcagtgtgcacaggtgatgggaaacagattttcagccaggtgagctttgctacacaaacgtgtggaattgtagcaggctgtttctccctaacaatcacacagatgggcctgcatgacagtcacacagacaggcctgcacagcactccagttacacagacaaatttccacagcactgccttaacactgagcaaataattaaacctagggaaatcggtgcccagacatcaaagctagaaatataaacatatggtcagtaggagacgtgcataggcttctccctatcctggagcaagtcaaaataacggagacagtctcacattcctagtgccaggacctgtcttgggttgtcgaaatctgagacagtcaaggtaacagaggcagttgtttgaatagatttattggaaagtctaagcagctcttcagaccaagctgtacatgagataagataggaataatcactccggatgggcacggtggctcatgcctgtaatcccagcactttgggagactgaggtgggcaggtcgcttaaggtcaggggtttgagaccagcttggccaaactggtgaaaccccatctctactaaaactacaaaaattagctggacgtggtggcatgcgcctgtggtcccagctacacgggaggctgaggcaggagaatcgcttgaacgcaggaggcaaaggttgcagtgagccaagattgtggcactgcactccagcctgggtgacagaatgaaactctgtctcaaaaaagaaagaaaggaaacaaagaaagagagagagagagaaagaaagaaggaaaagaatcactccagtaccacagtagataggccttgaagatactgggaccctcgcagtttaatcagacttagcaagcattttttggcctctgaccttctagttgaaacaaaatagttacttatagacttaggcaaatgctatactgcacataggcacataaccacaacctatataagcactaagaaaattgtacacttttgagttggtctggtggaattatcttcaaccttctccctgtatccagttacagtgataaattcccttctttcccagtttgtctgcttctcgttattgggccatgagaaaatgcaaccggacccagctctttctgggaacagaatgattagtattctttgcgtattgggctgaacaatttttaaaaccttaggggccttcttgaacccagaaccaggctaataaaaatgataatgctaacacttgagtgcttactatctcattcccacaaaaaccctatgaagtaacgcagcccccttttatagttcaggatcttaaggcttagaaagaataagtgatcagagacaggcacacagctgtcagtggagaggcttccgtttggagatcatttgacttcccagccagcaatcccaatcactgcggcctggcacagtgttttttctttttttttttgagacagagtctcgctctgttgccaggttggagtgcagtgacacaatctcggctcaccgcaacctccacctcctgagtacctgggagtacaggtgcatgccaccacgcccagctattttttttttttttttgtattttagtggagatgggggtttcgcaatgttggccaggctggtctcaatctcctgacctcgtgatccacccaccttggcctcccaaagtgctgagattagaggtgtaagccaccatgcccagcctagcgttttttcaaaatctgtatcacaaccagttagtggatcctaaatgataagaaatttttttttttttctttgagacagagtttcactcttgttgcccaggctggagtgcaatggcgtgatcttggatcactgcaacctccgcctcccaggttctcctgcctaagcctcccgagtagctgggattacaggcatgcaccaccacgcccagctaattttgtattttcaataaagatgggtttctccatgttggtcaagctggtctcgaactcccgacctcgggtgatctgcccgccttggtctcccaaaatgctgagattacaggtgtgagccaccgcgcccagccttgttttgtttctttttctttttctttttttttttttttttgagatggagactcgctctgtcgcccaggctggagtgcagtggtgcgatcttggctcactgcaagctccgcctcctgggttcatgccattctcctgcctcagcctcccgagtagctggaactacgggcgcccgccaccacacccagctaatattttggctaattttttgtatttttagtagagacggggtttcaccgtgttagccaggatggtcttgatctcctgaccttgtgatccgcccgcctcggcctcccaaagtgctgggattacaggcatgagccactgcacctggtcattttgttttcttttaacatagactagacaatatcagagcatactgcacatatactcatgaaacttatgtttcagtatatatgtgtatgctgtgtcatgaagaaaaatgtgtttcttttttttttgactgaagtgcagtggcatgatctcggctcactgcaaacttcgtctcctgggctcaagcaattctcctgcctcagccacctgagtagctgggactacaggcatgcgccaccatgcccggctaatttttgtaattttagtagagatggggtttcaccacgttggccaagctcgtctggaactcctggcttcaagtgatctgcctgccttggcctcccaaagtgctgggattacaggcatgagccccgggcgagaaaaatgtatttcttaatgtgagtctgttgaaaacagtttgaaagtgcttgctgtactgttctagcgtccaaagcagcctgactctactttggaccacagctactaagattcttcaaattcaaatatatatttcaagacgaaggcatctctggatgctaacccaaatactaaaataaacaagcagctgggcgccatggctcacgcctggaatcccagcactttgggaagctaaggcgggtggatcacctgaggtcaggagttcgagaccagcctgaccaacatggtaaaaccccgtctctactaaaaatacaaaattagctggtgtggtggtgaatgcctgtaatcccggctacttgagaggctgagacaggagaatcgcttgaacccaggaggcggaggttgcaatgagtggagattacgccactgcactccagcctgggcaacaagagtgaaactccatctcaaaaataaataaataaaataaacaagaaagaaattccaaagctctcaggccaaaaaggtcacccacctgtcaaagcccacaaaaccccaaagttcctaaaaattacccagtgcttcactgtcttgtaggttttgcctctcttcattctcctagaaagtacaaactgacttcattgtaggtgattatgcatctgggggaaatatggacaaatcagaaagaaagagaaacattaacagagcacctagtaagtgttccaagcttacctgccttatctccaggtgtaaggcccccttactttcagtctttgaatggagacaaactctacagcttccagttttttcctgttgtgaacgcatttccttcttttccaactatcccagcaattttgcattactaagtcagctctatcacctgccaagaaacctacccttccagctgggcatggtggctcacacctgtaatcccagcactttgggaggccgaggcgggcagatcacctgaagtcaggagttcgagaccagcctgaccaacgtggagaaaccccatctcttctaaaaatacaaaattagctgggcctggtggcacatgcctgtaatcccagctactcaggaggctgaggcaggagaatcacttgaacccgggaggcggaggttgtggtgagccaagatcatgccattgcaccccagcctgggcaaaaagagtgaaactccgtctcaaagaaaaaaaaaaaagaaacaaaacgaaacctaccctacagagtacaacaggatgtggggccaacaacaccctacaaacatttttctgttttgttttgtcttgttttgaggcagagtctcactctgtccctaggctggagtgcagtggcatgatcttggctcactggaacctctgcctcctgggttccagcgattcttctgcctcagcctctttagtagctgggactacaggcatatgccaccacacccagctaatttttgtatttttagtagagacagggtttcaccatattggccaggatggtctcgatctcttgacctcgtgatccacccgcctcggcatcccaaagtactgggattacaggcatgagccactgcaccgagccgcaaatatttatttatttcattttatttttttgagacagaatcttgttatgttgcccaggctggagtgcagtggcataatctccactcactgcaatctctgcctcccaggttcaagtgattctgctgcctcagcctcctgagtagctgggtttacaggcgcacaccaccacacctagttttttctttctttctttttttttttgagacggagtttcgctcttgttgctcagactgcagtgcaatgccgtgatcttggctcattgcaacctccgcctcccgggttcaagcaattctcctgcctcagcctcccgagtagctgggattataggcatgcgccatcacgcccggctaattttgtatttttagtagagacggggtttcaccatgttggtcaggctggtcttgaactcccaacctcaggtgatctgcccacctcggcctcccaaaggactgggattataggcgtgagccaccacgtcaggccacctgtctaatttttgtattttttagtagagacagggtttcaccatgttggccaggctggtctcaaactcctgacttcaagtgatctgcttgccttggcgtcccaaaatgctgggattacagttgtgagccaccgcacccagttacatttttttctttttttaaattttatttgttgagacagggtctcactctgtcacccaggctggagtacagtggcgcagtcttggctcactatagcctcaacctcctgggctcaagcaaaccaccagccttggtctcccaaagtgcttggattacaggcgtgaaccaccacgcatctggcccccacaaatatttagaacaaacaagtaccacatccaggagaagggctgtgatcctagctcttccccatctgtgcctaaagcagagggctttcccttgagtgctaggaaccccatggaattatctgcaaaataatatgtgagttttttctgggtcagagttcataggttttatctgattgagagaaccttctcaggaaaggctctgaagagctgtggagcaacacgtgatcaaaggcagggttgagggcttgagtgaaacaatttggaacagctgcagctgaaatgtgcctgggagatgcccatatgcttgcatgccttttttagtgcccttctgtgtagctggaatgctccctccaggccttttctccttgcctctcaaagcctagctcaaatgccaccaacttgtctgggacactctccttgatactatttcaaataaatcatttctttttctctgtttaatagtctttccttgttaatctcacttgattataaatcacttgaaccaaagaagagatttgccaggcgcagtggctcacacctgtaatcccagcactttgggaagccgaggagggtggatcacctgaggtcaggactttgagaccagcctggccagaatggtgaaaccccatctctactaaaataaaaaattagggccaggcgcagtggctcacacctgtaatcccagcactttgggaggctgaggcaggcagatcatctgaggtcaggagttcaagaccagcctggccaacatggagaaaccccagctctactaaaaatacaaaaatgagcgagtcatggtggcatgcatctgtaatcccagctactcaggagactgaggcagaagaattgcttgaacccaggagacagaggttgcagtgagccaggatcgcaccattgtactccagaccgggcgacaagagtgagactctatctcaaaaaaaaaacaaaaaaaaaaaaacataaaaaattagttcggcttagtgaaatagggcaaaggaagcaatcagatatgcatttatctcatgtgtgcagaggggtaactgtgagttctgtctgtcctttgtccacaagcagtcaccttgtgggcaaattgtgcaggagtactgtaagctttttttttttttttttttttatctttgtagctatcttatttcttattcaggaatagaatggaaggcaggccaggcgtggtggctcatgtctgtaatcccagcactttgggaggccaaggagggtggatcacctgaggccaagagttcaagaccagcctggccaacatggcgaaaccctgtctctaccaataatacaaaagttagccgggcatggtggtgtacacctgtaatcccagctactcaggaggctgaggcaggagaactgcttgaacccaggaagcggaggttacagtgagccaagattgtgccactgcacttcagcctgggtgacggagcgagactgtctcaaaaataaataaataaataaataaaaccaaggaaacagtcctgtctcatagaagtctctcaaatacttaaaaaaaaaaaaaaaaaagaatgggaggcaggtttgccgacatcgttccaagctcgaccttccctttggcttcccgaggggtcccgaggtttcttttcctttcataagtctatgcttaatacatgcatagctgtacacttgcatggtttcctcctttccttgacttagctgtgtgaacttcagtatgtaagtcaaacttcaaattccttacctgtaagatggagtggttctgagcatttaatataatactttataactaaaatgctacacaaacatgaagtgttattatttttggaaggagaggcaaggcctaggtgcaaatgtactgtatttttaacttttatttagaacagaggtctcttggactctcagccccaggcttgactactttgtgccactgggagtactccctttcctcttcttcacaccatcaggaaaggcaggctgagagttacgctgcttgactctgcctcggtctatcccacaggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttaggtaagataggatgccaaagtgaatgtctacagcttatttctaaggtatctaagagggatagccatatgcatcacggtggtacaaaacatcatgttcagtactttggattacacattcagaggtcacctcgtccagttccctggaaagaaatgtgtatcttctgtattatagccataataaaaaatgaaaatataagagcaattttccatagttgtccattacaaaacatattctctaatatttaagtgggatcttcatatttaagtctctcagatatgattcaaattcatttctgttttttgacagcaagagctaccaagttctacttaattgcttccaaattaatacacttctgtatcagtaaaaccatgctcaactttcctaaaatgtccaataataatgtgtcttctttgagaagtaatgaggcagcctctgccccaaaaattaaaacagcaccactggagttgcgggtatgtgtgcttaggggatggaggtggatgttttggtgggggtagtgtaaagcaaggctagttgaatccccactcaaaagttgaccaaaacagatggctggagaagcaactcaataggacataatttttccattgaatctggtgtttggggatctttgaatcactacacttttgcttgttgttgctgttgccagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattggtaagtcatcttcctaccaatctattgagccaacaaaatagtcctctatccgtgagctctaaatcagctttctcagcaactcactatgtgacctgaaataccctgctgaacctcctgaactgccatttttaaaatccattaactagaacagaaaatctgtctttcctttcctcaaatgacatgtaaaagtagtaaaagagattggaagaaatgtactacataaatccactatatctaaatattatgtttagtatcccttaaatgttcacaatcttttgtaacttttgaggatgtgctacaacttaaaaaaaatgtttacctttcttctcatgttcccaaaggatatcttttccatcatttcattcttatcaaatagcattacggaatctcagctcagtgatacaataaagtaaacaataaatatagataccatcactaaagggatttacagtcattctttctgcttgtgcagactacaaccaccctggacgagttctgctgcagaatcttaccatgtcctactctggactgtaccagtgcacagcaggcaacgaagctgggaaggaaagctgtgtggtgcgagtaactgtacagtgtaagcatccaaagaggttttagtttcatttttctgtttgtttttgcattgtagatcaatgttaagacattctaatcataagtaagagtaaggttaaggtcaaaatctttatctccagaaggatatggctatcaccaaaataaattcagtagttgcaaagaccactcaacaattgactggccaggcacagtggctcacacctgtaatcccagcactttgggagggccaggtgggcagatcagttgaggtcaggagtttgagaccagcctggctaacatggtgaaaccccgtttctactaaaatacaaaaattagctgggtgtggtgggcgcctgtaatctcagctactcaggaagctgaggcaggaaaatctcctgaacctgggaggcggaggttgcagtgagccaagatcacgccactgcactccagtctgggtgacagactgagactccctctcaaaaaaaaaaacacacacaaaaaaaaccagcccagcgtggcggctcatgcctgtaatcccagcacttcgggaggccgaggcaggcagatcacgaggtcaggagttcagcctgaccaacatggtgaaaccccatctctactaaaagacaaaaaatgagccaggtgtgctgatgcgtgcctgtaatcccagctactcaggaggctgaggcagaagaattgctttaacctgagacacggaggttgcagtgagccgagatggtgccattgcactccagcctggacaacagggcgagactccaaccaaaaaaaacaaaaacacaccagttgactctgtatttacaaacatgtgaattagccagccccctaaagaaattcactatatccaggggagtactaaataaacaccattcctaaaaacaaaaacaaacaaaaccgtgcagctagttagttatatgccactaccattctaggcaagtagatgagatttctcccctccacagagtgtttgtgagtgcgtatgtgcatgtgctcatgcacacacacgtgtgtacatgtgttataatcaagaatttgatttgcttcaagtacagatgagagacagtagtaggcgactaagagcatcagccgtggagtcagataactgcctggatttcaatcacagctaccactaactctgtagtaccttaggcatatttcccaatctataaaggagaataatagttaactgtctcatagagtttttctttttttcctttttttttttttttctggacagggtcttgctctgtcacccaggctggagtgcagtggtgtgatcttggcttactgcagcctctgcctcccgggttcaagcgactctcctgcctcagcctcctgagtagctggaattacaggcacatgccgtcacacctggctaatttttgtagagacagggttttgccacattggccaggctggtcttgaactcctggacttaggcgatccacccttcttcacctcccagagtgctgcgattaccggcatgcgcaacgccacctggcctcttagagtttttctgaaaagttagtaaatgaacacatttacttacaactgcctaggaacagggcttgacatacagtgggtgttcagtaacattagctattattattatttctccttaatcaatttagtaacttcagacttttgaccaaatcctatatccacaagccatgtttgcagtgttaaaatttatttggtgcaataaatagtatgccaggcttataatctagagattgagtcttgaaaaaagacaggataaaccaagttgaaagacaaaaggaagcagggcatggatattaatctttgttacattgtctccataacatctttgttaaattgtctctaatttctcaaatgctctttggaccacttttaacattttcctaacccccaccctgtttttttttgttgttggtttttttttgttttttgtttttttgagacagagtctcactctgtcacccaggctgcagtgcaatggcgtggtcttggctcattgccacctccacctcccaggttcaagcgattctcccgcttcagcctcccgagtagcgagtagctgggactacaggtgtgtgccaccacacctggctaattcttgtatttttagtagtagagacggggtttcactatgttggccgggctggtctcaaactactgacctcgtgatccgcccacctcggcctcccaaagtgctgggatcacaggtgtgagccaccacacccagcgcccccttattaataagttaaataaaacctttaatttgtcggaatcagtattttacttttttcaaagttatacttcaacattctgtgcctattttggtttagctgttttcccactgatttgaaagagttctttattatgtatttatatactctacttattagaatttgcattctggtggttttaaaaatatgtccaagtaatgatttgctacttctcccttcaagagatatacctttgtcgaggcgcagtggctcacacctgtaatcccaacactttgggaggccaaggcgggcagatcacttgaagttgggagttcgagaccagcctgaccaacagggtgaaaccccatctctactaaaaatagaaaattagctgggcgtggtggcacatgcccgtaatcccagctacttgggaggccaaggcaggagaatcacttgaacccgggaggtggaagttgtagtgagcctagattgtgccactcactccagcctgggcaacaagagcgaaactccatctccaaaaaaaaaaaaaaaaaagtacaccttcattctcctctttttgagtgtgatctgaacttagtgactcacttctgatgagtataatacagcagaagtgatggtatgttgcatctgcaaaagcactgcagtttgctttcttagatgttagatctcttagatctcagatcactcagatcctctctctcttagatcactcactttatgggaagccagctgctttaagagccttatatagaggcccatgttttatgttttattttaagtgaggaaactgaggcctccagccaacagccatgtgaatgagccatttcagaggcagatcatccaacaccagtcaagcctaggaacagggcttcacacatggtgggtgttcagtaacactagctattattactattaacagattgctggatttgacatcgagctacgaagtcgcagactaattcctggggtcatctgtttaactggtggataaattatttccatctctactagacagaggtctacaagttgcccctacagagttgtaaattgccaagttctgtagttcttttgtctatttccaagtttagataatttttcttaaaaacacaacagtcaggccgggtgcagtggctcacgcctgtaatcccagcactttgggaggtcgaggcgggcggatcacgaggtcaggagtttgagaccagcctggccagcatggtgaaaccccgtctctactaaaaacacacaaaaaattagctgggcatgcctgtaatcccagctactcgggaggttaaggtaggagaatcgcttgaccctgggaggtggaggttgcagtaagctgagatcaggccactgcactccagcctgggtgacagagagagactccgtctcaaaaacaaaacaaaacaaaacaaaaaaagtaacaggcagttttcaggaaaagaaataaaaaatggtgaataaacatgaataaagaggcccccaaaaatccttttttccccactaggttgagaaaaaaaaatcacccttttaattttaagctatcagtttagtaaatataaaaactgtagaatctatattagaaaggttatgaggaaacaggtgcttttacatttttgactaacatatacattagtagcacaatttagatttatctatagatttctgaggggtaaatatattaaagtaaaacttatacaaagaagaaggataagtgtacaacttgatagattttcaaaagtgaagataactgtgtaaccagtatcatgattaagaacctgtttctggccaggcacggtggctcatgcctgtaatcccagcactctgggaggccaagctgggcgcatcacctgaggtcaggagtttgagaccagcctgaccaacatgccaaaaccccagctctactaaaaatataaaacttgccgggcacggtgactcacgcctataatcccagcactttgggaggccgaggcaggtggatcacgaggtcaagagatcgagaccatcctggctaacatggtgaaacgccatctctactaaaaatacaaaaaattagctgggcgtggtggcaggcacctgtagtcccagctactcgggaggctgaggcaggagaatggtgtgaacccgggaggtggagcttgcagtgagccgagatcccgccactgcactccagcctaggcgacagagcaggactctgtctcaaaaaaaaaaaaaacaaaaaaaaccaaaaaaaacacaaaaaaacaaaacttagctgggcatggtggtgcacacctctaatcccagctactcgggaggctgaggtaggaaaatcacttgaacctgggagacagaagttgcagtgagccgagattgtgccactgcactccagcctgggcaacagagtgagactctggctcaaaaaaaagaacctgtttctgactcctgctacctctccataatccaggtttctaactttatggattacttttcctgtctcaaaactttaaataaacagaatcattccattttgtctggtttctttaattccccattatatttttgagactcatcattgttgttgcttatagctagagtatgtcatttttcattgttttatagtatttcattatataactatacaattattcattttatttcagatgcaaaattgcattccattttatccagtaatatttctgtgaatttatcttttagagacatgccccaagtgtccaaatacatatggaaaataatgatttttttttctttttttttgagacagagtttcactcttgttgcacaggctggagtgcaatggtgcgatctcggctcactgcaacctccgcctcccaggttcaagcacttctcctgcctcagcttcctgaggagctaggattacaggcctgcacaccacacccagctgatttttgcatttttagtagagacggggtcttaccatgttggccaggctggtctcgaactcctggcatcaagtgatccacctgcctcaccttcccgaagtgctgagattacaggcgtgagccacagcactgagatatattattttccattgtgaaaaattgaaagtgacctaaatttccattaacagacaatccatctagattatgtgtcctggagctggggcagtggggaaaacagcatcctctatttgaaattactcaggtaaaataactccattcctttgagaccttaaataaaaatatccaaagtccaatttctttaaaaaatgaaattttggctgggcatgtggctcacacctgtaaccccaacactttgatggaggtgggcggatcacttgaggtcaggagtttgagaccagcctgaccaacatgagaaatcccatctctactaaaaatacaaaattagccaggagtggtggcgcatgcctgtaatcccagctactcaggaagttgaggcaggagaatcacttgaacccgggaggcagaggttgcggtaagccaagatcgcaccattgcattccagcctgggcaacaagagcaaaactctgtcttaaaaataaataaataattgtatcattttgtttttataagaataaataggctgggtgcagtggctcacgcctgaaatcccagcactttgggaggccaaggcggggggtagatcacctgaggtcaggagttccaaaccagcctggctgacatggtgaaaccctgtctctactaaaaatacaataattagctggccatggtggtgcacgccggtaatcccagctacttaggaaactgaggcaggagaatcacttgaacccgggacgcggaggttgcagtgagctgagatcgcgccattgcactccagcctgggcaacaagagcgaaactccatctcaaaaaaaaaaaaaaaaaaaaaaaagaataaatagcaaattctgttgattagacttccaaaatataggcaatatccatgtacttgtttctatatacattactttcatcctagcctaatccatcatgatctccagcctgcactattatacgcctcctagccaatgtccctgctttctttcctacttctccactatttattttccctagagcagccatggtgtactgtctcagatataattcagattgtgttactcttttattgctctcacattaaaatttttgccatggcctatgtgggctggtcctttcctgtctctgtgacctcatctccctctactctcccttgctcactatgctccagacccactcacattaattgtacttgctgttttctgcctggaatgctctgttcctagataatcacaagatcgtcctttatatcatatatgcctcaactcaaatgtcacctcctcaaagtcttaatcacccaaacttaagtggtatccctccattacccctctaaaattcactcatccaattttgccttcatggaatttatccattatctgaaattatctttatttacttgtttattatctgtttcccttctggaatgaaaactcaacaaaagcagaaaacttgctggtcttcaacagtgcctataactgcctggctcagggtaggcactgaaataaatatttggtatatgaaaaagggtgtattgctaaactacaaattgtatttaccttaacttcttaaattctaggatccaatgtcaaattccacagagtctaacattataggttatattccatttttaaaaatcaacttttattctactcaaaattttttttttttgagacagagtcttgatggagtgcagtagcatgatgtcggctcactacaacctctgcctcccaggttcaagtgattctcctgccttaacctcccgagtagctgggattataggcgtgtgccaccatgcccagataacttttgtatttttagtagagacggggttttgccatgttggccaggccggtctcgaactcctgacctcaagtgatccgcccacgtcagcctcccaaagtgctgggattacaggcctgaggcactgtgcccagccaaaaaaattttcttacattcccttttatatgactggtgggagaagagagatgttagagaaaacagggaagtcggcagagccagaggaatgcccaaatgttatcctattaaggcagacaaatcttcagacatgctatgatttctctcccagcccagttttaccatctgaacccacccagacttattcactaaaacataaccacttggttgcgcgcggtggctcactcctgtaatcccagcactttgggagaacgaggagggcggatcacgaggtcaggaggtcaagaccatcctggctaacacggtgaaaccccgtctctactaaaaatacaaaaaaactagccgggcgtggtggcgggcgtctgtagtcccagctactcgggaggctgaggcaggagaatggcgtgaatccgggaggcggagcttgcagtgagccgagatcgcgtcactgcactccagtctgggggacacagcgagactccctctcaaaacaaacaaacaaacaaacaaaaaccctggccacttgctggcgaagtctgtgattcagtaactacaactgcaaatatatcaagagggttggtcatacaataagagagagtaatgcagtactactcaggaagatagatataaagacctggaggtcggcgcggtggctcccgcctgtaatcccagcactttcggaggctgagtctggtggatcacctgaggtcgggagtttgcgaccagcctgaccaacatagagaataccgtttctactaaaaatacaaaattagccgggcgtggtggtgcacgcctgtgatcccagctactcaagaggttgaggcaggagaatcacttgaacccaggaggtggaggttgcgatgagccgagatcatgccactgcaccccagcctgggcaacaagagtgaaactccgtctcaaaaaaaaaaaaacaaaacaaacaaacctgcaaatactcattctgtccagagcttatgttttttgagttaataacatatttcctagcttacgtttggttttacttgtgcttttgcttctgagaaaatagatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcggtaaacctcccacatccctacttttacggggcttctgttttagggccagcactatagtgaccagccaacataaatgttcccagttttctcttaaccatgaatctgttaaaaggattatcctggtaggtaggaagttccagcctagggacagagggtatggtttacctggactttattgtgaaactatcttatcctcaacaaacacttaaaagttaaattaggctgggcgtggtaggtcatgcctgtaatcccagcactttgggaggccgaggcgggaggattacttgaggccaggagtttgaaaccagccttgtcaacatagttagactccatctttacaaaagaaaaataaataaataaataaccaggcatggtagcccatgcctgtagtcccagctactcaggaggctgagacaggaggatgactttagcccaggagtttaagactacagtgagccatgattgcacctctgtactccagcctgggtgacagagaaagagcatgtctcaaaaaaaaaaaaaaaaaaagtatgtacatatgtatatacataaaacagttcaatttacattacttctgattcacttctacccataatgggcatacaatgaagaatggacatagcctataggtcatgaaagggtttatgcagacaaaccctaaatcaggaggtgtgctgtctagaccatctcaatggtaaggtcctatcctcccagtataatagagttgacctgtgggctaacaaaatatacatttgtgtgagccaagcattaagtcttaagatacgaggaagcacctatgaccctaaatggttgccttccgatggtattatctgaggttcacagcttcggaaacctcagaaggaagcaatcatactggaagcaatcacagatctgccagtgttaatctttgctgttttttctcttcagagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaaaagtgaaaaatgagagaaattcagtattttcccaggctcagcatccagaagtctagctctgggctggaagaaaagggtactaatatttagggaagagatgagaataagtagtgggtggcaggagagggctgagctagtgcctgctaacattttagttgtatcttggaaagatttagcaaaaataactcaccaggatagctgctgaagagttgatgaatgggagaagaaagatgtttgagaaataaagaaaacagcagcctgcaatacaataacttgcctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgccttgtcctcctgagtcgctggtattacaggtgcctgccatcacacccagctaatttttggagttctgatagagacagggtttctccatgttggccaggcttgtctcaagctcctgacctcaagtgacctacccacccttggcctcccacagtgctggaagccactgcacctggctcagaatacttttttttttgagatgcagtcttgctctcatcacgcaggctggagtgcagtggcgtatctcggctcactgcgacctccacctcccgagttcaagcgattctccttcctcagtcccccaagtagcttggattataggtgtgcgccaccacgtacagctaatttttgtatttttagtagagatggggtttcgccatgttgaccaggctggtctcaaaacgcctgacctcaggtgatccacccacctcggccccacaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaaaagtgatactgtaggagaagctgaagctcatataacctggaatggaaatttgtttatcagcttgctgccaacagaagaacagaagaactcagactgaatacgatctattatttatcaatttcagtcacgaatttaccaattacttttttctctcacaaggcaagatgctaggtataagttgcacaggggataccaagagttgctgtccttaaggatttatcaaaattaatgaaataataattactaagtaagtattttgtgcctaggtgaagtgccaacagagaagcacacactaaggggttcaaataaatctgaaaagtatgcactaagagattcaaatacatctggaaaaaacttcacagaggtcattgcaaaatagcagcaataatagtaatcatcacttactgagccatcacgtgccagtcacactaagtacattatacattttgtctcaatgtcatactcacatcaaccctataaggaaatatttgtattcacattctacaagtgagaaatgtaaggctcaaagaggttaagtcagtagtagagccagcatttattttcacttttatttttattttgagaccgagtctagctttgtcgcccaggctggagtgcagtggcacaatctcagctcactgcaagctccgcctcccgggttcacgccattctcctgcctcagccacccgagtacctgggacaacaggcgcctgccaccacgcctggctaattttttgtatttttagtagcgacgggtttcaccgttagccaggatggtctcaatctcctgacttcatgatccgcccatctcagccttccagtgctgggattacaggcatgagccactgtgcccggccctggagccaggatttaaacccagccactgttagtatattccatcagaactgacagatcctgattcatcatcatcttccctcctgaaatcctcaaacttttacactcagctataggctttctctcctctttgctttcttccttgacctaaagctgttcaccatacttgggacacacttagctcactcacacaagtccaaatcctttagttttcccttgttctgcaaaacaagatacaattcccaattttataattgcctgatttgtctttacatggtaatgatgggcttagatcatgtaatttttgttgaatgttaagcacagagtatcttgagcacatcaagattaaatctgtccaatcttctgagaggcaaaaagataaggtacattaaaactacaaaataataggtacagttgattcttcaaagatgatacagtcatatcaatttatttaaaatgtaggctgggggccatggctcacgcctgtaattccaacactttgggaggctgaggtaggtggatcacttgaggtcaagagttcaagaccagcctggccacgatggtgaaactccatctctactaaaaatacaaaaactagctgggcgtggtggcacatgcctgtggtcccaactactcgggaggctgaggcaggtcaatcacttgaacccgggaggtggaggttgcagtgagcggagatcgtaccactccactccagcctgggtgacagagtgagaaccttttttttaaaaaaaaaaaaggtgctccttattattttaattttttttttttaatctgagatggagtctcactgtcacccagtctggagtgcaatggtgcaatctcagctcactgcagcctccccctcctgggttcaagcagttctcctgcctcagcctcctgagtagatgggattacaggcgcacaccaccatgcccggctaatttttttagcatttttagtagagaggggttttcgccatgttggtcagtctggtctcgaactcctgacctcatgatccacccgcctcggcctcccaaagtgctgggactcaggcgtgagccactgcgccccgcctattttaatttaaaatttttttcagagcagcttaatttttaatatttatttatttatttatttatttattttttgagatggagtttcacttttgtcgcccaggctggagtgcgatggcgcaatctcagctcactgcaacctccgcctcccaggtttaagcaattctcctgcctcagcctcccaagtagctgggattacaggcatgtgctaccatgcccagctaattttttctatttttagtagggatggggtttctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttaaatttaaaataggcggggcgcagtggctcacgcctgagtcccagcactttgggaggccgaggcgggtggatcatgaggtcaggagttcgagaccagactgaccaacatggcgaaaacccctttttactaaaaatgctaaaaaaattagccgggcattgttgtttgcccctttaatcccatttactcagagggctgaggcaggaaaactgcttgaacccaggagggggaggctccagtgagctgagattgcaccattgcactccagactgggtgacagtgaaactccatttcaaattaaaaaaaaaaaattaaaataataaggagcaccttttttttctttaagagacaggttctcactctgtcgcccaggctggagctcagtggcacaatcacggctcactgcagcctcaacctcccaggctcaaaccatcttcccacctcagcctcccgagtacctgggactacaggcacatgccaacacgcccagctaatttttgtattttttgtagagatggggtctccttatgttgcccaggctggccttgaactcctgggctcaagccatctaccagctttggcctcccaaaatgctgggattacagtgcctggccaagagcgcattttataccgcacctcctctccatagtgcaggggctaaacaagatgactaagagtttgaaagtagaaagcaacctagcctgagttagaagcataagctgtagaataaaatctgattttgaaaaattcagggtcagctagagatcttaagcaaattatttgacctatttgaacctcaatttctttacctgaaaatgcggacaatatgatctgccaaaaatagttgtgagggtcatgtaagagaatatatgtcaaatgcttagcatggtgccctgcataaagcactgaataaaacatcaatggcaagggctctactaccagaaatacaataggcatgagaatgttctaaagcgtataatctggtttaggaaggtaaagcataatgcaggaaaaagatattggggctatgtttatgtatgctgttctccagttgcaataatttatacatggctgcagttagaaatcaaaatattaataacagcttacatcattctggtttcaaatttccctgatgcaatgcagtacatacactccagtatttgggcaatcagggcatacatatattgcatcttttagtcatgtcaccgggtcacaggaggattgtttttaatatctgagtttttaaagcaagggactgtaagtttactattctttaatactaattttttaaaaatgcatacttagtaacagtacaccacataatcctaacacaaattatccaattaaattctaaaccttaaatttttttcatttttttttgttttttgagacagggttttgctccgtcactcaggctggagtgcaggggcacaaccatggctcactgcattctccacctcttgagctcaagcgatcctcccatctcattttttcagagatgggggtctcactattttgcctaggctggttgagacttttcaacagaagcaactgataccacaaaactattaaataatttcttcataaactgaggccagcacggcggctcactcctgtaatcccagcactttgggaggccgaggtgggaagattacttgaggcctgagaccagtctgaccaacatggtgaaaccccgtccctactaaaaataacaaaaattagcggggcgtggtggtggtgcgggcctctaatctcagctacttgggaggctgaggcaggagaattgcttgaacccaggaggcggaggttgcagtgagccaagatcacagcactgcactccagcctggatgacagttatagactccacataaaaaaaaaaaacaaaaaaaacaggccaggcgtggtagctcatgcctgtaatcccagcactttgggaggccgaggcaggcggattacctgaggacaggagtttgagaccagcctggccaatatggtgaaaccccgtctactaaaatagaaaaattagccgggcgtggtggcatgcacctgtagtctcagctactcgcgaggctgaggcaggggaatcacttgaacctgggaggcggaggtcgcagtgagccaagttcctgccactgcactccagcctgggggacagagcgagactccatcttttctgggagactccattgggagactgtcttttttgggagacggagtcgtgccttagtttccccatttacaaaatgacgatcataatagttgctaccgcttagatttacggtgagaattaaatgaggttaaggctggcatgtggtaggcacacaaaaatgttaaatcattatccttttatccagtcagaagtcctaggctctaggctccactgcagtcccatgcaaccaaactttaattttagatcttaactgtgtcatttgaaaccctgtgcgtttgaagtggtggagacaggacctttatcatattctgagctttaaatatataaacggtaaatcattccatttaataagacatagcccaagtcccagaacgcgttttgagagtaaccagaaacagaggttatttgttctgctttcttttatcactgctattggatgggatatcccaaacaagtggatgtgcgccccaattctattttccactattcaatgattaaaataattacaaaaacgcaaaatacagcacagggtgtagtttaaaatttgtgcttgttaaactctaggcactggggtgtgaaaagaaagattccagataacattactagcagttagcgtgggggactgggggttccaaataccaaaggaaactgaaaacagtggctcacagtacatatcttaactctttctggagttgagttcaatttatttccaggaaggaaattacactgtagcgtaactaacaaaaaacataaaacaaatcttgaaccaaaaaaaagctagatttgattctagcttacccagctgcttatcttcccacaaatgattatctctgagctgcatttttcccctgatatggggatgaataatacacaccttagagaattgtgttgatgattaaatgacaaatgaaagcattttgtatgtagtgaaagcattgtataaaattaaattcttgggacgtgggagaggctaagaatatatctccatgaactctaagccaacattcctccccaaaaggaaaatatgaaaaggaaattcttcatatgtttgagtctgtctctaccctttactggctttgacaaggacaagatgtcctcgctcttctgacagcctttttcgcagtctagagaccttctaattccagccctgctactaaaagttcttttggtgtagccttaaaaaatcttttcccccatcggtgcctatttatctactaaataggaataacagctacctcgcctgcttgaaaggatacagggagtgttcaaggtacctgagacaggctcttggaaccacaaggccccacatatccgcggccatgcacaacattgcacaattcaaaattctaggcaccattgttttgtgcaccagctcagtcacgttttcaaagcgtcggtatggtctgtcgtttaatttttgatgaaagtcaaaccaggaaagatatcacctcatgttactgaaaatacaaacgttcagaaagtctaaatcaaggacgcacggctactggaacctatgattcctaatgcctggttcacctaaccaagaacacactcgccaccatttaaacctgtttattttataaacaacggggaaatgtagggcttgggctagttggggaaggactgagccaagaagccgaatctgttctagacggaggtgggaaggggcctaacggtcagggctcagagaagcggtttcgccttcttttccgcggagggatccagacacgaccgcgtcctgaggcggttctgaaaagccgggccccttaaacctctgcgtcgggggctgcctcccgacagttgccgtagggaaatgcaggtgctgggaggcctgccgagctaacccgccccaccccgcggcggcctggcggctccctccaatcccaatcctggggggccgtgagcgagcagccctagtggcaccctgaagccggaaccttcgccccagcccctcggggtcagcccttgtccaaagccacgctatgaaatacagattcgcgaaacccggggcacttagaggcccgtctggaacacgaaggtggggcatggaaaggaggattcggacgtgggtgggggaggggagcaacaaccttcgcagccattttgtcctcgctccacttccgtcttctcctgcccggctcccgcgcccaaacccctcccttcaggccccgcgcgattccgcccccagttctgtgccggccaagatcccggctagcgccgctatcattggttagttccaagtttgcccgcccctcttcctcctcctttttccgccccctccctcccgcggaagctgggggcgcatgcgtagaggtggacgctcccctcccccgcccggggtaactgaggactcccgcgcgcggactcgctgcgccccaccctccctttccccggggccgtccggagagcgggggcgagcttgaaagttccagaacgctgcggtgagtgcgttatcgtgaggcggagcgcggtggggtgggtgcggaagggggcgaggcccgaggagtggagccgggcttgtgattgggtcttgtaagggcagccgggcgtctattggccggggaagccgtaatggcaggcagcaggggcgggccccttctggaaggttctaagatagggtataagaggcagggtggcgggcggaaaccggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcaggacggaaatgtagggagtgggccgcagtggccccaggggaggctgggagacgcccggcggccgcgtggcgggggagggttgctgcatcggtttgcctggcgcgcggggaagtggagccagcgttttctttcacccagttccctgcttagtccagtcccaccgtggttcttcagagctgttcttggcgtgcttccagtatgggggtacattccggagtagttaaaagcccgttgactcccgggggcactggcacctggcgagggaggggaacagacagtgctcagttcggggtaagaccacgtgttgagcaacgccccacgccgtctgggtagatgggtccttcatctagggcgtgctctgctgcggttggcacggcaacctggactgcagcactagttctggacctcgcgcgtgcttagacaggaggtgatgggcactattacctcttggcagtggccatacgtttttcctggttaagtgttctgttaagggatgagggaaatattttgattaattgaatttttaaaccagatttttctttttttcagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttggtgagttcctaattttaaatgacagaacaaatataacagggctaggaagcacaaaagtttatgaaacgtgaggagggaactttttgattttagaaaaactgagctgagagacttgttatcaagtctgttataaaacaggttgtagaaacctttcaggctgaaatctggataacgtaggaggttgaagtttgaacctttgctacctatatggtagttgaattcacctacctatgaactgttaggtatttgagtaatcatggacttgagttttatcagaagagctatgaaattgaaagtgttttcatttgacaccttttacagatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaaggtgaggttggtttttcagtatggggtgcattccggagtagttaaaagcccgatgactcccgggggcactggcacctggcgagggaggggaacagatggggctcagctcagggttaagaccacgtgcccaacagtgccctaggctctctaggtagatgggtctgtcaacaccagaaaccagtgaatcttgacaattacacagtaatttacattttggtggggggggtgctccagctgttctttcaccagcattaatccatttgctggagtttgcatatatgtaagtataatagttaccaatctgtggtcttttccttattcctagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggtatgtaccatttgtgatgcaagttcggattattttaagattaatttgatccatcgtaaatttaaatgagattgtttttaacggcaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtctgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggtaaggaggcactgtcatctggtcttgacagggataatggtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtttgtgttttttttttttttttttcctcccccactcaatggaggggaaggggatggtaaaccaagcttgagctggatttcagtgtagggtcacaatgatgaatggtccaaaacattcgcggtttccaccagaattcaaggtgttggcaactaccttccttggatgtctgagtgacccaagatgttaaggaagaataaggccctattttaatgttggtagtggccctcttgtaagagtttgcgccagacttttagtatcagattgcgtcagggagaaagaagggttattaacattaaaagaacttgcagtaattcctttttctcttcctcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaattgctttgagtctttaaataatctcccaggccagctggtgggagaagtaggcttaggtgattatgtgactcttactttctccttcctcttaagcttgagttaacaagggctgggtggcaagttgcccttcagagcattgtggatggtacattttggaattcagagctttgagaaggggagcataagaaattggatctggatcaaactaaccttagtccttaggctggagaggcagaaagctgacttaatggtgttttctaaacttattctgtgtgtaagcctgcctaggagcagaggctttcctggagggttgtgctagatgagtaagaatttagagatcagaatcaaataatgggcagtgaatattaagctacatggcagaggtatctgaatgtcaatcccttatatgagccactgccctgtgggcttccatttcttcctgagttaagattattcagaaggtcggggatggagctaagctgccacctggttaattaaggtcccaacagtgagttgtgatagcctaggggagcaggctgttacctgtcattacgtacgtgacagatttcagtggactagctaatcttagcatatgccaaaaagctaattcatggaggagctgcagtttttctctttggtactgaagggctactaatgtctgggtatctcagtgggaatttgtagcacgatttgatatacttctcattccatattttctccaaggttacaaaaaatgacaagtagtacacacttctttttttgaagggttttactcttgttgcccaggctgtagtgcaatagcacgatctcattgcaatggtgcaaaccctgtctcctgggttcaagggattctcctgcctcagcctcccaagtagctgggattacagccatgcgccaccattcctggctaatttgtattttttagtagagatgaggtttctccatgttggtcaggctgatctccctacctcaggtggtgcacccgcctcggcctcccaaaatgctgggattacaggtgtgagtcactgcacctgacagcaatgcacgtttttggcatgtttcttttgtttgggtgagaatcttacctgggcttcagttttccataggggtgtgttatcacttgtgcaggctggactggaactcctgggtccaagtggtcacccagccttagttccaagtagctggctctacaggtgtatgtcactgcacatggccataccatgtatttgagatgctacaaacttttttgatgccttgactcaacgagactaaagggtaaatatactttgatctcgtttcatgtggaatcttaaaaatatgtggaaggttttcagtggtagctgttactgtaaatttttgaacttcaggttaatgttagcttaatgttcattagcaaaacacaaaattagaggagtaaatatggcaatgtttcccctatacagataataacttgttggacatgtgtaatgtatagcaaggaattggggcctgggaaggtgggaattaatatttgctaggttttctcagttattcgtattatactttcatctatttataaaccagaatgtgtttatagatgatactgaggctcaggtggacacttaatgtcatcacatagtctaatctggggaaatggatttttttttttttttgagagcctccagcctcccttacctaggctggagtgcagtggtgcgatctcactgcagacattgcctcccacctttgcatcctcccacctttgcattctcccac

SEQ ID NO: 16477 - DNA, 72549 bp, Human
  misc_feature (1)...(72549): n = A,T,C or G
ggcttctccctgggctgcaggaggggtttctgcggcgcaggcgcaaggattgccgctgccggaggctgagcggctgcggcgctttgtaccggcgaaatctgcttgggagcagcgatctgtttggccagtggcaggcggatgctcctccccctgatacgcacgtggtcttgtcccttgctgtaggggctttctgctcagatctccagactgaccccagggaacgccctggtacggggaacctaggacttaacaactccaaggaagggagtgtaggagttggggagggacagtgtccccatctgcaatttccggtcattgacagggattttaggccccgctgagagccagggatgcatgaatgcgtggagggaaatgagttgtaaacagagtgtaggggaacctggcatctccatgctgctttgctgcagctaatatgttttgcacccggggtacatcattttacctctgtaagcctcaatttcctgtctgtaaaatgggaaaattatgcctagtgttcctgggatactgagctggcttctctgtgaagctaaaacctcacctctattttaaggcccaggtgtctctggcctcctgccctggattaggggactggcccctggggtggtgaaggtcagggccccagcccccaaccacagtgctgggggagctgtaccaagcctaggccaccctcgctctggatggcaacttgaaagcagaaaagatgagtagtttcataggacctgtggggttggatttcgcatgcagaaaatgaacaacgaagtggtggacaaggttggtgttttattctgcctgggaacttggggcacctgtccagtgaggttggggcttgctggggctcccccttttcctccatcttctttcatcttttcccctctgctgttacggaccttgtcaagctgtgacctggcttcctgcccacctccctctggagcaacatctggatcatggactccggggctggtgtccacagtgctgggaggcaggagcaccctagtcctcctcctgacccccagcttgtccccagggctgtggagaccttggtgccagtggcccagccctccaaacacctgctgtcttggaggcaattctgtggggtgacctggtggccccagtgtcaggctgctgtgtgatgagggagctgctgttggagtagaacaggtcagcattaattaaggccgtacccttctgtccctgctgttccctctgccagttagggggctccaccttagaggcccccagggagggctggttcaatgctaggatggagagggtggcagggagaggcttcgtggtggggaaggcattggagatgggtctaggggagtggacaggcttttgtctggggtagactattcagggagagggtacagcgtgaataaaggcttggggtccgagatggaaaaagtgcttggtgcattcagggagaggcactcgggaaggataaacggaggctatggaaggagaggcaagaggggagcggtccttgggcgcgatcctggagggacaagaacgttcccagcagcttgggccgatccttggcccccgtcccacactccctccccccacacccccgcagatgttccggggaggcctccagacgcgcggccacacacctgtggcgccgcccgcgggccctgaccgcgccgtctttttcttttaaaggagccctgaaaaccatactctctggatcgcgagagcgaggccagggcccgccaagggcgtgtgcgcagggcgggggtcggcggggctgggcgggtggggggcggggggcggggtgggagatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacggtaagcggcccccgcccccgccgccccgcgctggcctttgtgggctgggagtgggcgcccggcagggtccagatccacggggcgccggcaggggcgccccccgaggcctcctgcgtcgccgcgggtggggcggggccggtctcgggatttcagccccctcccccagcctctggggacaatgggggtgggggagccccgcatggcggggcggggctggagccgggagtccctctccccgcgggcttgccgccccctccccccacgggatgtgccagaggatggcgtggacagggaggatgcggagccgaacaaaagagggaggggcaggggtccgaaccccctccccgcaggcctcgcgcgggggtgggagggtgagctgagcctccttggctcggcccccgcaccgtccggcccatgcaccccacagcccggtacctcccccgctggaggagggaaaaagatcatccagcgctccccactccccgcctttactgatggagtggaagtccggacctagggacagcgccatgatggaagctcggtccacccctccccgcagctaaaaataacctaatggggcgacgctggcggctgcggcccgggaagggttaatgttcccgacgctgggccgcgagagggtggggacggtggtggaggcagaacagccgggctgcgtccctgggtgtggccggaaacaaaggaatccccgtctttacgctttgtctcggggtggggagctgagggcgcagcggtcaggagctggccctccgccccagttcctgcctggcatcagcgtggagcctgactgttcctgagggatgcggaccactggagcccatgtatgcaggagcagcccggggccgggaggcgggattctgggcgtggtggaatcctccagggtgactccagaggtttgactactggagacccagcctgctcatttatgcaaaattcaggctcctggacagtcgcagggcacctgccagagggcagccttaggtaggcggaggtattgacacttgcactcacctgccagtggcctgtcccgtgtattgcaggcctgtttctttaaatggtggcagcaaggctttgcgggtggcattacccacgtaaagctccctgaggctagagcatgggctgagggcttccaccacaggaaggtcaggagggaacccaggccccctgcctcccctgcactgtcctgcatccgccccagctctgggctgagtcttgagttagaaaattcctcctgggcccagcctcagctcttgtcagcaggcctctgccaagcccccatccagagggtgggcaccacctcttctccgtctctcagctctgccctctgagacgcagaggtgtaagcggcccattcgtaaacactagttggtcaagaatcactagaacacatatggttgcttcctcctgggcaatgtgagaagaaggcaggtgatatttgaacaagtccctgccttgggaccctctaaccctgcctcccaagggaactgaggcaggtgatggggtcggggtgatgcagtgactcaggagtcaggagttctgggtttgaggctgtgtgcccacagaaggtctctgctgctctcaggtccccagtctccaaggtggaaacttaataggatggcctgcaaggcaggtctgtgggatgctgcctctgaaagtgtgcagtcccagtctgctaagctgaagtggtcaccaggcctactgcctgttgccctctggagtggagatgcctaggcttttccagccaatggagctgggtgtctgatgcctctctgaacctcagtgctctgctgtacgatgtaggccccttcacaggactcctgaacatcctaggtgaccctccaaagcatttagtgtgctaggtgcatggtaagggcttcagatctgccgacaggtcttgctgctttagttcttcctgtgaaacaattagtcaacttgtgtgtaaagagaaatcaaatgggtggttccagcagcctctaaaggtggtttcaatgagcatgggaaggagagaggctgtaagttatgcttagttcctgggaaagagggccttgatgaggatcatttgtgttcatttggcccacatcagccagaagcgtttgtggttttaaacaaatcaaaaccttcagcaaatcagagaggatccacttgaatggggcttcactgtataggacctttcatcttcctgagtaccttttgctaataacacacatacacgtgttgtgacaggaaccagatccctgccttaaatgccatgtaacaaatgggtgagcactgtggcttttcaaatggctgcaccttaacgtgttccatagtagtcatttgacaagttaaggcaaacccattggctgttagtgggtttgcattaacttgtcaaatgactgccataccaagcacagtgctgggtgccaggaagagtgggaaggagatgaatgggtttgccctggcccttctagagcttagccaaggctgacatttcagcctgaagtgttagtgaagtgtaaagggtatcatacggcggggcggaggaaaccccagcagggacactcagcctggtcctaggggagacagaggggacaggaggagagcagggttctttgtggagcccatgggtccccagaggtaaaggagttggcatgctggagaaactgaaggaaagacggcctcgggagagcccaccctctgcttcccagggcaaccgctgcacagttagatcaaatcatgaaggcagttgagatgtttctgacagccatggtgtgtggcctgtggagagacctgggggcttggaaaggatcaagtgtggttcatgggaagaagtgctggtgtagcaggcatagctctcagcttcatccccaggtccccacctgcttgttgctgggtcatcctgtgcccctctgagcctcagctgtctcatctgcacagtggggataagggtgtagctttgccaatgagttcagagcctggagaggtgggagctagagtgggggaggtgaaggggcatcacaggcaggggcgcagcatgggcaaaggcaaggaggctgatcgttctgctcatgttgacgatgatggtggtgtcttcctcttttttccatcttggcctttttctgagacaatatagtagccggttagagacggaagagcaaaaaagcagaaacacttagctcctgcccccaaggactgtgtgaaatatttataaagctctctttcatgcgtgtcttttttttttttttttaatgaatggcacacttggggattaacttagctgaagcggcttcttgtgcccactgcagtgagtagagcatcctgggtgtggctctgagcaaacaaaggcacatggcttcctagccctgcagaagctgttggctctgaatagagctaccgaagtggggaggcctgctcagttgtgagaggagtaaagagtgtccaccatgatgatgacggggtattattaaaaatgaagcttcatgagtaccgatcacatgtgtttttgctctagtccaagcattcggcacaattgccattatctctcacctagttctatgcacagaactgtgagaaaggcagcctaggtagatcacccctctttcccaaagagtaaactgaggctcagagagattcagaggcttgtaaaggttcttcattggccagtggaggaaggagagcttacattcaagcagggaggataggtgggctggtctgcgtgctaggaaaaccactgcccgtgtgtgtgtgtgtgtgtgtgtgcatgcatagttgtgtgtgtgagtgccagtgtgtatgtaaatgtaagtgtatgtctgtggtgtgtaaatgtgtttgtgtgtgggtgtgggtgtgtgtgtgtgtgtttgattaaacagtgaagatgatcaggaaagaaggatcaagtaaaaatcacatcaggctcgatttgttgctctaatttgcaagtatgcaaaaaatgtgtgaggcctattatgctttttcccaagggtgacattcagcctatctatggatatccagttgattccctgcctttttacacaaaggatttgagatgtccacagtgatttgtcatgcatatggtgaaatcagatggaagtcgaatagcaggactgaggatcaaggaaggacagaacaaatgtgccagtgattaggacactggagtggccatgattagtcatccactactgactctgagcatctgtcatctagggcagagaagcaaacaccctccatgatgtcaaggtcatgatcagagaggaagaagtggaccatttttagggaaaacattattttgtttaaatcaaattcttaaaaatgtctcagaggggacataaaagtgaaagtgacataactataccaccttaaccgtgaatgcccatttcttctaataaacatggccaagactgaatacatggagcacacacaatacaacatacatgagtgtgcatggcacatagtaaatatctaacaggtcatagctctgttctgaaaactcaggctgtgtctttgaggaaatgaaaattcagaatggtagctaaccagcaggtgtggtgggcaagcatgtgtgtgtgtgtgtgtgtgtgtgtgtgtgtgtccctgaccttaattatcttgccatctaagtgacaaagtgcatgcacataaaacaacttaagaaagactaaagggtgcctgtaatcccagcactttgggaggccaaggtgggcagatcacttaaggtcaagagtttgagaccagcctggccaacatggtgaaaccctgtctctactaaaaatacaaaaattagccaggcatggtggcgggcacctgtaatcccagctattcgggaggctgaggcaggagaaattgcttgaacctgggaggcagaggttgcagtgagctgagatcatgccactgcacttcagcctgggcgacagaatgagactctctcaaaaaaaaaagaagaaagaaagagaaagatagaaagacaggaagggagggagggaggaaggaaggaaggaaggaaagatggaaggaaggaaggaaagcaggcaggctgcggaacagggcacaggtgtcagaggaattcagagaagagatgactcagccctggcagaagcaacaagagatggcttcttggggtttggaggatgacatcagccaggtgttgagggacttgattggttgagggaagggaagggcatgcaaggtgggtggaatatttcacacaggtgaatcagaggacgcagaagtggaaatacatgtgaatgggtggggctatggggggattctataaagctttggaaatcagggagaatgcacccaaggggatggaaataacacgtgggttctaagtgtgtcttagatatgaatgggttatttgatgttgagcaagtcactttctctccctgggcctcggattccttttctggacagggagagttggattagataattcagttccaagttctaggccactctgatcttcttctttggttaataggaaggcactggaagttcttgaggtaagatgctgttattatgaaagcagcttgtaggaatgtggattctgaactcagactatctggctttgaatcctggctgttttacttactagctatgtaattggacaagtcacttattctttctatgcatcaattttatctgtacagatttatgtttggaaatcagaatgatatttcctaagattttttccccatagaattaaatgacttaatatgtgtaagatgcttaaaatagtgcctgcacatattaaatgcaatgtggattagctcttattattattaccgtgggatggtgtattagctttgctccatagcatacaaccccaaggtgtcaacaatatacacttattttttgctcatgctacatgagggctgtgggttggctgtaactttgcccctgtttactggtgggtagtgagtctactctgtgcatctcctcactttgagacccaggctgaaggagaagaaaagcacaagagattggcagcaacctgaaatatctttaagaacttctactcaaatgtagcatatttcacatctgctgatagtgtactggccaaagcaagttgtatgatcaagctctaaatcggtgggagagaagcacaaagtcagtctttctagaggagatgtgaggattgaatgtgaaagttctgacatgtaaaagatgctaatacacacccgtggaagctgataatgaggtggtcaggaagcacagcgattgggtttggaagaaaaatcccaccattggttcttaggttgtattggatttggtagcaagctcgaaattgaggtgtctcaatggacaataaggaatagattggaatgagggtgagaggcaaaggacagagatagatattaggggcccatgtacaaaaggtattggtagaagacagaaaaatgcaagctatttcaacaaccagtggttctcagcctgtgtgctgtgagcacagtggtgtactcaaaaaaattctctgccgatgtgtggctaaattttgatcagcgtttaaaatttatgtttgctacaaccaagtctacaaattattgtagcatctctcaggtggagccctgagtattcacaagcagagagatgttgaatagagtctaatttgctgtaagtaaaagtcagctcttgccatggaagaggaacaccggaggactttgccgtgagagcatataaaagaacatggtcggggcagtggacagcaccacggtgctgaatggtaaccaagtgcaatcagagctatgatagacctgtaagacagctacagtcacactgcagtgggagggcatggtgatggttgcagacttacctggtgtaattttaggtctttaatccttcaagaatgctgcaaaattttatatgatttgaaagtatgtcctgagtacagtaaggttgagaaccattgccctagagagctgtaatgaccaaatcatagctttgctctgagaagaaacaactctgaattggtgttggtagtttgggaagtggagtgggatcttggatgcttcatagagaagttgtctagaaaacaagagcaagcagctaaaaggaagaaagcaatgtttgtggatatatgaggttgtagttccccactccttccttgggcctgtgtcccaggcatccagagcattcgccttgacctggcacaccatgtgtggccctctgcctttgtatcagctgtgtccattctctataaaggattcctcctcctgggctgggggtggtgagcacttcaatttcagtaactttggcttgttgctcatgtccatctgctccgcttgaccatggatacttggaagactgggaaattgtctgattctcctcaggagcccttcaggaacactggggattcacagtggggatgccacactgtgtgagtgagtgaatgggagcaagattgtggacttccttgctgagtgaggtttcagccacagctgcatttagtcttccttaacaaggcactgtctgtggatttaacatgaaggtagttactatgcagaatgagatgaaggtggcatgaggagttttggagctcaaagcgaaaagaaggtgtgggggcccctgaagtggtgctttgacaatggggagagggcagatctggtttagtaatgggcttcgctgcatttcacatggaatgggaagcttttgcaaaaggtactttttacacacaagtgggatcgtcacattgcacatcttgtgctctgcccagggccttgagtaaataatgacctggtgttggaacttggagtcaattccatgggaagactcattggatctgatgcagaattacatacagcaaaaaggtggctatttgaggaaattttgaacctgcccccaaattatgttgccatgtatttttaaatcataccatatccatagacccttagggcttaaggtctaataaaatctcagcaaatgtttgatttctataacctcaacgttgaatggaacttttaaattatgtaaaattttatgttgtacaattaaggaggaaggaaaaagtgtctgtctactgcttctcccctgcccccaccattctcccctcagtgcagaaattcccagtatgttctctgcatacctccaatgacagggagatcaccactttacatggcaacctgctttactcttgtacagctctgttgttggaaggctcttctttatgtagagtgggattctgccttgtgccttacttttgttctcaagagtctccccaagtttcttcttccacactgctattcctagaggcactggaagatgtttctccattacttaggaccttctcttttccaaaaccactccaattctttattcctcctctatcatgatttccgcatacggtgttaggttttcctttactttctttcattttcctttcctttcgtctcatttttttttttgctatattttatttctgaacatgcagaataaaaaggaatccaaataaaactttaattactgggaacctcttaaacgagtttaaaggcttcctaaggccatcaactcctctgagaagctgataaaagcaattgaagctttttcctgcatcctcaaatggatgaacatttggcatagaatgttagagcatttggcatagaatgttaaacttcataggacagtgttcagtgtattgggtgcttttacatattatttcaagtaatcttgtgaggtaggtattttgatgggttccatttatagatgaggaaactgaagccaacagagattaagtatcttgccaaagatcaccccgctaagaagctatgtgggaataagctgccatctctggtgccaaggatttcagtctcatgggggaaataagatatattacaatgagctggaaaatgagtgtcatgaacaaatgctggaccagagatgcaagcctcatgttgtgggaactccaaggagtgaccttgtgatcctggactcaagacactgcacgtgactaaggagttggaaagcaatgagcagagcagatgtggccagagatgcatgctgcagggaggccatagaggaaggcacaggttgtgaaggtgcagttagggaggcagagcgtggtgtgcgtagatagatgtggtggggcgcggccgagagagggccgggctcaggccgggaagagcctaggaggtgagctttgtcctacagatgaggacaagctggtgaaggattttgaggagaagcgaggcatggttggatttgcatttcagaaaggtcactctgcctgtcatatggagtggacaagttctgtggcagggagatggggtgagggcttatctggggcaggtgcattgggaggtgaaagtcagcaggtaggtattagaacagttccagagtagatgcaacaagatctaaaaaagagttaggtttgaggtgggacagatgagagataagctgaaaatggaactgagcattttaatgagatgttaccccacgttgcaaggattaaaaaaaaaaataaggcactgtgcgaagtgctatccgtgggttaattcatttcacattcaaaattttcctctgcatttgatgagaaacagaagcacagagaggtgaactcacccatgtgacagagtttggaggtgtggggccacgttagagcctaggtagtctgccctctgcacccatatcgttaggtgcagtctggcctctgcattcatatccaaacatcgcctctttgttaaatgagcatgtaatgagagagtaaatataagcacctggctcccaggaggcattggcaatgtttattagatgacaggtctctgcatgtaatgtatttcccctagaaagccttttgcagttttccgaggcctttaatctgccttaaccacttttgaccacattcacgataatcgtgtcaagagggcaggtgaggtgcaaggcctggggtatgtacttgataaacactgagcagataagtgtagtctatcactgcctgtccctattttacagagtggggaactgaggctcagatgtatcaactaggtacactgaagagaacactgtactagtctcaccaccgagaggcagtggggtggtctctgtataggtgccaggtggaattcggttcaaatcctagctgctgtaccatctcttggctgtgtgaccttgagcaaattacttctgagtttcctcacttgtcatacttattcccacttttaaggtgatttaagaattaaaaatgaaaacccatgtaatgcagaactgatccttaatatgagctcaaggaatgtgcacttcttaaggcaaaggagttctgttcggatttctttctataaagcaagaagcacagaccagaacacagagaaatgggtcaagttaccgatcacacatgcagctagcatcgtctttccctatgcagcgtgcaggccctgcccactcttagggttgtgacagaggtgtgctgttttaaaatcagatattcagtccatcagggagtgctccctgaaagtctgctggtacagtgggacctgaaattgtgcacttataactgcagttgtcatggaaacaggcataatatcggggggaaaaaaagtcctgcagtccatggggactacctgtatctcccattcatgaaagggggaaagccgccctgtcccctacccgtgagagggggaacgaatgtgtgttaattagattcaggctcataccggttgccacttcgtgggttgcattcctggatagtgtggcaaagggccactggctgacaggctgtcgtccccggaggcaaaatcaaaggcaaatggatggtttctgtgaataaatatgagtgtgcagctggatgggatggcagcacttgccgttgcaaggaggccagagtggggagcttgctcaaggggaaggctctggttattcaaggtagggaccaagtcatggaagtttgacgtatttgagctataaaacctcttatgcagcaacccctgtggctcccagcacagaacctttacgatgtattaatttgctttgatgcgatgatgctgcctaacaaacaccccctctagactctgtgccttacagcaaccaatatttatttatggcaataggtttgtgggtggtagatgcttagcagggctcaactcaatttgtcttcagtcttctgttggggtcaggtgtgctcctcaaatcctctcattctggggctgccactccttgggtcctgtggttttcatggcaggaggtggactgtcagggaaagctgaacccatctgccccttaaagcttgtgctcagactggtgcactcccagccaaagcaggtcacatgggcagaacacccacagtcagtggggcaggcggctgcactgcacccactttggggcatggtgaggacttgccacagagggtctgtgttgaaattatctggggatgtttgttaataatataaattcctggcttgtaatctagatctggtgaatgaatatcttgataaaagccccgatgggaatttttagcaggcaattccagggcattctgaggaccagctgggccatgctgtcgtgctatcagttttcagaaggagggtggtggggggatatgcctaccgatcatcttgaagttttgaattgcgaatatcagcttcaacatcatgagtatgtggcctttaaaggactaaaaactttcaaaacccaccttgacatttcctttgttctaaaagaaagcagttccccctgcattcaatgcttggataagcacatttctacaaaatgggctcccttgatctttttgaggctcatttccctgcttgctctttggaaagaaagggtttcttcatctttccagaagagactggtcagttagttaccctgagctttcctgcccttcccactgaggaatcaggtaacctcatctgaatttgcgtggcctctgagaccctatgttgacacccacctcttcgtgattgcaatgactgctctagtgggggccatgggagttgcttgccctcaccccaacttcctggggtgggagaattaagtattggaagtagtgtaaggtcttcatctaccaacactgaaatgtacttgccaactatgtccactcggaaacataagtcatgattattttgactctgcaaggccaaaagaagaagttttgaaacaaaacttttttttttttttgagatggagtctcactctgtcacccaggctagagtgcagtgacgtgatctcggctcactgcaagctttgcctcccgggctcatgccattttcctgcctcagcctcccaagtagctgggactacaggcgcctgccaccatgctcggctaattttttgtattttttagtagagacggggtttcactgtgttagccaggatggtcttgatctcctgacctcatgatccacctgcttcggcctcccaaagtgctgggattacaggtgtgagccaccgcgcctggctgaaacaagactttttttaagaagctgagaaagaaaagcagtaagaaactataaggttggatgtggtagggggctgaggggtcttcagcatcagggtttggagaaaactcacggtctctgtgtccagtgtcaattcaggaccgcggacagcaccaacccccacctgttcctcacctacccacagtacctggaactttcagaagaccgtgtctctgtatctaatgtttatttggctggaatgtttcccttctcctctcccaatttttctagacttctgaactcctatttatattgtggaactcagctcaaatttcccctccttgatgacatagtcacagtcttttctctgtcaccgtaataacagctttggttctctgctatttttcagatagccaaggttgctaaaccagtgatttttggatagaggttgattggataagaatagcatcccatctcttttttttttttttttctaaaatctagaccttaatagattttgtatgccttctgacatccaccttcatggtggagatgacagatttattcccaccatgcaggagggagaacagaacccggggaggtttaatgcctcactcaggaatagacagtgatgcagaacattcactgtcatccagaacctcccctctgagctgaggctgactgtggttgctgctgtttgtttttttgttctgtggataaaaatgcctgaagctttaaaggctagtttttgtaagcagagctcaacctaatgcttaatgtttgtgaaaaagaacaaaagcgtcctgccaatgtcagctgtctcctcccagtgggggctggatgggagatgacagtaggtttggagaagaatccctttctcttgcctggctgctcctctgactcatgagacatttggcagtagagacaggaatgcagcccagcagggttttggtagagtcttcgcgaggacgccttcctgcagcatctgtagcgtgcaggctttgcacttgccaggcttctctctcagctagtggggttaggttttcaggaatttgaaaagcagaaaagagagatttattatgtgtccatgtattcttttctccctttgtttctctcttctctcctttctttcctcctccttccatctttcctttcctctttatccttcttttatctcttcttccttttctctcctttgcactccctctctcttttcaaacgttctctttcttctttctctgtctctccttgcctcttgtctgttgcctccctcttcccctcctgcccagcaaacatctgctaaatactgtgtaagggtcctggctggttcctgaggatatagagatgaaatacgcagaactcccctggccatgaaggggtatccagctcaatgagagatgggcacatgaactgtgaccattgggggaaggttgtgcattgggagacagctgtgcattatactggcggttagatcatgggtgtggaccccaaagtctccgtaggggaagccaatgactccagatccacttcattttgaattcctaacaaagaattttgtagtttgctttttctcctcacattttattatctagcacttttgttcgtgcttaaaacttcctggaagatatttgagtagctgtagtagctgaatgatacttcattattggtgtggttataccattgtaattaattctggatcgcatctttgtgtatcattttgtgaccctgttttggatattttctagaggacaaattcccagcactaaatttatgggtcaaaggacatgaacattgttaaggcctttgatacctgttgcaaacttgcctgctacacattcttactgaggaatcccagctttgaggagaagataaagacgattccttccccttcttccatttccacccagcgctcatgtgatgtcttagcttggaaatgtttctatcttccggttcctccctgatgaaaacccctccatgaccttcaccacagagcccagactcccctttacacatggcactggggtccctgagatctggcttctgcagtcctttccagattccccactttgaggtcacccttcagccaaagaagaccacttacagatccccaggcatgccaggctgcttctgacctctgtgtctttccccatggaatatggtctggatctctgtccccacccaaatctcaagttgaattgtagtgcccagtattggaggtggggtctggagggaggtgattgaatcactggggcggatttccccctttggtgctgttcttgtgatagtgagtgagttctgaggagatctggttatttaaaattctggtacctccccactctctctcttcttcctgtgaggtgctcaccccccaccccccactttgccttcagccatgattgtaagtttcctgaggcctccccagaagccaagcagatgccagcatcatgcttcctgtacagcctgcagaatcatgagccaattaaacctcttttcttttcttcacaaattacccagtctcaggcatttctttatggcattgtgaggatggactaatacaccgtgtgcttccctctctcaggatcccttttcgcctttgctgtgtggctaatacctactcatcctctaagcttagagggaatgcttttccccttagcagggttgatgtggaggctgcctccatgctctgtggccctctgcatttcccacactggcagcaaaggccagcagttgacttagcctccctcactggcctgagcaccccttgagggcacaagctgcatttaagctgcttacacccatccttaaacaatgatttatagagtggagttctagccacagaaaatggcagagaatgaacaatgagctcttcacctgccaggcctgggctgagtaagcacttcaaatacatgcctaggacgcagagccaattatccccatctcatagacaaggaaactgaggctcggtaagtcacatggataataagtgaagtcaggatccaagcccacctctgtctgagtgtggacgttttgcttttaagcggtgctgacacaagaacatgatttgctctaaaggtcattgctgtcgctgtggaacgaactgtatctctgacatgccctagctaatcaattcagctgttagactttggctgagtttttcatgagatgctttatttcttcaaggtttatacataataattgttttttgagatggagtctcgctctgttgcccaggctggactgcagcggtgcgatctcagctcactgcaacctccgcctcctgggttcaagtgattctcctgcctcagcctcccgagtagctgggattacaggtgcctgccaccacgcccaactaatttttgcatttttagtagagacggggtttcaccatgttggccaggctggtctcaaactcctaacctcaggtgatccgccaacctcggcctcccaaagtgctgggattacaggcgtgagccaccgcacctggcctaggttatacataataatgtttgtgcagagcgtaccattgttcacatctgctgttttcccctcacagtaaccccgtgagaggcaatagacggcaccggtattatttttttttataaatatgtgaatttggtgttattaattttaaaaacatatattatgtaacatttacttttttagtatacagttctgtgcactcatatttcctgcatgagaaaggcagccttagaaggcaaggcccgttgatcttattacttgggtgggggagggttctaagttctatcttcttatgaggtgtcatggattctagagtttgggaatgtttaaacatgggacagaagcatggcttggtggctggaatgctggacaggccattaggaacccttggctctagcctgcatccttactggttgtgtgaacctggaggtcacacctgttcgtggacctcatttccctgcgaggtgggatcagacctaacattccacacggaccattctgtgcaaatggtcacaaagcacgtaacttcaaagcccatttcctacggtctcttctgtgggaaagtatcccttcagattttccacaccacaaagggacctgagtttggaaaagatatcaactcaattctcctcttgagtattcgtatcaaatatcagcagaggcaaggatctgaaaagttctgtcataaagacatcattgcttctgcttaacccagagatttctttttttttcttttttttggtgggcggggagcggggaatctcactctgttgcccaggctggagtgcagtggtgcgatctcggctcactgcaacctccttctcccttgttcatgccattctcctgcctcagcctcctgagtagctgggaccacaggcgtgcgccaccacgcccggctaattttttgtatttttagtacagacggggtttcaccatgttagccaggatggtcttgatctcctgacctcgtgatccgcccacctcagcctcccaaagtgctgggattacaggtgtgagccaccgcacccagccttaacctagagatttctaaactcacggcaccgggtaacccctgtctgggcctgtacctactaaaatctctctgagcttgagttctgaagcacatggctttgaaaatgcctgtttaagaggcaaaggaactactaattttaagaaagaacatgaagaggttgaatcagtgcttggcttcctgtgggcttattttttcagaagtagaccagcacctgagagacactaagggcttggagcctgggcgcccctgcttgcagtgtctattggtagttggggagggagtggatttgaacatgagctccaccatctgattctaggaaaagcatagcaggttgggccaatcttctggcacacagtgcattaaaataccacctttcgggctgagcccgaaaagccccctattaatagtgacaagacagacgggtgcctgcggggcggccgtgttccggaagccatgcaccagctgctggtgacttatgtttcctgttctggagccggggaaacatgcacgccagcttgtgggtgcttcctggacgtgcagagcctgggcctctttttcccattggtcccggattgccgtcaagaggcttggtgagtttcctctctggggatgcacacatcttttttagcggtacagataggttgtggggcctaggagcaacttaccttgaaacatcttcctccagagaccctcctgctgaagaacgggatgtgcctcttcacactggtcttcctcggctcacagctgtgatgcctttctctccatcttcacccattcatctgtcaagaatcagttcagtcacccaggcagccagccaggctgtgtccaagatgccggagagacagcagtgaagaaaacggacaaagtccgttgcctccgtggagctcacggtctagtaaagacaagtgctgtgcaaactccaggcagtgccgtccccaccaacgcctgtgtcatgcgtcccctggggagttgtgtcctgcactgccagtggggtaacacaccaaagctgtgattccagtgtggcaagttacattttagacagacctagaaatacatagcctgccagatgtgccgtaaatactgtgaatacataaacgggtaagggatgtagggccagctggcagggtggtggtgtgtgttgtcccaaacaggggaagtcgagcggagggcactcagataagtaacatcaagcagggcccaaagcaagtaggagcaggaagactgccaggaacctgggactccagattaactggggtctcgctgaccttggctttcactctgagggaagtatgattctgatgcaagaagctttgagcagccgactgcatgatgtgtttctgatgccttagtttgggttaaactcttcttctctgggcttgcagggccattgtggctgatgccataagaccatgggacctggtccaggggaccactgaagtgccttctgtgcacttcctcagatggccttggcaagatcaagctctggttgcccacagtgctagccaggtcaatatgcactctttattggattcatttattgaacaggataccctccctccagaccctggaaccacctcccagatgtaccacctgcctccaggttcttgagttaggctctgctgtcagagcaccacctactgtgggttgttcttgtcagtttacttcttttctttttcttttttttttttttttttttgacggagtcttgctctgttgcccaggctggagtgcagtggcgctatctcggctcactgcaagctctgcgttccgggttcatgacattctcctgcctcagcctcctgagtagctgggactacaggcgtctgccaccacacctggctaattttttttgtatttttagtagagatggcgtttcaccgtgttagccaggatggtctcgatctcctgacctcgtgatccacctgcctcggcctcccaaagtgctgggattacaggcataagccaccacacctggcccagtttacttctttctcccccacccaagggatgggcttcagggcagacactgtgtcttcttcgtcaccacatctccagcctggagagaatacaaatggtaaaataagcacatggaaaaaaattacaagccttcaagaagtggaaaattgccaaggcacggtggctcacacctgtaatcccggtgctttgggaaaccgaggagggaggattgcttgaggccaggggctcaagaccagtctgggcaacacactgagaccccatctctacaaaaaaaatttaaattagccaggtgtggtggcacattgcctatagtctcaaatattcgggagtctgaggctggaggatcacttaagctcaggaatttgaggatgcagtgagctatgatcatgccacttcactccagcctgggtgatagagtaagactctgtcttgaaaaaaagaaaaaagaaaaggaacacaaattaacaaacattaataataaacaagagtgcttagtgttttcgtgcaaagaatggggcattccttttggaaagcagtttggtcatctttatcaagggctgtaaataaggtttatgttgtttgacccagttgttaagcttctgagaactttgcctaacaaatcattcaaaccaaggaaggagttttgtgcacaaaaaagttcattgcagcaaaatacgtatcactgtacaaaacagaaaatcacttcagtaaccaacaatgggggaaatattaaacaatttattatgtatccctaagatggagtattttgtgattattttaaaagtatagtcatgaagtgaggccaggcgcggtggctcacgcctgtaatcccagcactttgggaggccaaggcaggcagatcatgaggtcgggagattgagaccatcctggctaacaaggtgaaaccccgtctctactaaaaatacaaaaaattagccaagtgtggtggcaggtacctgtagttccagctactcaggaggctgaggcaggagaatggtgtgaacccaggaggcggaggttgcagtaagctgaaatcgtgccactgcactccagcctgggtgacagagtgagactccgtctcaaaaaaaaaaattatgtatatatatatatatatatatatatatatatatatatatatagatatatagtcatgaagaatgtgcggcaagttgggatgtgcttatggtaaaatgcagaaaggacagaactgtgttctttttggttcccataatgttctggtttctgacttgcatatcatttcctctgcccggaacactccatatggtgaagctttgtttatgtttatgcataaacatgtttgtggctgagttccattctggaatggtattgacaaatagaagagggttgaaagcctagtctgtgcccttaggataggctgagggattgaaaacatcccttggagaacatcatctgaatacatgaatgtttacgtagacatactcatacaatcctgtgtgtgtgtgtgtgtgtgtttatctatccaccttcctctaatgacacatccatttatctatctatagtcatacagagtgtagatataggaagtataaatagactcttttttagacttattttctgggtctgcgctttctctgcccaatgccccagataaggttggcagcccctttggttggcttccatggcaggtccccacttttctcctcctcctcaaccccacataccccatgacttgataaacatctgtctctccatctgtcaaccccctgaaagcagattccagctctgtgcctggtcccctctggagctgagagcatcagtcggtagctgatcggtgcttggatgagtgagtggatgtgtgcactgtgggggaagaaaacaggaaaaagagtggggagacatcagaatgtcaactgggagttgtactggaaaaatggggttttctttttttagtctcttcactatctttttaaatgtctctaagttgatcattatcatatttaataataccttgataactccctgttctacaaatgacccaatttcttcaacaaacgaatgacattgaaaagggaggaggggccagtgcagatgctgacagaggctgccgagatgatgaggcaggtgtgctgtggggcctggtatggctgttggttcaaaccttccaactacaaaaagacgtctatgagaccatcaaggcacattgaagagggcctgattattgactgataagcaaggtattaagttaattgagttcgttgggataatggattctggttttgtttctttaaaaagtccttacccctttcctgtttagaaaaaaaagtgcagcttgctgcccatactcatttctcggggcaaacgggaaatgggttaacagtgagagagatctagtgaagtatttataggtggaaagatacagtgcttgtgctttgttttaaaacacctcagcaaaaacaaaacaaagtgagaggggagaaaggtgaaaggagaataggaagtattggatagagaagtattgaagctggtgatggatctggggcgggggaagttaaatgcctttacttttgaaaatatttgataattcttatattaaaaattaaaaagaaaaaactttatcctggcttttcaccaaggatccttaatactttgccttgctttgcagagtgaccgactcctcatcaaaggtggacggatcatcaacgatgaccaatccctttatgctgacgtctacctggaggatggacttatcaagtgggttgatcaaaacggaccttttaagaaacctgtgtcgccaggctgcctggccttagatggaacagaaggctggcattctgtcctagaatgacggggctgtgtacctgtgtttcaggggtagagacctcacagaggttgggggaggtgcacactgcgggtggagaaggggctggcatttcttgggtgcccccccgggctaggctccctgccacacggctgaggcagctcctctcttgcaatgctcacacaaaggctgcaaaatgcagacacgtttcctgttttgtggttttggaggcggcaggccaatgagtctgggtacctggccccatatgacggggtgagttagggtcaaggcccggattccaccctaagacaactgaattcacagctctttcttccacctacccacagtttctggaattgggttgaggagagcagggaggaaggaggaatgtgtggcttccaagcccagccttggcacttaaagaaaagatagacattggggctggagtttccttccctttcttctcattggctccctcttcagccctgcttatgacaacccaggtgtcttagccagcgctggctgccggaatggaatgccacaggctgggtggcttaaacagcagaagtttatttctcatagttctggaggctggaagtcccggatcaagctgccgtcagggttggttcttcctgaggccttcctgaacttcttcctgaggttcttccttggcttgcagacaccaccttctggcttgcagacaccaccttctggctgtcctcacagggccctttctgtgtgtgtgtgtgcacactcctggggtctcttcttctaaggtcaccagttttgttggattccagccccactcctgtggcctcattcaaccttaacaaccttaatcacctccttaaaggccctgtcgctaaaggtagtcccatggggtgggctggggcttcaacatgaattttgggagatacaattcagtccataacgccaggcaggggtctgtaggcggcggccttcttttttttttttttttttgagacggagtctcactctgtcaccaggctggagtgcagtggcacaatctcggctcactgcaacctccacttcccgggttcaatcgactcccctgcctcagcctcccgagtagctaggactacaggcatgcatcaccatgccccgctacttttttgcattttagtagagacgggggtttcaccatgttggccaggatggtctcgatctcctgacctcgtgatccgctcgcctcggcctcccaaagtgctgggattacaggtgtgagccatcgcgcctggctggccttaacattttactggcgggtgaggatcagggcagttctctttctgtgagttgtaacctggatttgctgggtgctcagcctcttcccttgaaatctggaagagaagagaaggacactgtttaaggatccagcatgagtggctggcacaagaaggaaaggcagaggggaattggagcaaggggaaggcagaaagggattgatactgttaacaggatcatcctggggcccgtgtgggctttggagatgatgatggaggaggaggaggaggctgggggaaaggggctgtggagtattgggggcattgaaagggaccacatatgcaaatcacccagtgaagagggatacccagaacagttgagccctccctgcctccccccagcccaccccccaattctagtcccagactttgaccatttcaaatccagcccgggcctcccctcctctggcttcattccttgcttgctcttccagccataatgaaaacttgggactcacgggacttgccaggctgctgtcacctgagagccttgcacccatcagtcccctgcctggaacaccttttcccctgtccctctgccttcccctcatctcttatttgtccttgtgggccctgctcatgcgactcctcctccaggaagccttccttgaccccaagacggtgtggggtgcatccctctgtccccacagcacgtgagctgctgtctgttgcagccactgtcacactgcatcgctccttgaccagggccttgcctcgtggccccccgccctggggcccagcacctgtaggtcctggagcaccgattcagggaaagcgcaaacaaatgaatgctggccatcaggtggtgaggatgctcctgtcagcctcagggcacctggatcccgaatggtcaggaaggcagattgggggtggggaagggtgtcaggatgtgtcaaaaaatgaggttttctaactcaaccatggcttagatagagagaaagcaactctgagggaacacccctttgtgtgggggctctgggcttctgaagcctgaaaggtaaaatgaccctgagaatgatctcgtgggctcccccatcccacacaccacctgctgctagaagtttgatctgaccacacccacccccgtccttcctgggccaggcccccttatagagctccgcaatcccggagtatacagaaggagcaagtggccatgggttgagctgcattcattaagtgcctgctgttatgtgtcaacatcaagagtcctaggactccggctaaccaggctgttgaggaaaaatgcagtttccctaaattcattatctgtcagcccctcttggttgtaatccccttttacttgaacccgttgctgagaagctctctgcgtgttggcagtcctactccggacttgtgaagctgagtgagtgacggtgactgaggcctcacagggcccttgggtgtttattctgaacgtgcatcctgcaggctgagaagggtaggtgtggaagagccggggaccacctcgggtacagaggcacaattactttccttcacttgaatgaaaccccaagaatcctttaattctgtggccatttgccaagttttcttaagagccgttcagctgttgtgtgattcattgaattatgattcatcgaggtttccatttaactcactcagccttggtgaatctagtgccggtggttgagagtttcttctgcaccgggaggtgatggtgttgggggaggggcgtctgtctcattcactgagctgagcttcctctctcctccttccctttccagcacattgctattgagcgccattcactgagtccctctgattcactgggggtcccgtttagtgcaatccctgttcagggacagtctggctcctatataagggaagcagggcggcagtaaagcctgctggtcagagctctgatattaggcttggggagacctgggcttgaatctgggcccatcactgacttgctgtgtggccttggaggagtcactacacctctctgagttgtgctgtcctcttttgcaaaatgagaatacctcctaccttgcagggttgctgatgggagaccagagagagtttgttaagaggctatgattgtgcctggtaagaaagagcctctggctgcagagatggcattcactgttgaacatcaagcatcttaggactctggccaaccaggctgttcaggaaatgtcctgtttctttaaaaaaaaaaaaaaaggaaaaaaagaaaaaaggtcaggcatgtttgttcacacactttgggaagccaaggcaggaggactccttgagctcaggagttcaagattagcctgggcaacatagggagatcccatctctacaaaaaatttaaaaacaaaattacctgggcatggtggtgcaagcctgtgtagttccagctacttgagaggctgaggcgggaggatcgcttgagcccagcaagttgaggctgcagtgagccatgacctgtaccactgtactccagcctggctgacagagaccctatctccaaaataattaaaagaacctctcattagagtacttgttggcccccactgaatggtgactcggtcacaggcttgaatcagactgagctgtgattccgctgacactcacgtgtaggtccgtgcccatgtgtagacacaccacgtgcatgtctacagccagcggcccttctgcctggaccgtgcccaggcctttgcctgagatggcatttggggtgcgaccctgtcctctgttagagctggttgtgagccttcaatgagagaagccgtgatgcgcttagaagacgctgttctccagttgctgttccttttaagttaagggtcgagtgtcttcccaacccctttcccttcagctcttggcaagcccacacgtttggagaggatggcagaaggactggggaagaaaggatttccctaagtcaagttggacattctggtgttattattagtagtggtggtggacattctgggggtaagggattggttataagcagcggcggtggacattctgggggtaagggattggttattataagcaatggcagtggacattctgggggtaagggatcggttagtataagcagcggcagtggagattctggggataagggattggttattaaaagcagcggtggtggtgatcctggtggaggtggacatgtgtggtaacattttctgggtgtccaccttgtccctggcactatgcggtcctaggcttatttcctgggttaagaggacagtgtgtggcacccacttctttgggggagccccagctgggacctgcttgctggcccagcttctcacaggagcccaggagggcagaggctgctgtcttggctgcctggctgtggattctgtctagagctgcacttttggtcactgaagcagcatcttcctgtgtctttattactagggttttttgtgacttagaaaattaatatgctgcccaatctcaagcgttcacaacaattggattttttttagaataaaaatcacccacagtcagatctcatggtctgagccagaccttaaccttggatgctgcagggttcctttcctggttctggctgagcctcttcccccagcgccttgagggacctcctgactctggtgccagcaaataaaaaccagaagccaccgtcatcaataagtcacccatggagatccccgggggcttcgtttctcatttcgtaggctcttttccctccttccccatttggaatttaacctcctggaggaagttttcaggcacctgttacatcagaatagacatgacggtcagcacatgcatcatgctgggctcacttctgttggattcagctctgccaccccctccacctggaagccttcttagataatgagactggatgaaagggcccctcctcgtgcccccgatcatctctgctatactgggctctaacagtctgcccacctgtcttacgtcctattagactatgagccccttgagggcatgtgccctgcctgagttatctctgtctccccagggccttgtgaagggcctggctcagaaatgtttatttcatggaactgaagctgcgggttgactgcccattctacttttcctttaagaaccaaggctgtctctgttgtttgcctccagacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcagtgagtgacactgtcccctgccttagggacatagactgtgaggtctcctccccatcaccagcatcacaagtgctcagtgtgttcgaggctctctgcccagggtgccattggatttcattctccccccagccctatgacacaggtcactgttttacagagcataccgtgtgtgccactggggccacagaagatggcttaataaacaatacggttttataggtaccaattttaaaaaattatttttaaaatattgaaataaaacaacatctcattgatataatcgcttagcatgagactgaagtcacatttagatttttagaaacaaaatttgtttaaagaaaagtattaagtaaagaagacatggattatagggagataaagcaaaaaaaaaaaaaatccttcaacatgatgtgaagatggctatggtttcagaaccagtgacataggtattattgtgacagatgggagaatagaggctcagagaggtgaagcaacttgcccaaggagacacagctgggaagtggttgtattagtattgctgcagtaatactgtgataacaccgcgtaacaaacagcccccaaatcttaagcaacacttgtttttctcatttgagggtgtgcaggagtgggagtggggctggagtggctgtgcttagctttgggttggattcaggcaccatgggtctcccattctggacccagtgactccccagccactctgttctcctggtggatggcagaatgcagggggttctggccgaaacttgcctttcttctcactgcctcatctcctcacttccatgctgcaacttccacccacattccattggccaaggtcagtcatgtggccgagcccaaagttgacaggagcacactgtgccacagagagccctggtgaggttggggagggaaggaaacactgcgggcagtgagaccactccccagcagtgctcggtctgggaaactggactcctcctccattgccctgtgcagcccgatggctgtttcttgtgttgattttgaagagccgcttttgcttggattcattttaataagcaattttaattaaataggccacagtttattgtaaatgttctttcaactgttaggctcttcggtttcaggaggcctgtctgtaagctggccccaaccctgcccatctctcccgctccttcacaaaggagtccctttggaagtgtggtctgtgggctgaagcccaccgccatgggcagagtttgccaagtccctgagccaggagggtggggctcgacttttgaggcaagcactgtcctgatccctcttccaaagggcagcccgtggatctgctggatgggaaatgggaggatctagacttggacttggatcccagtggccagggtttgaacctgagcactggcactcagcaggcaactgcatgactgtggccagcactcagcctctctgagcctcagcttcctcatctataatgtgggccttatggtgggaagtgcctagggtggtttggagacgtacatgagattccttcatgtagtgcatgggacatgagagttctgagagatgggcatggaagttctgggttcaggaggactgcacagggcaggggaaggagtactggatgaggagccagggttcctgggatgtcccctgcttttctccattaccagctgtgagaccctggggagccctgccctgtaagccttatcctcctcacctgtgaagggcagtttccaaagtgtgtttcatggaacaagagcctatgaaagcacacgaggacaacagtccagggctctgaaagggtccccgcccttccccatcttcattcaacagatgttaagtaagagttgtctgcaccaggcactgtaccaggtgaacaaaagcaggaatgatgctcgttgtcaaggggactgccatctcttggggagtcactaatcgtccacatgtatgactagaaactgtgactcctgctacaaaagaagggtacacagtgctttgaactgaggggcagggtctcagggaagtgttctctgaagaagtgacattcgtacagggatctgaaggatgagttggaattaaccgggagaagagggcagagaaaagcagagccccaggaggagggaatagcatgtgcaaaggccctgaggtgagaacacacctcccattccagagactgcagggaggcccacggtgcaggggtgtcgagattgagggatgacatcctgtgaggcaaggctggaaggagaggacaaccctgggcctcgatggcctgatgaggctgtggctctttctcatatgggtgatgggcaatgttgaggtattttaagcagggagagatgtgaactgttctgtgttttggagagaccggtaatagagtggcctggatgggatgtgtctggaccagttgggaggcgattgcgtaattcagctgagagatgagggtggcgtggccatggagtgggcagaattggacagctccagggatatggaggaggccagtcaacagccttcggtgctgggtcacacacgggggcatgtgagggaaaggaagtgccacgggtgacctgggcctctggctgtggaaccgttggttggtgatgtccaccacagctggggtcggggtggggagagtattgcatgaggttttggacattctcatttgggggagcttttgagtcatctcggtggagaagccaagaacacaaccgggttcagagttctgtagctcagagcaagtggtgtgtttcaatgagctggcacaaagaaaagggatccaattagtaagcatagtgaacagtaggggatggagtcctcaggatgattgagaagcggcagccaaagaagtaggacaaaggaacgaaaaagccagaaggtggcgttgccatggaagctggagagaagcgagtttaaggaaggagggagggactctctgtgccctgagaggccaagagactgaggactgcatgctccccattagacctagagatgtgagggtcatattagcaaagcctgatgctttaagtggatggaggtgtgagtgggaggaggagaggtgagacttctctttttgacatctgcctgtgaagggtgggggtgcaaagaaacagggcagtaagcctcaagggaggtttaaaagactgactgcaggctcccctttctcatctactttacatttaagattttatttgaaaaaaggatgatgaagtgaacttgttgggtctcggaggcccttttcatcttggcattctgtgccaaaggaggtagcttggagcagtgggtaagagttcagactgtctgacaggtcttggataaccttccttcttctgcttactagttgtacgctcttggacaattgctttaccctctttgagcctcaagtttttcatctgcaaaatgggtatattaattttcactttacaggacagttgtgaggattgaatgaacgaacttatgtcaagcttttgtggcattatctgacaaatagtaagcattccataaatagttatgatgatggtgatgatgatgacaatggtggtgatgatggtggtaatgaagactgaagatgatggtgatgatgtcattgctaatggttatggttaatgatagtgagtgatggcagtatgacaatgatgatggtgggagtgattatgaaaaggatggtgatgatggtgatgataatggtggtgatggcgatggggtgataatagggatgatgatgatggtgataggatggtggtgatgaagatggtgatgatgatgatggggtgataatgatagtgatgatgatgatggtgatggtgatgatggtggtgctggtgatggggtggtgatgatggtggtggagtgacaatgatagtggtgatgatagtggatggtagtgatgatagtggatggtggtggtggtgatggtgatgattgtggtggtggtggtgatgttagtgataatggtggtggtggtgatggtggggtgataatgatagtggtgataatagtggatggtggtgatgatagcagatggtggtgatgatagtggatggtggtgataatagtggatggtggtgatgatagtggatggtggcggtggtgatgatggtggtgatggtggtggtggtgataatgttagtaatgatgatggtggtggtggtgatggtgatgatggtggtggggtgataatgatagtggtgataacagtggatggtggtgatgatagtggatggcggcggtgatggtgatgatggtggtcatggtggtcgtggtggtgataatgttactcatgatgattatggtggcggttgttgtgatggctatgactgtggcgtgacattatagtggttataatagttgattgttgtaattatagttgattgtggtcgtcgttcataannnnnnnnnnnnnnnnnnnngtggtgataatgatggtggctgtcatagtgataatggtgatggtgtgataattatggtgatgatgatgatggtggtgatggtaatgatggtgatgatggtggtagtggtaatgatgtggctaccattggaacacttgagtctgaagcatcatgatgcatatttctctgtcccagttgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggtcagttaaagcctcggaacggggttttggggaatcccttgttctttggtagatccaaagattatgtggagtgaaaaatccccctgtctgcatctgttctgagcctgattatgagctgcactctgccacgtgacagtgaggaaacaggccagtccctttacagagtccatccttttctccttgaaaacctctgggggtgtccttgttctcagaagcagatccagtctctgcagcctgctgtgcccaggcccttgctgatctaacttcacttttcttttccatcacccggatcactagcctggctgccatccctgaaactggctatgctgtgaggcccttgctcatgtggatcccctgccaggaatgaatgccctttctcctctgcctgcccagtgctactcaccttcaagacccaactcaaccattaccttctcccattgcttcattccttgaatagccaatgccggttacttaggcctcctttggggcactttttccattgttcctggattatgggacatggtttgtctgtctggctcttctgccaaaccctgagctctgtgagggaggggaccacgtctatatgtccctgcttcccaccttggctcccctctgtttgggttcacaccagcacagtgtagacctttatggtgtgtgttacatcgaactggggggaactgatcagaagacacaaaggaagcaaagaacagcagaatggaaagagacagggcatgagcgatctgtccagaaaggggcagtcggggagccctctgaggaggcagcctcaaatggtggtgcttcaaggagagcgagggtgtgtttccaatttttaaaatagctgtgctatgttttctcgtaataacagtatcatccccaatatttaaagaaagtcagaaaatggaaggaaaaaaattgttttcctctggttctacccccaatcacaatttactctaaatgtgaaggattattgctttccattccctgtgtatttggatgatttttcccctatgtggttgtgcaatagctgttatgtggaacccttcttttttcacttaacattttatgagtcaaattacttttcatcaataactttttaatggcttgtaatgtataatataatggttaatttgcttagctattttctttttattgggcatttatgctttctattcgttttattataaatcctgttacggtgaacatctttgtatataaacatttgtttgcatttctaatttttctttagatttccagaagtggaattagaaggtcagaggttttaacatttttcaagattatgacacttattgccaaattggtttcctgaaagatgcatccccttgtacccctgcaaatcctatgccagaatctctagtccctgcacctttgcaccattgggcattattgcttctatgaaatccttgccgattcgatgggtgaaagacaccaccattgtggttttcatggcagttctttactgattacattcaacattttgcatacatttttccttatgtgaatagctgattgtattatttgcccactcttcaatttgcattttcatatgtctgtttaagctctttctatcaagaaggcattattggccatggtggctcatgcctgtaatcctagcacttcgggaggctgaggagggaggattgcttgaggcctggagtttgagaccagcctgggcaacatagtgagaccacgactctattaaaaaaaaaaaaaaaaaaaaaaacatagccaggagtggtggtgtacgcctcccagctacttgggaggctgagcaggagcattgcttgagtttgggaggttgaggctggagtgagcactgcactccagcctggctcatagagtgagaccctatcttttaaaagaaaaaggcattatccttgtattgcagttgctgcgtgattcactgcaactacataacagagtcataatccaaggaaattgacagtcttgtatcttactttccttacctaatgttaagttctgagcaattttccccaggttgccgccttaagcaaatggtcgtttaggacgcccctcactgagatgggagggtctctggagtggcagtggagtttgtagggaaagacactgggctccgtgaggcctagtgggtctgtgctgcctgcaggcatccagggagccctgtgctgtgcgcatctgggctgggtcaccagcaggcgaatggcgatggtgctcaggtcctggcagcaacctttcaactttgtatgcttctatgaaatcaactttttagattccacatataagtgagatgctgcagtgtttgcctttctgtgcctgacttatttcccttaacatagggttccacagcttcaactttgttgctgcaaatgacacgatgtccttctttactaaggcatccattgtgtatgtttaccacatttataaaatccattcattcattgatggacacaggttgcttcctaatcttggctgttataaacaatgcctcaatgaacacgggagtggggatatcccctgggtattctgatttcaattcctttggattttcagccggtagtgggactgctgaagcatatggtaattcagttcttagttttgtgaggagcctccgtactgttccccatagaggtggctgtgctaatttacattcccacaaacggtgctcaggaattgccttttctccacatcctcatcaacacttgctatctcttagatgcagctctttctttctttccttctgatggagtcttactctgtcacccaggctggagtgcaatggcgagatctcagctcactgcctcccaggttaaagtgattcttccccctcagcctcccaagtagcttggattacaggcacctgccaccacacccggctaatttttgtatttttagtagagacggggtatcaccatattggccaggctggtcctgaactcttgacctcaggtgatccacctgccttggcctcccaaattgctgggattacaggcgtgagccactgctcccacctgtgtttttattttctaatcagcttaaatgctctcagcaattccacattatccccagaataaattgcaagctgtctgcctggctcatcaggatgcgcctgctcctccagactggcttgttccagttcctggggcccagagccccagccccctgcacctccgtttcccatctgctcgaggctgcctctggctcttggggctgtgtgagtgagcactggccccttcaggaacagtctccctgccttttcctagcgattctcctgttcgtgctgagctgtactcccctgggaagccttccctgaagccccctgacagatgcaacccccccatgcatcccccacatagggatcatcagactaagttgtctttgcccattgacttgctgatactcccacaccccagcccagatggcgagccccctacgggcagggacttgtcgtcttactcacagttgcatggctgggacctgcacagagagttgcatccaatatcagtggaccagctgattgatttcatgaaagatgcctttagtaacttctgtatctcaagtgcttagcacatgcccagcatacagcaggctctcagtaagtgtttgtaacatgaataaataagttaggaaaggaaaagaggagagaagcagggagggagggaagaaagggaggaggaacacgcctggtttccttggtcctgaagcattttagtgcgtccttctctaagtcagaagggcttgcccagaaatcttgctatttgtcatgagtgtactgtgcagtccagtgcagggcatttccaggatgggaaaccaacacgtttggtgtaatgtcctctttgcagaaatggggaaagtgaaacccagagaggtgcagtaacgtctcaagtgccacacagcaactgaggcctgaactcagctctccctgacggagcagctgtcactgttgatgtctttatgggaattgcaaacacaattctttaaagaaatgggataaaaaagcacatgctttaggacactttctagaagctgcatgactaatgtcttttcatcttccgtattgcagatgctcatcacacccttccttatccttaccacacccctccctctcagcctggggagttttcctcctcctcctcgtcctctttctcctcctcttcctcttcctcctcctcttcctcttcctccttcttctccctttctcctcctcttcctcctcttcctcttctccttctctttctcctttttcttcctcctcctcttcctcttcctcttcctcctcctgctcctcttcctcctcctcctccccttctccttctttctcctcctcttctttttcctcctcttcctcttcctccttgtcctctttctcctcctcttcatcctcctccttctcctcttcctcctcctcctctttctccttctcctccccttcctcctccttctcctccctttctcctccatcaccttcagattctgcttaggtgtgaccttccctggaagcttcctttgaccttcgcccacatcctcaggctggataggtgccccactggggatcccaatggcactcatctctcctggcgactaccactctgctctgtggtcattgatttattggaaagacatgcttctgttttttcttaaacatatttttctatcctttctatcttgaaacaggcgtcaattccttccaagtctacatggcctataaggatgtctaccaaatgtccgacagccaggtaggtccctcacactcactctctcctctcttgtctgggcaggactgggccagctttgccagtccaggcagcacagggcaagggagattgtgagaagccgtgggattcgagtcctggttctggcatggaatggctgtgtgatacggtgtcagtcattgccccagctgggcttctgttcttttctgactgtgtgagtggcatgcagaaggggttccctggtttggtggctcccaaatctggcttatcctcagcatcatctggagagctcacttgaaatacagattcttagtgcatgttccagatgttgggtgttggactcaggagcctgtacttcccgaaagctctgcgtttgatcctggtattcaggcaaggatggggaccatttatgagctctgacacaggaagagagactgcctggccttccctcacagcaactgcaacatgctgggcaagtcatctcctcacatttgtaagatggaacatttctggccctgccaacagcaaacaattattatgtacatgcaccaagtcaagggatatggagccgcaagttgttcttcaggaggagtggttacgacttacaggacacctggccttcttatactactgggtctcctagttttgtttcattgtcagtttcccttgctctgcttgttagtgtggtggagaaaatcatggaggctacagccaagccaggtgcttgctctgcagccaggggcagctttcccaacttctctgtgctttaggctcatgatagccctaccttatagaggcagttgaatgatttcataagaagagtaaagtgctaggatggtgcctagcagagaatggtgccatacaggcatcagttagcagggtaattggttattaccatgaagatagatgggcaacgggagaagcactttatgtccttcctttcagataaacacttggggttacagaaaataacttatcccaagatgtcctggaggcctttgatacagtcaacaaaagacattcaaagagctgaaaattggttcagttacatagaaaacatagcatgtgatgtgctggcataattgtgattttcacctgtttcattctaactactggagccatgggcatggatggaatcgagcagcctctgcgtgcaggttctcaaaagtgcttcatgcctccacatgccttccctatttgctgaaatagggatgtctgtcggaaagcagacatccgaggggatgttgtcttgcatgcatggagaacaaagttgaggttcaagtgtccctggagagggagcttcgtggctttggcccttaccaggggcaatgcccaaatgcagattctcctcaggtaggaagagaacactgggcagtggggagggcctgttttgtctaattgagaggatggttggcatgctatatattttctgagtattggagttattagagagctggtttcccccaccccaccattgtccataaaatggcatgggttcatatttttgtaaggatgcacacatattctgtggcatgtaggtggctatggtacaggcttagcagatttagttagataatttctgtaaaactaacagtgacttctcaggaccagttgctgccattaacacctacaggtgtttcaaaaaagccaacccaaaaagacagcaaaaggcatagataggcactgagattgagtctgtcttcatgccctggggtgacttggaccagttgtgccccatcctcagcttcctgcttttgggtctgcaagatgtcagggtcaaggaatgatccttccaagtctgacttgtgtagcagcgtattccatccacatgaatgtgtttgcagaggctggcaggtgaatgaccgaatgggtgtgatcggaacggtcttcatgaatgcacacgctgtgatttttttttttttttaaatctcacaccaacccctgtttatctctccatagctctatgaagcctttaccttccttaagggcctgggagctgtgatcttggtccatgcagaaaatggagatttgatagctcaggtgagtggcaagaatttccactccttctacctcagtctgattctccttgttgcaaaaggtttgataaaagagcattggttagtgaggaggctgtacaatgaaaggtcaagccaggaactgggtgtcatatcagacacatcagatatgaatgaaaatgctttgcaaacctaggtcataccagtggcaatgcacatggaagctggtgttcctcattgtcttcaggaattgggagtgggcatcatggaaaagcccaggcttggaggaggtgttccatgccagtctcctccatctcctagccatgtgaccttgggcaaggaactttttcccatgaacactcttatttttcttccagaaacaaccacctggcagtgttattgtgtggatcaaatgatattatgtgccatggcttgaatgtgtccttcaaaagttcatatgttgaaaacttaatgcacaagctagtatgttgatggtatttggaggtgaggccttagggaggtaatttggattagatgagatcatcagggtgggggccttatgacgggattagtggctttataaggagaagaagagaggcctgagctggcatgcacctgctgtctcatgtgatgcccaccgcaatgctatgatgcagcaagaaggccctcaccagatgctggcaccttgttattagatttcccagcctccagaaccatgggaaatacacttattttctgtaaaattaccaagtctatggtattctgtaatagcatcagaaaacagagtaagacatcgtgtatgtgaggttcagaatctgacacataatggactgcagccatgcaaaagttttggataaaatgagacatgaacatattttgataattctagctgtggagtggagaatttgttgggaaaagaatgaaagctgggagttgtggctcacgcctgtaataccagcactttgagaggccgaggtgggctgatcacttgaggccaagagtgtgagaccagcctggccaacatggcaaaaccccatctctactaaaaaatacaaaaattagctgggtgtggtggagcacacctgtaatcccagctattacaggtgggaatacaggtattacaggtgagaatacagccattatcaggtgtgaggctgaggcagagaattgcttgaacctggaagttggagcttgcagtgagctgagatcacgccactgcactccagcctgggcaacagagtgagactctgtctcaaaaaaaaaaaaaaatgaagtcagggtgactagctaggttctatttcagcaagtctcataagaaatgaagagaggagataggagatggaagaggtgagcatgacaggagggaaacacaatctacaggacccatggacggattgggtggaggaagaagagaaagaagtcaggcaggctcctgggtctctggtgcagaggcatggattggttataatgttgtaaatcaagccaggcttataggggaaggtttggatgcagccagtaaaggtagttaatgccagacatgatgcaaaggacttcacatattgatactcacaactactccgtgaggtagatataattattcccattttatagatagggaaactgaagctcagatatgaataagttgctcactgttgctcatggggcagtagagttaggatgttaaccagttccctctagttccagagcgcagtggaagagcaacatgatggttcagtgctggagatctaaagcttcaccattaaggttcattgacttcacttcttcttatctgagtccttgtagttttcctgcacaattgaaattctttcaaattcaatgtaaaaaaccaacagtgccttagttccatcatgcaagagtattctgttcattgctaacaggtcactgcatccagcccacactcaaaaagaagggattatacaagggcaggaatgtcaggaagtgagaattattagggccacatctgagacttcctcccaatctgtcttctggcccccatgattgatgttcctctcccatgcaaattacaatcaccccttcccatggttctccaaaatctcataacagcattagttcacagtctggaatctcatcatccaaaccaggtccaggtgtggatgaggctccttggctgtatttcccataatctgtaggtctatgaagctaaagaaggaagatatctccctgaccctcctgatatacaacatgcagtggtggacctgacattcctattcaaaaagggaaaaatagaaggcaccaaggagttattggttcatggcggttctgaaatctggctgggaaatgttggcagttccttgactgggtttcaaagcctgagaataagtctccatagctcttggctctaccttctgagctcctgcttccatcctctgagtcatccatcctttttcgtgaaaggtagtacatgtctgcagctgagtggttttctcagcctgcttcttgctcagtagaatttcagggatcagccaggcacggtggctcatgcctgtaatcccagcaatttgggaggccaaggcgggcagatcacctgaggtcagaagtttgagaccagcctggccaacatggcgaaacactgcctctactaaaaaaaaaaaaaaaaaaaaaaaaaaaaaaaaaaaaattagccgggcatggtggcgggtgcctgtaatcctagctacttgggaggttgaggcaggagaattgcttgaatgtgggaggtggaggttgcagtgagatgagatcacgccactacactccagcctgggtgacagtgagaccccgtcttaaaaaaaaaaagaattttggggatccaactgcttcttttcacatcacatgcctgtgttcagtctcagcttccagtattttgctaaggcaactctcctaaaaatctgtggacctcctgtgaatctcgctggggttcacaccataagacaaaaggcacccacttcttccagataatccctccgctaccctgatgagagagctgagagacacaactgcaagcttcccagaggccctgtagtttgactgagatggtccacaggcacagccttcatctctttgaaatgtctcttcaaaaaaattttttttaaatttttttgagacttaatctcattctgtcatccacactggagtacagtggtgcaatcttggctcattgcagcccccgtctcctgggttcaagtgattcttgtgcctcagcctcctgagtagctgggactataggcatgcgccaccacgcctagctaatttttgtatttttagtagtgatgggtttttaccatgttggccaggctggtcttgaactcccgacctcaagtgatctgcccgcctcggcctcccacagtgctgggattgcaggtgtgagccaccatgcccagcctaaaaggtccctatttaaaggatctctttcttgtggctgataatactgggaggcaccacccctcatctttctgagttcttaacaaggggctgtagactcacatccttggtttcttcgcaagactgtttatggctgcttcttgcctcctgtgaggactcaatgtcctcagaggccctatttcttctaagagtccattcaaggctatttaaattgctgtttgggaattcatttgctgcctggttccagagcctcttccacacatttagatatcttttatggtaacaccctacttctggtaacaaaacctgtactagtcatccatgattgcataacaaattacttcagaacatagcgtcttaaagcaaattatctcatggtcctgtgggtctggactccaggtgcagctcagctatttctggctgagggtctcacaggccatagtgagtggcaggttgggggcggtgagcatctcaaggctcaactggtgcaggatttgcatccagcctctcgtaggtggtgtatttctggatatagctccttgctagctgtcaggctaatgtgatggtctgttctttgctggctgctggccagaggcctccctcggttccttgcacatgggcagccccagcgaggcggcttccttcagagcagattaaccaaaaagcagtaggtgagcaggtcggaagccagagtctctgtaacctgacctcgggagtgacagcccaacccttttgtcttgttctgctcatcagaagcaaggtgctgggtccagcccacactccaggggaggggaccctgcagggccttgaaaagcaggaggcgggatcactgggagtcatcttagaagttgctgccacacaaatcttagctgattttaaactttctaaaaatggaagcatacagcacacactgtcttatgtccggctccatttgctcaatccgaggcgtgtgagatccatctttggccaggcatagcactagctttttctatttcatcggtgtgtagaattccaccgcacgaatctgcacaatgtattctccagttgttggatatttggatagtttcacatttggaaccgtgatgcgtgaggcttctgtgcttgttcttgctccactcttgttcagccttttattaaccataggttcacatctttagctggtatatacctaagagaggaatggctgggtcctagggtgtgtgtagattcagcgttagtggttactgctacacagttttccagcgtgcacgcacccctgcaccagtgtgagagaggtccagcctgcagcccccagctcctgagtggcacataaggggctttgctctcctcactgccagcagagatttagctgttccagctccagcacatccgtcaccttttggacatctgctttccagctttcaacattttgttcctctggtcttctctgtagtttcttggttcctgtgtgtctctttctcttgtgacttctgtgtgttttggaaggcagtgaaacaaatgcatgtgtgtagtccattattttagactagaaatcctactctcgtctttgtttttcttcatcatgtcatctttcatcctcccttcctcgcctcttctccctccctcctggctttcttcccttcctccccttccctccattccccttccctcccctgccctccccctccttacttcctctttccttccagaatagtaactgacatgtaaacaatttcacagagggatttctcggtattctaaaatctttttgtaaacattttctaaaaatgctttgtaaacagtgtcttcggtagctgaaattattccattgtttacttcaatctacccagctgttagactttgaaatggtttcccatttatattcttgtaataacctcgagcttaataaccatagacgcgcagttgagattgtgatttcttttcatgggtgatgaggcccagggttcatgacggggtgatgtctaagaacaatgacacagacactgaggaagttaaaattagcagcagtacagctggcatctgggcaatgtcaaattttttttttattttttattttagaaattaaagtgttcctgggacaaagaaactttggaccagatggatttgaatctaggccatcagcccagggaaccatttcaaggttatatgataagtttcaggtagtggtttcccgccataaagacagatgccaggaagaggcagctgaagtaggtatgagagccggctgccaattaatgagcgtgtgctcgctcagctccaggttttgtgctgagcatgtttcgtatgctcgctcatctgatcagcgtagtaactctgcagtacaagcaccgttatccccagtgtacagaagaggagactgaggtcaagagagcttgaccaacctgcccaaagtcacagagacggctgttctggatctggactcccagtttcgggatctttgatttcaacatcaaagactagagtaggattcctagttgaagatatccatgttgtacccaaacaccacgtttcttcccagaggagaggcctgcagggagactccgagattcagagagtggtgggtggccttggaagctcgtgtcttataaccctgcttcctctcattgatcccgggagattcaatataaagcaggtgcagatggagccatgcagggctacaaaggggaaggtggatgggtgtgtagtggaggggacacagttcactgcccccaccccgcacactgttaacctagtgcaagccactcgcctctttgggacccagctgccccctctgtctaaccagggggttggaggagtcacttctcccagctctgacaccctctaatcgttaactcacttgttcttgtcttgtaggaacaaaagcggatcctggagatgggcatcacgggtcccgagggccatgccctgagcagacctgaagaggtaaggactcctcaacttgggcatgactctgacactcaccactgagcactcaccttgatgctgttccagctggagtagcccagccaggacccggcctcttcccgtgtcctctcccagaccatcccaaaccatcttgttttccccgggaaccctggggactgctggctggagaagacaggaagaggtgctgcctctcccagggtcctggaacttcactccaaggccccgtgggtgcttcagtgtcccaagtggatacggattctcatggaggacatggcatagtggataataggaaagtggagccgcatgcccaagcccagcacccaggagacaactcccactgcctgccctgttcccaagccttgaaaaaggatgacttcccctggactggctgtgtgtgtatgtgtgtgtgtgagtgtgtgtatgttagtgtgtgtgtgtgagagagacagtgcgtgtgtgtgtgtgtgagtgagtgtgtgtgtgtgtgtgtgagagagtgtgtgagtgtgggtgcatgtgcatgcacctgcagggagtgtggaaggaggaaggcaagctgatcgggcatggaatagagtgggcaccctggcagccatcctttgagttgaggacaccttctttttactttctttctttcttttcttttctttttttttttttgagatggagtctctctctgttgcccaggctacagtgcagtggtatgatctcggttcactgcagcctccgcttcctgggttcaagtgactctcctgcctcagcctcccaagtagctaggagcactaggcacaggcctgtgccaccacgcctggctaatttgtgttttttgtttgtttgttttgtttgtttttgagacagagtctcgctctgtcgcccaggctggagtgaagtggtgccatcttggctcactgcaagctctgcctcccgggttcacaccattctcctgcctcagcctcccaagtagctgggactacaggcacctgccaccacactggctaattttttgtattttcagtagagacagggtttcaccgtgttagccaggatggtctcgatctcctgacctcgtgaatagagactgggtttcaccatggtggccagtctggtctgaaacttccgacctcaagtgatccatccgtcttggcctcccaaagtgctgggattacaggtgtgagccaccgtgcctggccaagttgaggacattttctgatgtcctcatcaggtcattaccgagtcttctgggcccatgccctgggcctggtgtctgctggacacaggggacacagacatgagtccacatgagtggacaggttccgtgtcctgaggggcttgagatcccacccagtgctcttcatgagctccacagcccagggatggccacgagctgtatgttcctggcccatggtgaggtcaggacagaactgggaggcagtgctataaacttgtatagcgcttggatgttgctgccgtatcccagcgtgagaccaatgctccaccccggagagcagggggcactgtcaagcgctgttggactcagtatgtccttctcattcaatggagcagatttcccttctgatcacattcaattaaggaaaatggagatgggtggtagctgttacaccagccttccctcctgtgacactgtgtgtgccgtgttcagctggaggccgaggcggtgttccgggccatcaccattgcgggccggatcaactgccctgtgtacatcaccaaggtcatgagcaagagtgcagccgacatcatcgctctggccaggaagaaaggtatgcagccggccctgggccttctgggggcagctggggcctggaagggggtgtcctgcaggttcaagttcactccctcccgaactcagacaggcagccggaggagggaggggtggagcggggatgctcctgacacaaggatggtggctggaattctttggtcccaatgaccttaggatattcacctcgataagctcagctccatttaaagagaattttaataatatattatgtttaatctaatggatccacatattaattcagcatgtcatcaatgtaaaaatcattaatattttgcatgatgttttctgtactctcttcaaaattcagtatcttacatgtacacaactcagttcagactaaccacagcctcaggttattggtggccacatgcggctcaggactgccttattggacagagcagctgtggaccccaaatatgttgttttagtgtttttaagggcaagctgacaagtagaggctagaacagcacagcttgcctgaaactagctccattttgaagataaggaaaccggggctcagagaggttacagaaatctggaagcggtaccagccgggagcgggtaagcaggcaggttctggagctacaggaagccataaggtagccactaaccacacgtggctatctaaatttaaattaagtaatgttaagtaaaatgaacaagttagtttctcagtggcaccagccacaccagcttaacagccacatgtggccggtggttgctggttgggcagctgtgatacagggcacccccctcgctgcagaaagcgctgcttgatgggctgccctagagccgggcagagcttgcagctgcctctcctactgggcagcaggtggcctcaggcgagggcagcagggggtctcgggccacatctcttgcccttggtctctaatgcaaagatctttcctggggagcccgagcctctgcctgcaggcttttctggaagaagcccgccaggccgactccttgaaagacaagcaggaacttctgggaagttagtgctcgggaagccgccctccggcactgggctgacagaaacacatccaactccctttcccctggggtgggaggaccctgaggcgtgttcccgagcaggactgagtgccagggccctcagctgtgcctcgatgagaaatctccctttattggctgctttccctgccttatgtcacttcctcaatccccagccagtgtttcctggaatcacctcccaaataagactcttgaactagattcctaagatctgcttctggcagaaccctaactgagagagtaaatcgtgtctccatggcttggcttacaaatctataaaaggacataataatgtccaaatcgtaaaagcaacagccatatccacaggttgctgggtgagtcagctgccgtacgccccatggagcgcgtggcggggcgccgacaatgtggtggagctgggcccggacacccaaggtccctgcggtgcaggcggtgatgcctgcaagaacggtggccagtgttctggccttcagccagccccgttctccctccacagtcttccaattttgtgcctttgacatctgcctcaagagagtatttgcttttaaccaggcttatgttttcccctcctaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctggtgagacctgtgagaacgtggggctgggggaggcagctggggcctttggaggcagagagttaatggtgggaatccgcaggctggtttggactcatgattgtagaggaggctctgccccgtgctctgcaaggactgcgctcatatggcttacaacaggccctcacggacctgaagatctgtggcatccagtgactgttccattcacatcaattgaccacctcctgttgagccaacctactgttaagcacctgctctgtggcaggcaccatggtgtatcgggaagcactcaggatcagggatggagacaaggctgtgtcaccccggacctggcacgtcacccgtgacatctctctgtctccctcgttttactcaaagtggaagcagacagtacctgtggcagagctgcctatgggacagtgcaggaaaaggacctggaaccgagtgctccagaagtggccgctgctgcctgcagcacacttgctgtggtgcacgcacactgtggagcccagcacctcagccccttcccttctgttagccaccaggagggaagagcacttagcaatagcagggccacacagcgaggctaagtgtccaggccgctctggaagcagagacgcatgctcagaacccaccgggaggcttgcagaaggctttctggaggagggggcatcaagactaaagcttggggatgagtaggagtttgcccaataggggaggataagatggggcttcttggcagaaggaaccttggaggagggggcagtggtgtgcgcccacgtggaaatcaccatccccctgatgatacagaaacctttgactagcgtagccaagggcttactcaacatctgcagtccaatgtctggtgggcagctcacgtttacaaagaactgcagatcttcccccataaagctgctagtcccacagtcttgcccatctaagaaaatgtcaggaacacggaccagaggccctagagtctgacaacgcctcacctgtctgctgtggccatcctggctcaggccaccatcatccctggcttccgaccaagactttctatttccacacgggcccaccccaccctacccatcacagtctgctgtcagacatttagaacctagattagatcaagcacccctctgcttggaaccagtaagtcctctgccagtgaaacccaagtccctgcaacatccaacaaggcagaactcaatccggtgcacacgccctgaccaacctccctccctgggcctcctctgcccttggctccctcggtccagtcccagcttcatgctgaccctgaaccccaggcaggaccctgcctcggggcctttacactcatgggaacccctggctagttccctctttcttagacgccacatggtttgctctgtgacttccttcagatctttgctagaaggctcctcagtgacgtaattttctgattatcctcctggaaatggcatctccagcctgtccccagcacgcctcatccccacctgctttggttgaatccctgacactcactctaacagcgcccatgtgccccattcgcctctgcttattgccagtctcccccatccctcagtatagctgacacatgcagaagctctctctttctgatcttagatgcagtccccattccttaaattgtaccgggcacataggaagcatgcaacacaattttgttgaataaatgagtgaagaaaacttctaaatatactcctctgcatctaggcaattgctaacatttcctgggcctctggattggaggacagcctcaccttcctcaccttgcatttagaaccactaataatggtccattcattttttattttattttattttatttattttattttattttattttattttattattttattttattttattttttgagactgcgttttgctcttgtcgcccaggctggagtgcaatggtgcaatctcggttcactgcaacctccacctcctgggttcaagcaattctcctgccttagcctcctgagtagctgggattacaagcgcccaccaccacgcctggctaattttttttttttttttttagtagagacaaggttttgccatgttggtcaggctggtcccgatctcctgacttcaggtgatccacagcctcccaaagtgctgggattacaggtgtgagccaccacactcagcctggtccattcattttattgtcttaggtgttcagctcagggcacctgatatatcaaagagtatttgtttttaaaacaccaggggacaaaagggtaaatcccagtgaacttgtgccactttgctgtaaccaatgaatagtgtttgttctgcaagcacagcacaaacactctggccagcccttaagccaactgccttatgtcaagaagacaaatgtcagcacacattactcactttgtaacgtgcaaagcatgaggccagtgacataaatggggcatccctgacttgtgacacgtgcaggcacacgctagagagtctctcttacccactggcttccttatctattcattcattcactggctgtgctgcatgtacctgtctgaagtcaggatttgccttcaaaatgaactagggtctgaactctaccttgttttgtccttgccagtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggtaaggctggatctcttctcaggagcattctagaaacactctacctgccctgtgaaagccgatgcattatgcacgctgggttcttaaaagttcccttcttacatggaggcggaagcagatatactaggagggcgcaggagggaacgcataacttgagagatagtagctcaagtccgggagaggcctctgcatttgtggatgtcacccttgtcctttacatcttaagattgaaaaatgttttgttttgtttctcaaccacgtcttagttcctgtggaaatggctctgtaacgctgtgtgtgtgcatgtgcacacgtgttaggagttgggatgttgagtgggtagagagagaattcctgttgcagaggaagagctgggtctcactctgatcactgacctgaaaccaaaggtttttaatcttctgttaaactggggcctggtgacatggacaagatgtcatagtggctcttgcgtcaacatacctctgtgcggttaattaaatgtcctctctgatgaggctgggccttctggggttcttgatgatggcacgtttttagctgggagaggagagaattccaagccttgcaaggcctcagctggcagtcttccatttgtgcccagctgcccctcctcctggccccattatgagatgctcttctcatctgtgggtcttgcctgtaggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggtaagtcctggcctatttgtgctgctgagataagtgattcttcgttgtaatcatttttaaagactggttaaaaatgatttatgaattttccaactaggatgtgatctgatatctagcctgactcagtcattcccatttctcctccagttggagagattgggaggagggatctgagcaggctcaactaagctgcttctccttctctttctctctctctcttcctctcctctctctctgtctctttgctcctgcccatggatgcatgtgttcccagccatctgacactgcttataatgtgtaagcttcagggctcagcgagggaaagtattagatctaaggttctcaatttaattatcaagctggaaaggatttgatttggtatgtcggaaacctcccactcggttttgtggctggctgctaatagacaggaaagggttggccctaaagtgcacactttttcacattccatgcccatagttatgggccttctctgctttgtatcttatatgcctttgatttctccactcatccagcaacctaccaaagatgcgtgcacagagagggtgcatgcagagatggcagaagacaactgtgcctccctgaagggcttgctttaacaccctcctgcatggccaagagtggccttgggtctggattaacaactacacgcacagacccaagaggccacagtggtccctggttcactggagtctgtgcaagcacacaggccagaagtagtgcatgtgcacaccgtgatggagctgcagtgggtgttcccatggccccatgggctatgggctcacatactgcagaaggagtatgggctcacatactggagaaggagtatgggctcacatactggagaaggagaccacaggtgtggggacaggacatgaggcacaaggaagtttcataagaaagccacaggaaacacttgtagcagctcacggccatggccctggagtatccattggctgccacagacatggcctgcagaagcagaggtctcggtagctgctcactgaccttgtccggctcaccaatccaggtcattcttataatacacaatgctccctggtaacactacttgcttcccacagcccccatctccagggaacggggtgcctgagatcatcttcccatggagaaaggtttatgccacgcacatgtacagtccagcagggcttgcaattctattatttattatgaattatttcacgtgtgtacacactgcttggggtctgtgcacataggagaggcaatgggagagcgtctgagagggtcttgccagtgagagggtgtcttggtccattttgtgctactgtaatagataccacagactgggtaatttataagaaaataaatttatgtggctcacggttctggaggctgggaatttcagtattaaaatgccggcatctggcaaaggccttcttgctgagttatcccatggcagagggcagaaggataagacaggacaagtgtgaaagaagtatcaagaggacgctgaatttgcttttataacaagcccagtctcacaataactaactcattcctgtgataatagcattaaccattaatgagggcagagccttcatgacctaatcagctcttaatggtctcacatcttaataccattgcaatggcaagtcaatgtccagttgaattttgaggggatattccaaccatagcacagggtgtgcactcctaccgccatctggctgtgggagctgccccttgcttcacaaggtgatccttatctagaaaggaacgtgaatgtctgtgtcagccagtcaaaggtcggcggacaaggacccagaaggaagtagactgagctgggattgtcttactattccttttgttgttgttgagatggagtcttgctctgttgcccaggctggagtgcagtggcgcaatctcggctcactgcaagctccgcctcccgggttcacgccattctcctgcctcagcctcccgagtagctgggactacaggtgcctgccaccacgcccggctaattttgttttgtatttttagtagagacaggtttcaccatgttagcnnnnnnnnnnnnnnnnnnnnggattgggagagaggagaatatgtgagcgggtgagtggaaaccgctggataggggggtgtgtaggcgaaatagaggaaaaggggcaagggaaaaaagggtatgaaaaaaggggttctttccaattcaggaggggggggtgattatcggagccaatttgtggggacaactctcgacaaaaaaggggcgcgggcaagactggggctttcgtggtgggagaagaagagaagtgttttgaggggggggttcaagagggtttttagaaagcattggggggagtttcagggtttttaaaaaataaccggggatattgggggaaaaagggccttttttggtttaagagttttttcccaaggggcaaaggggggagagagggtataaggaacgggccccaaggtggtaaaaaaagggattcaaagggggcacggtggaattttgggtttggtaaaaaaagaggcgcagttttcccacaataaacggaagtgcatttcgtggggataaaaagggctttagcccattaattggaggggaaggagcccttcatgggcggaagtcagctgtttaaaggggtctcactattcttaatacgcattgggcaagggcaaggtcaatgttcaggtggagttttgagggggatattccaacccaaggcacaagggtgtgcactcctaccgccaatctggctgtgggaagctgccccttgcttcacaagggtgatccttatttagaaaggaacgtgaatgtctgtgtcagccagtcaaaggtcggcggacaaggacccagaaggaagtagactgagctgggattgtcttactattccttttgttgttgttgagatggagtcttgctctgttgcccaggctggagtgcagtggcgcaatctcggctcactgcaagctccgcctcccgggttcacgccattctcctgcctcagcctcccgagtagctgggactacaggtgcctgccaccacgcccggctaattttgttttgtatttttagtagagacaggtttcaccatgttagccaggatggtctcgatctcctgacctcgtgatccgcccgtgtgggcctcccaaagtgctgggattacaggtgtgagccaccgcacccagcctcttactatttcagtgtgggatcagaggccacaccagattccatgctcaggagtgggcactctgattatcatcacaatccagccaaatactgttttgtagttacttcgtgcttagcattctccatgcatcatctcatttaatcctcacgatcttctaagttaggtatattgttattgataaatgagaaaatggagagagagagaggacacatgtgtaagtttcctctggacgctgttataaagtgccacaggttgggtggtttaaacaaaagaaatttcatctcttaaaagttctggggccgggcgcggtggctcacgcctgtaatcccagcactttgggaggccgaggcgggcggatcacgaggtcaggagatcgagaccatcccggctaaaacggtgaaaccctgtctctactaaaaatacaaaaaattagccgggcgtagtggcgggcgcctgtagtcccagctactcgggaggctgaggcaggagaatggcgtgaacccgggaggcggagcttgcggtgagccgagatcccaccactgcactccagcctgggcgacagagcgagactccgtctcaaaaaaaaaaaaaaaaaaaaaaaaagttctggaaggtagaagttgaaaccaaggtgttggccaggccatgctctctctgaaggctctgggggcagaccccttccaggccactcttctagcgtctgacgtccccagcagtacttgcttccatggcgggtaaggcatcccttacatcatctgcctctgtcattgcgtggccctctctgctgtgtcttctccttttatggatgccagtcattggattttgcgcctaccacaccccaatgtgacctcatcttacctaattatacctgcaaaatctctgtttccaaataaggtcacattctgaggtaatgggggttaggatttcaacacgtcttttttgggagcacgattcaacccataacaatatgtaatatacccaaggttacccatctgggaggtaactgtcttcagggtaaacttggggaagcatcccctctctgtgtgaggcaagatttgaattcttttcatagcagcaagaggacagttgaggattccgtgaggtggtttgaccaaaggattttgtctgtttcattttctctgtccaaagcaatgccatccacataattgcaattttttcagaacatggattgagaaatgcttagaggttcgttttgtttttatatgttttaaaaaaatgttacttttaacaatgaaaagagatcattccttatatattgaccagtgattagattttaaatctacttttctataaaacacaacttttattctttcctatctttgtggaaaacattcacatcaaagtgccacatcatgggtatgcatacatgtttgtatatcatagactatctggatgtttttaagtttcttatcgagatataattcatataccataagtgttgccattttgaagtgtacaattcagtggcttttagtatattgagaaggttgtacaatcataattccagaatgttttcatcacctccagaaaagaaaccctgtacccatgaacaatcagtccctctctctcacccccattccctagcaaccactaatctgctttctgtttctatggatttgcctattctggacatttcatataaatggaatcatccaatatgtggccttttatgtctggcttctacttagcatcatatttttgaggatcatccgtgctatatcatggatgggtaccatgttcctttgatggctgaataatacccccttgtagggatggaccacgtttagtttatgcacacatgagcttgagtggctgctctttaaagggtataaaagaaaccagttctccctggaggggaccagggaaatggggctcatggatggcaagaggttttttcatcatggtgttttgtgttgtttaaatttttacattgtttgtatgttacctttaagaaatgaaggaattgatgtttacaattcagtgttcttgtgaaatgcagggtgtggcatttgtgatatgaccagggcctcctcacacctctgcagcttgagattctcaccaaagcacagcacgttcctcacccaggagtagggacagcagcccaggtccccaagggctggccagtttcagctgggagatgggtgactggttccttgcaccgcccctccgcattcacaatccatgtgtccctcggcacagttatgaatcactccatagtggagccactttagggtgagggagaattaggttagcaaatgctaacactggaaacgcactgtctgcctgggtcctgcgaggctggcacagtgtcaacagctgtgtgtaggagacgtgattgcctggaacccccaagaatgcacctaaaaatcatcaaacaccatcagattacaaaccaatataaagaattgatagtttttctatggaagaatcaaaaatcactttggaaaatagaatggaaatcaaaatcctgtaatagcaataaaaactaaagacttggcctggcgtggtggttcatgcctgtaaacccagcactttgggaggctcaggtagggggacttgaggctaggagtttgaaaccaaactgggtgacatagtgagaccctgcctctacaaaaaaataaaaaaattaactaggcatggtggtgcatgcctgtagtcctagctacttgagaggctgaggcaggaggattgcttgagcccaggacttggaggctatagtgagccatgatcgtgccactgcactgcagactgagaccctgtctcaaaacaaccaaacaaacaaacaaaaataaaaaactaaagacttacataaattcagggacttttacactgagaagatccaatatagtgaacatatcaattctttctaatctaatctataaacttgatgtgatcccatcagaaaatttaattgtttagctaggaaagcagagttcccagatgagaaatgtgagagtagctgaaatagttctgaaaaaagggaagactgggcccgggggtatcagtcatcccagttattaaaacgtgtcataaagctgcaataaaccaaacagtttggcaggggtacaagaaaagagagccaaggaatagactgactgcatatgagaatttggtttacaataaaggagacaattagaattaggaaacgatagttactcatccaattgtgttagaacacctggcccaagaggcttaacctctgccctactatttactatcaaacaaatcaaaccatggttcaaagattaagataaaataaagctatgaaaggactagaatacaacacacattttttgaaagaatgataattttgaaggggaaaggatcttgctaagcaagacacaaaacttagaaatggtaaagaatggtctgtttgaccactgactacacaaaaattatacaaaataatctgtgtggcaaaaacaattacttcatttgagttccagagacagaggaccagggagggaggacatatttgcaacacacataacaaaggataaattctttaacattgagtgtgtacttttagaaatcagtaagaagaatgccaagaccctgagaaatagaataatgtgcaaaacacagtgacaccgtaagaaataaatatagaaatggcatgtgttgatttaaaaagagacccagtctcagtcacagatgcaaataaccacctagagatagtatttttcacctgtgccagcaactgagatcaggagtttaatatacatagatactgtttaccaaaggctgtcaggtaagctcacggagttttgttgggaatggaaactagtgttgtcttttttggagggcaaatctgtcaaagatgaaaatccatttactctttggcccccaactccacatctagaaacatgttcacgtgtgcagactgtggatgcaaagtctgtttcagcagtttttagcaaaggcatggtaatgacccaactgtttattcttgggaactgggcatataaatggtagtacatcctcctgatgaaatgtagcagtgtaaaagtattttgtatgtgtgctgatatggaacaattgctgaggtaaagaaaaattaagctgagaaatgtctgtgtagagatgtgtatatgtcagacagttattcatgcctcggacatacttagagatacagaagaaactcttcagggcatatgtctcagactcaagtagaacacagacttacctttctatccaatatcttttttaccagttgattgttttcaaccatgtatgtgacctacttttaaaataataaaaagcagttggctggtgacagttgacacacaactgtcaagtattcacttgaagaataatggaaagaaggtgagttttttgttttgtttttttctggagacagagtctcgctctgtcccccaggctggagtgcagtggcacgatctcggctcactgcaacctccacctcccagattcaagcagttctcatacctcagcctcccgagtagttgggggtacaggcatgagccaccgtgcccggccgaatgtgtgttttaaaggaaatgttattttgtctttcaaattagcagagaaagaaaaaaatggcattacccaatgctggagggggtaagtgccgatatcgtgtcaattgatctgaacccttgggaaaataatttggccatatggcacacgtgctttaaaacagctctattctttcacccagtaatttgattttagaaacctagagaaaaaaattttatttaaagacacattttaagtaaaatgaagaacattttacttatttttatgtccagtacagtcaaagcagccacattgcataaccccgggggacccccttcctctttgtgatgccccagaacaatattgatttgattatagaaagccaccggcagcctacatgcgcaacggtgagttgttggttatatacactgtggaccatacagtggaatattacagtcaataaaaggtatttttagagagaaaaaaaaacattggaacacgcttatgatataatgttaggcaaaatcgctgttatgaacagctcgtttggggcagagcaaatcctgggaagtaacgctgaggctgttggtgcaggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtgagtgtgtctgcaggggagcgggcccacccgtgggaccagagccgacagcgtctcttggggaatcgagatctgacgtgtgcagagttaataatgtcatcgccctgggaacctccgtttccttatctgttaaatgggttgagacgctggcctgggctcctgtctgaggacaggagtgagcatcaaatgaggacatgcaagttccagggctttgcaaactgtagaggggtgtgcacccgtgagggtgggtggatcatgggagggacgcttaccaagctgctctgggcgctgtcctgcgtcatcttaagtaatcctgcccacccacgggaggtgctgtgatcctccttttgcagcccagagcagtgaagggcttagccagagtcacggctcagaaaccctcgggtctggccctgtggagcaaggtgttacccctggcatcttgcaggcagggcttccttcagatccgccctttcttcctttccttcctcccttgacgtttctgccctgtcgttccttattttccttgaacaaccttagcactgacctcaggacatctgtcaaagggaaggagcaggctctattcctaactttagagcaactcagaggagggaactttctcacagctgagagagactcccgcccgtggccaacatcttccccagccaggccctcccatccccatggcagctgctttccccatgagacagctgatgtttgccagaaaggccagcttcgtgtgtgtgtgtgtgtgtgtgcacgcgcacatgtgtgtatgtctatgcgtgtcatgtgtgcatgtgtacatgcatgcacgtgtgtatgtgtgcatatggggatgtgtgtgcgtgtgttggagtgtgtgtgtgtgcgcgtgtgtgtatgcgagcatgtggtgagctctgtgtgtgtggccatgtgtgtacctgtgtggtcctgttctttgtatgcttcctaagtgaccaattgagatggagaagtccagagaccttcctgcattcccaggctccagcccggactgggaggctctgcatctggttttggtctctccccagcttccataaggtgtagcaccaggtcaaagacaccaagtcgcacagatgctttgcactggatggggaaacaagggatggggtggaaacaagtcagatccgagacaaggccaggcacaggcagcaggccatatgaggacaaggggactcatggaaatccctggctgggacacccactgaagaggcagacacaccccttggctggcttcatttccttcttggtctgaagctgaggcctgcggttaacagtcagcttccgtgagggcagatatctgaccccaaatgccaagacagcaatttgcaggagcaataggatcggggggtcccattgcacagggattccttcatgcctgcaggagctagaccaggtgaaggagagacctgcatcagagcctgcctctggccacctgagcttcagggagtgatgaacggcctcacccaggaagcaatgccacagccacagagaatgcacaggatacagtgaggcccagggagtcggggagcagggctccagggacagaggggagggccgttgacatgatgtgcaggtgctgggtctttaaacttggtgctaaaattaaggcttcctcctatggagagacaggagcccagagctgggggtcagggtgctatcacctgcagagaaggagggagccaggcctggggtcagggcactgtcacctgatatggaggatgaagccccgtgttgggttagggcactgccactgactcatgctgggaccctgtacaggtccctgaacacatgctgttctccagtgcctggagcaggtgccctcccaaccttggccatccctgaggtcacctgggctgctgtcagcagttcccagcaggctgacagcctcctgcctggaagccctgctgctttcagggtctctgcccccacaaccctttcccagtggggctagggctgtggctccattgccctccttcctcgtcctcctgcaggctggtgtggaggtgtcctccccacagcatccccagccctgccccccatagacctggcccactccttgtccctctgtactgagttttctccctccctgtctcagctccccactccttccccctttctggaaccatctcccaacaaactatctgccccccgaatctttgcctcgctgttgacttctacaagaacatacatgaagatgggcccgttgctgctgccttgtctgggactcaggggtcctttccgggggtgggtaggtggtagtgtcaggcaaagtgacttctctttggaagggatttggggtcctcctgcatgaagctttgtgtgtatgagtatgcgtgtgtgtaagtgtatatatgggtgtgtatacctgtatgagtgtgtgtgtgggcatgtatgcatgtgtatacatatgtgagtatgcctttgtgaagatctgtatgtgatttaagtgtgtgtgcgtgttcacgcgtgtatgctactgtgtaggcctgttttgttactgcatgtgcatgcatatatgtgtgcatgactgcatgtatgtgagtgcgtgtgcgtggtgtgtgcgtctgtatgtgtatgcatgtgggtatgtagatgtgtgtgtatgcatgcttgtgtgtatgaatgcctgtgtgcggctgcatgtgtgtgaagtgcacctgtcgtgtgtgcgtgttgtgtgtgtgtgtgcatgcacatttgaagtgacctcaggtttctctctcgcccgcagggctctgctttatctgcccagaagggcacacatgcacagtgtcgatcaatcacactctcccttcctctgtttaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtaggaaagagtggtggcccaggctccccacaattgcagcagttcaggccgagtccttcctgctgcttctgaggaaatggacacgtggccttggacactagatgaagaagcagggaagggagtgtgccccacccgagcctgctctcactggtggggcagagtgggctggcatggtcaccaagcagaggggggtccatgttaggggggcaacatggtggtacctgatgtgggtttacaaagagaggtaccaaaattgtcccagtgctcatccttacacacatttggggacactttcacactcttcctcatgaaagtaaacatggagtggtggggatgaacaagagatgggagtagctgccatttgcagggcatgtgctctgtgtaagtctttagcctgttcacccactgcagtgtactaagcactttcataacccatgattttattttatcctcactactccataaagtaacattataccctatttatttaaagaggaaacggaagccccaagaaatccagtgtcaaaataccaggacttggtgctcaacaaatgtgtgggaacaaaattagatgttgacctgatccctcctgactttcttaaggtctcagggcagtgtatctgtgatttggtgagatggccacatgagggcaggcacgcacacgttgagaaagttgaactggaattttgtcctgcaaactctttgaggcgttgcatgggttgcacaccgtgctgggtactaagagtatggtgattttttttcttagaaggccggatagtaaatactttaggctttgtaagctaagaggcaacatctaggatgtcaacatctaggatgttatattcaatagccatttgaaaatgtacaaactattctcaggtcatggatcgtacagaaacaggcggtgggccggatttggtcaatggacccgtttgctaattcctggtcaggaaaggcgatatgcttagcaaaagagagagtggaaggggcaaagagagagagagagagaggatgacgtgtgaattcagattgtgtggtggcagaacctcttatccattcaggaagtgtctgattcagtgattatgccgaggaggcatgaatcaaggaggcctccccattcatctcactctccataagactttgatggaagagcttccagtgtttcatatttttgcacaaaatggaccctaaatagaatgctaaaagtcatgtgatgctcaatcagcaaaccagggattggcttcatcctgggaaaaagctatctgggtgcaacaagacacaagctctcaaggagtttgcaaactggaccactgttctggagttatgcaattaaacactgcacaattgcaattaaacatggacagaaaatcctcctccccgttgttcttagaacaagaataacaatgaagttaaaagccacctggaagggcccctcctcacccttgttctctcagtttcactcttagtcctcctgaggcccacagcaccactgctgtcagccagcctcttggcaggttgataggtgacttcatttggtaccaacaacacagatgctttccaacatcataacaacctcacagatgccctttttaatatctgcgtatgttacgttatagagctgtaccatgagttagtgtctgttttcgtccatttacattgctataaaggattacctgaggctgggtaattaaagaggtttacttggctcacggctctgcaggctgtacaagcagcacggtgccagcgtctgcttctggtgagggcctcaggctacttccagcatggcagaaggcgaaggagagctagcgtgtgcagagatcacatggcaacagaggaagaaggcagaggtgctctttaacaaccagttcttccgagagctaatagagcaagaatttactcattactgtaaggctgacaccaagccattcatgagtggtctgtccttcatgacccaaacccctcccattaggccccacctccaactttgggatcaaatttcaacacgaagttttgggggacaaaagtccaaaccatattagtgtccttttttccagcaggtattttcaaagtacagacatgcaaccagcaaggtacagatggttgtaaggaaaaagttactaagtgctaggcctgattccaggcctttaggggagacttgtattgcaagaagacatattgtctaccagtgaaacaatgggagaaaagaaaagtcactactgtgaaccaaattcttagtggcttacatagacaaatcatgtaatgttggagttggaaggggctcatctagtctactgttcttattgtgcagaaaaggaaatgaggccaagggagtggggtggtgtcttactccaaattgcccaaattcaaggcatgattagcactgaaacttgagtctccttcctgttgcaggtgacaactacctggggccagtgttctgcagctagtaaaaaaaattcaccaagacagttgtcggtaaagaaagtcagatgtattagaaaaagtatgaaagggtacagtgggtaggtcagcaagaaaggagccgactgcaaggaaacaaaggcttgctggagattttataggatggtgcttgtgctgtgtgccgaagagggctttgtgcagtactgataatgctgtggttgcagtgagctaacttacttacgtttttctgttagctgaggatctggtgataagttgagtacaggaaggctgtgttgtagaccatgaagaaaggcagacttacagcttatttgctttctctttttgattttcctcagttccgccggctcaacttcccctccctgataaggactctatccttcccacctttcagcattatccacccttcatgatttactcatttaataaatatttgttgagctccaggcactgggtttgctgctagaattttacatctttatgcaagagaataggtaaaagtagaatggatggttggttttgaaagattaaaattaagaacctctgcacaccacccccccccccttcagatccacctatcgccaatgagggaagtaaatccagcttgcggagttcacatgcacatgcacacacatatgcacatgcatatacaaatgtgtacacacacaatatgtaaaatacctttggagtgtgggacagtgtgcctaagatcatgggctttgaaaaccaaccagtttgggcttcaatcctggcttccccacccaacacctgtgtcccgcaagacacgtggcctgaacctcaaattgctcacccgtaagttgggagtacaaacacccccttcatagtatgattgtgtgccctaaatgcagtaacatgttaaagcaccaaatgtgcgcctgcacacagtaggcactcagtaagtgtttgatcacctgtctcaggaatgtcggattttactggggattttgacaagaacaccacaaggtggtcagggctgaaggtggggggagcccagggactgaggggcacagaagagggagcagtggactctgtggaggccagggaggcttcccatggctggtcctggactgagccctgaatgaaggtgggtccagtggagtgcatggcagagtacatggcctccaggagcagcgtggaactgatgctaacagatcccatccagcagcgattggcgctctctttcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttcatttcagtggtggtgtctggattgggtacgaatgcttggcagtccccccgcgtgataacgaatggtggtggctgcttcctgaggactcactcttggtagagactggtggatgtgggggtgggaggagagattcagttcatgacttctgaaggctgagttcctgagacccaaggaggcgaagagagggaagacggctgatgggcgggcttccacaaaataggctcaaatcttgcattgattccctcctgttgggcctttcctggctctctttcttcttgtattgtatggatcagcctcagactggaagctccaatctcctaaacttcacatttcttccttccatttccatgagctagagatacactaaaggacggataaaaacagcaggcaaagttgcttgcttccattagctgttgttagtaatagtgatgacaatgatggtggtgacagtaatgatggtggtgatggtgatgatggtgacgatagtggtgatgatgatggtggtgttggtgatagtgatgaagttgctggtaatgacaacaaatacatgggctgatagctgtatagcagttgctatatgccaggtgctctatgaggtagggattattatccccattgtacagatgaggaaactgactcagagtgagatcaataacttgtttaggatcacacacttaggaagtgatggaaccaggatttgaatccaggacccaggcactttgggccctagtccaaagctccttgctcctaattactgagctccaagggcatttgaggcagatggctttggatgctctggtcccacatcaacgcagggcttttcatgtacccttctcctcccccgctcctcggcttcgtgtggatacctttgtcaaggttgaaagaagtgttggctcagggtcagttatagacttccttgaaacaaggttaactaactactgagaaagaccaagaatggatggtaaggatttttggatggaaagaccaagaacggatggtaaggatttttgatgttcggctttggcccatttggactattaaagggaaacttccagaaaagtaaagttggcaggatgaagttatccagcctgttctctgggcctggcctcctcagtcctgtcagggtggaagtggaagcagaagcagccctagcaccttctctaagacagactctgacggggtgcttgcctgactcccaggtcatgggagccactgtccaaccagcataatctagagcccatgtcgaactttgggttccccagcgcctccaagaggcacagttacaggggacaggagacctggtagctcagataatccttagttcttggagactgagctgcaacactccttttaaggcatgtgacttccttttacctcttgagattttgggaggagggagagagagtttctcagaaagttttaggggaaggctattctcattcattcatctgcaacccaattctcccagccatgtgacataacatactcacaggcccagggattaggatgtggtcatcttgttggcagggacggggagcgttattctgcctaccacagtagtcttctgggttttttctagaagttttatctttcacatttaggtctctgagccatctctcaataatctttatgtacaatataaggtaggactgaaggttctccatttcccatatgatctcccattgacccaacaccatttattgcaaagactattctttcccccattaagaggcagtggggcctttgttgtaagtcaggtgattgacccttctgattcagtggtccagaagtgtgctgccaaatcaatgttgaacaatgggtgaaggtgggtggggtagaaagcccttgtttgtagtgtttgctagttctgtggaccccacttctgttaccgattttctgtcttagtccatttggcatcactgtaactgaatacctgagatggggtaatttataaagaaaaggaattcatttcttacag

SEQ ID NO: 16478 - DNA, 8127 bp, Human
gcgcttcaaaatgtatattgggataggggtagcaaaatgttgggagcatcagagcagttcctaaatacactacaggcaaaaacttattttgatctcagaccagagtttcttaacatagtgtcaaaaaaacacattatttcaaaaaactattttccctatctaaagagggtttagttctttaacaagttaggagtccaacatttcccaaacttacttggccccataatttttgctgctgctcttgttctttggaaactgtcagtatatttggatgataatactagtgggctgttaaaaataatttttaaatcattttactctaacataacttactcacaattatttagaggagtgagaggatactagatcaacaaacatgagcaatgttgaagattttaacaggaaattaagtatggactgaaccacaggaagtatacaaccaaatgcctttatgtcatctgtctttgagtttcatcggtctcattagggtcacttccaaagtggccagctcatctcaccagttatctttcttaatgccttatgttatcttcccaacataaaatgatgcttgttacatacaatataatgagctcattataatgaaattaatgactgtgtataagtgaattttataatattgtaaatgtgttttcttcaaatattctttatcctgacgatagaaccagaacagaaaaattaatactcccctcccttttatcagctttacctaataccatcagaagcttcactaagtaaatgcttttttgtccttttaaaggaaagtattgtccttccaggggtaaaatccaaggaggcttaagttaaactgggtactctataaataagccacacttgttatataaacttttgaaagcttatattttactaacttctctatccttataaatgattagtcatctagttccttgagttttgtttgtgttttaaactttaatctcaattaaagctaaaactgttatctctccagagatactgccaaaatgtgaaagatcattacctaagaagtacacattattggtctatccaaatagacttttattttaccttgagcagtttttcctctgatactgtgaccttggtatcagtatgtttacaaattatgtcatatttgtatacaattaaacatttatttatttatgattggttttaattaaactttattttttcctaatatgcaaaatatgcaaaaatcaaagtttgatatactagttatattcttaataaatatgaaaataatattaaaaaccatgcaccccttaaaatcatcctatgtattgccagtcgatgtctagcacacaccttggaaaatattaacatggaaatttcctgccatggaaataagggatgagaattggagtgggaaaatgtgaagatagcctcttataactttccctcctatcagatatgtgcaaaataattaaacaaaaattatttgtttactttgccctgcttcctgcagaaaagaagagaactcttaaaatattttgatcagatgaattttatagtcaaggactatccaaagcatggagtaagatacaactctatgtgatgaatttctatgtgagtttctatatgataaattaatacgccaaatgaaacagtttattgaaacatgcaacttttttaaaataaacaaacatcctccagaaccaaagactgatgctgttaatgctttagacatgtgacatatgtgtgtgtacctctgtatgtttaattttctttctttctaatcaagtgacctgttctcgtttggttaagtttcaaccacaagacaccactgtatgcttttttttttttcaagatacacgtcacagcacaccaagaaaaggggaacttccagtgtctgtggtaacatcacttgataaacagactcctttaaacagcaagtgcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagactttgtaagtttgttcagagtctcactttgtgaattttaacaagttatctttaatggcagaaggattgagaatgaatggaagagagtgtgagcatttagtttagccagatcagaggagttaattgcctgttgtgagtaataagtaatattcagctgcattaaaaaataaatcttgatatggcattaaattgggtaggagtttttctctacacaggctcataaaaatgggttctatagcaaaatgttgtatcaaccatttttagtattgccttattccttagagaaatttattctatgtctttttacaaataaaatgaattctgaagaaatatgaatattcacttttatgtcttttgtagtggaatggatatgaaagcatacctgagatctatgatcccacatctggaatctggaatgaaatcttccaagtccaaggatgtgtaagtacactaatacactaaactatcattatcatttacaagagaagcctatgcattatctctatatcccagcaagggataaatactgcgcacagtagacttcatttcttttaagtaacatgccaaataaaattagactatcagtaccaatgtaaattgaatacaaatgtgtacacacacatattggactttatctatttggattttttcaaattttattggcaggttttttttttcataactatagtaactctaagggaagttttgcattttgtgaataaattttaacatatttattagaactacagtttcagtttgtgaagttatcaaagtgtaacagccattcttatttcatttgtgcttacattttaaaaattgactaatgtatgtacattttgtcccctgcagactttctgctgctgaagtaatgcaatggtctcaatctctggaaaaacttcttgccaaccaaagtaagtataactattgaatgtttctgggttcagctaaatactctaaaaaattgaatggcttcactaaatatagtattctgggtaggatagtatgcaaaaggttgtattctagtttgtctgtagttactgataacttcagcatagtatgcctcttaataatgctgacttagcactcaattctgccaactccttttagacaaatttgccaagacaattaggtattttcatagatcattatggagataaaattaaacattgtgctgggattctgatatgtaaaaattttaaaagtaagccaaatattttaatatgtacattgccattttgaaatctgcctaaagaatgtatttttctacacttggatgtaacaagtatgattcattcattcaattaattaaattatctttcatacattcatcattcatctcacccttatgtagaggacattgtagaggtaccaaggattcaaaatcaaagacagtctcttactgccttgaaggtggttgagatacataacataaataattgcattattataacatgatagtttttatgacataaatatgatagaaggatttttaagcacatatagtcttgtggagattttctgatgagagaaggtaaagaatgaaatcagcttgccatccccttgtcttgggcattacaattctactgagattaggacctttttcagaggtgtagatgagcagtgtggtctctatctctaaagagtgagattattcttttctccccacagacaccctaaggagctttacttgggaatcacattgttcactctagctcagctgactttgtttataattcagctaaacaaataaatggtatagatatggaccataaatggtgccatataaaagtctcagtgaatgctagcaaacataattagtacatcaggcctacagatcatatataggcctaacattttctggctaatataaattagatggggaaattatatttactaattattgtgatgttaatgccttttgtcagtgtttgctttcctaaaatactctctactctggctaagatttggcatatataaaagatggttttatattcagtggagcagaatttcaattcaaaccgcggatagaagcaaaacagtttggtagccaccatcaagtagcaatgtgactatgaatgagtttgtctggccccagattcctcttctatgaatgaagaaatttcaaatgacttctcatctctacaatctataacacagctatttcagcagtagctgtctcttacctttgtatgaataggaagcaattgtatttttcttacaaatttcttcttcaaattattcatttgttggttcatttaatttaattatctccccacccacccctcgtttctttttagctggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaagtgagtattaagcttatcatcatcagtttctccataaaagaccctatatgcagaaataacatttaatatatacaacaagataaaatccttttggggtatataattttacttctacatacttaggcatataaatatagttcagtgcaatgagaatctaattttctatattggtgagggtttcagcacagtagaatgaagagactgattttacaaaaccagctgccatgatgagggtgagggaagggttaagggtattgttactgaccagaactgcatgtcagggagtccttaatgagtgctcttgttttggataagaaaatgcagattagcataatgtatacaattgcagcagcaaaagtatttccaattaacagtattaccagataaatattcttggtccaagcagaaaatatcaacaaaaagagccttcttctcctgtaaatcttaaatgcctacatcactctttatgatacatggatcatcttatgtggatacttaaatttttcatgtctgcttcttttgcctctcctaactatactatgaggaaatttggaacaaagacatttttgtaatatttcttatctccttcacacctagtatagagctgattttacaaaggcatttaagagatatttgaattgatttaaatgaggccttaaaattactttctgaggtgtttcaaaaaacagtaacatcataaaatttgcagtaaagaaaagtatatattagctaacaaggttttcttttttagatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaagattcttctttctaccatctcttttaacatctaaaactattatctagtgaatactatattttatgtattagtttggacagaattcacaatttttctctctgctatcacaaggcacaaaatcaaacaaatataatatgatctcatgttcaataagaaattgaagtcttttaaaaagggatagaaaatttatttcaagaggtaatctaattaacagcatatattttattgtgagttaaagttcataaaatctagacatattttctcatttaacattcatagcaatcctatgaaagctgagactcagaaagattaagtcactagttcttaattttaggtaactctcaaaattatctagaatgttaaaaaaacacacacatatccctgttttggggtcccataccagaatgactgaaccaaatctccaaagggtagcatatgggaatctatatttaaaagaaagccccaagtgagtctgaagatgattttataattcagagttcagaacctgggaattaagggacagtcatactagcagggattgcccagaagtcttcctactacaacctattctccttcctctatgtaacactgccacccactgatcagaaggcatttcctgaatcactaaagtctgcaacagtcctaagtgtcacctaagcaggaaaaaagactccaaagtagggctcacctacagagagaagaaaaatcatcaagatgatgcatattcctgaatagcctgtacagctcttatctccccgcgcacctgtgctttatattttattcaataatcagtcactcacatatcacaatgaaatacggttaatgtatggataatctcactatggactggtccagtcatcaggcacacagcaatggtaaggggcaatatgcagatcaggtacaaacagaattattcttgagttgtcatgggacagagtttaaattggttctactttatgctttattcctgctttaagtaagagaaacttgggagtccagtgataataataataatgataataagcatcatcatcatcagtcatctctctctcaactcattccatcaccaaattctgccaataattcttctacaatcagtgtctgtggttagaacatcgcttgctcttttttattaccccatcctagtacaggctttcatagtttgccaattcacatgacatgttctttgtcttcccagtgtcttttctttaatttatcctctgaacagctacaaacatcatcttctgaaacacagatttggccacatcatttcccatgacatataaaatgaagtatacatgtctccctctgggcttcaaaaccctcccagtgtaaccttcatgatataactctcattactcaactctgggtatccttcctaccttgaagtcacactggattattcaccttatcttatataattccaagccttcactatctccagcctttggttatgctctactctctaaaatgccctttcctaacccattccggttttcaaagttaaagcaattcttcaaggttttgtttgttttgtgttggtttttgagacaagtttgcctaggctggagtacaatggcgtgatcatggctcactgcagcctcaacctcccaggctcaagtgatacccctgcctcagcttcccaagcagtttccaaggactgtcacattaattatagtccaggccttcaagactgtgaggagcaagcagtgcaactgtctaacacactcaccagtcatacaataaatgctctggttcttctcttgacaaaatgccaaaaaccattcgattttagacagaagatcaaaacaagaagcctcttcattttgaccaaaaaaaaaaaaagtcatcctggttgcatagattcaaaataatgtaaaatacttgaaaagataaatttttattgtcactttttttttt

SEQ ID NO: 16479 - DNA, 7235 bp, Human
tcctcgtacgattttttccatcttgaacagctatgatttgaacatttccttttgccacacatatgcaaatcagtaataaacttccgtacagtactttagagcttagaaaagacctttcatgtaagagtcacataatatcctatgaggctggcaagaaaatacatgttactcttattacagatgagaaactgggactcaaagaggtgtgaagctagtgtcccaacagttacttagcatttactggataagcccaggctctaactgggtctcctgacagaagtccagctctctctctctgctgcctctttgtcagaactcctggcctgccagcgaatttaactgtctatgagtaaattctaacatctaaggttctaagtataaaatatattgaggtttacagtggtgagaaaaagcaagtgtctgcgtattacagacagctgataaatacgtattgagtcatcagaaagtgaaaatagatgtaggactattatgcaaagcataggagaggaagagcatatgcttaagaaaaaatggcattcctagagttaacaagcatgtttcaaagtatctattactgaaatctacacgattttcctttccacaataaagtccacaactgttgtcttaaataataactgcaggttttgccctccaagtcaaacttggagctccaactactggcagctcaccgtaagaatatattaattatttccaatttccttttaagaagtcgaatacaaagtagagagaatatctgcagcttggttgcaaagccgcttaaacatttcactggctagttctggtaatattatccgaaatcaactcattttgtggttgaggtaatctatttgtctttaccaatcaagtcgttttaaaaccttcaggagtagagatgatacttgaagaattaacaaataaaacttaatcaaggaaactgttaactcattctcccccctactttttgccagttattaaatgttctggtaaatcctaactcaacaagaatgactcatgaggaaatcctgactccttgaactcactgattctggtgcattacagctatgaaatctctatgtctgcagctttctctcccaccataaggaaatctgtgatttctattttggcaggagatgtgaccaaggactcctgaggaatgaccctatagacagacccagccacgtgcctagtagtgatcaaaaatgcaaacccaattaaagcactgtcttctgataaagtcactttctcttgttcaatccctaatgttcattctcaaagtgttccaagacgccccagcaagctgcagagcagatcccaccctgcccctgggcaatcaacgtttcaggttactccttccttaagttaagtggcagagagaaacgggcgagggtctccccattgcctcagttcacagaccagggggtgtcgaatgagtcctacagcaggacagcaaacaagaaatgaggcgcggggtcagggaacgcgctcaaaaaaggaagaaaaatcccactcttcattcgaaatcaggccactgcactccggcctcgtggcgggcgacctcctcctgccagggaatcgccgctctggcctcgggctggggagcccgtcagggtgggtgagggagcgccggcgcccccgcccggccgccgccaacttcggctccctccctccgtcgcaaagccctcgagcccgcccggccgccacgcttcagcaaaaggtcgtgcgcagcggcccacactgaagactctccatctgctcccacacctgccccagctggccgctgctatgtggcccgagtgcgcaagaagccggggccgcagacgtcagcagcgccccggcttcgagacccttcggcagcagccgtgactgccgccggcgggcgctgacccatccccgtgccagtctgcagccgaccaatccgcgtcctcttgaggcggggccggagccgcgaggccccgcccccaagccgaggcctcataaatgctgcgacgcacgcccagccgcaaacagccggggctccagcgggagaacgataatgcaaagtgctatgttcttggctgttcaacacgactgcagacccatggacaagagcgcaggcagtggccacaagagcgaggagaagcgagaaaagatgaaacggaccctgtgagtatggctttcttccctctcccgccaccccctgccccacactgcaagctgcaaacgcggtactttcgggctcgcctttgacgttaggaaactagcctgagcctatgcagggaaaaaaaatcgaaaaggtcaatttgttaagtaaggttaaatctgggtgatgctcgggtacagtttaagaaccgagggagacagttgatatgagggcggtggttgatgcgctaagaaattgcgggttggctttttgtcctcctgcattcaaaatgacatcagaatcctgcggctgaagcgcgtccccagcattcatacgttgcatgatgagttctcatcagcttacacagctactggaaggtgatgctcttgctggttctgaatatactcgtttaaaatccatttttgttttttaattatagagcagatctcacccagtccgaatgtggaacaaataattgttatgcagcgtctgcttaaaagaagtgtcgtaggtggggaaggaagagcgcaggggaatcagtcacccacctctttgtacagtctctggcgtggtccagaacctcctgctctaaagagagaagcgtgggccggctccagacagttccatgtctgtccttttcattaaagtgcaaaacgtctcggaattgtaattaaccttgcaaacaaactgatgccctttgtgagccagaaatagtgtctgccttttgaactaaattcattaacaattctttaaaataccctagtgattataggtagccctgcccttagttgtaaaactagtagatacggtcagattaatggacgaaactgctcagtacatgaggtttaaatgttaggtggataagacttatttgaagagttcttgctttgccttatgcggtttgtctctagttactgggtgactttatttggtaaaaatgcgttcagctgcagtagcatattcaagtgttgctagttagtaattatctttttaattttttgttttagtttaaaagattggaagacccgtttgagctacttcttacaaaattcctctactcctgggaagcccaaaaccggcaaaaaaagcaaacagcaagctttcatcaagtaagttgagaatcctgtgcttgcaaatatcaatagttagctgctgaactgaaaaggggaactctgatgtgcgtaagctaacatacagaacctctcttgcaggccttctcctgaggaagcacagctgtggtcagaagcatttgacgagctgctagccagcaaatgtaagttaactcttgagcttgagccattgctaacatcgcaaaagcctggaaaggctgcgtccacctaacaaaagagcagcttgcctgagggggattagactgcagtcactataggataaagcctgtttttctttcctttatttcccagggtttaacaaataaatgcatatattctctccaggtggggaagaaaatcagcctaaacaaattaaagtggcagttgcttatagttaaggttgagtcagtttttccattgcatacaatgttttcaagaggcttagttcccagagaatttatggctcccctataaatatttactttgcattgacagcaaagtacttatatttttgcagcagagtgccaacataagccttttgcctactggtatcttagtctttaaaaagctaaattttgagaattacaggtttgagcgaaatctagaaaattcatttagaaataattaaaatgtgagggataggagaaacataaggaatcatttggtctctcagttcttcacattctgcatgctctcttttctccccccttcagatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagaggtaaggaaacaagttcctaatttcagcacaatctggacatctttagcacaaaagtgaaacaaagtaatcaaggacaaagcgggctaggaggggtaaaaagtccctccacgttgtagctttcagttatgttaaagttctcctgtgacttagctagtaaagctaatcacacataatttttattttttgttttcaaatactaaattttaatctttaactctgaataccaaataaacaacttttttgttttatttcagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaacggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattgaacacttggagtctagatgtgattttatttttgataactggaaatgtggcagataaagggaaaacatctttatagtaaaagacatttcagtttttgtgcctgcccagtgagaattgacagtcttcagaactgagaaatgatagttgcagacagataattctttttttaaaacctataagcattatgcagacctaaggaagtcacatccttagaaccactgcatttatgctttctaatcttaaaaaaaaaatcaagcttgttaatgaaacactgatctaaaggattctgtatctaagtaccagctaaatatgagaagtaaatgtaatggagacaagcacaaaaattattcacataattaagcttctcaaatgaagaaagaagccaaataaggtcaatgtatgcctgtctttatttactttccattggttccaagctcccccacaagtaccagcatgggcttccaagatacatacctgaaattgttcccttccataatgtatcaatagaaaatctcagaattttcctgattttcatgccttcatttggccaacaaagaatctgttactttaggtaatgataaagtcaaaagaagtgcgctttcgtttcttagacttaaatccagaaatgtgcttttttccacttgagagaggaagcccttgaatctgttttcaaactggctaattaaaaagcaccccttcctcagcaggctgtttttttcaatgtccttgattatggtcttaataaaaaaggaggaggaaccctgattttagagttggaagaactgacgcaaagtaatcatttctcatagctttgtgaccttgggtgtccccattgtcttctctgactcttcattttagaccttcctgcctttctggttttataaagtagtaagggactttagaaatcataaagcactaagaacattttttttctgatttgccagaagaaaaattgacctccagtagtttactgtttccattgtgattgcactaattttcaccttagccagagtttctggcaccaacagacacaagctctattagagagactgccttgtctactgtatcacagcagccagaataatacataataggtgctccataaatattgattgaataaatgaatccaaagagtcattgaaacaaatatttctttggagaataaatgtgtcaggtctagcataatccttaatttggaaagattttgaccaacagaggaactcaggagtcatgccatatatcatcctatttgtcaccaagtcatttattttacttcaaacctctctacagcctactctctgttaccactctgatcaaagacaccaccatctgatgcctagattactgcaatagtctcatctcctctcacccactcttccccctctcccacaccaatgtgttcctgccttttaactctagggatcccttcaagacaaatctgatcttgtctccagttgcttataaacaccttgacaggttttgcaaacaattaggataaagacagtatctctaatatggcctaacacctgcatggcttgacccctccttttgttccaaccttgactctaccacatttctcccagctctttctgctaagccacactgtcctactttcctagcaggtgccatgcccactggcctcacaggaccttagcacctaatagttcctctgcatggaattcagttttagctcttactcatgcacatatcaatgcaattgccacttccttagggaagcttccctgacctccttacctcggtcagatccccttttagatggtcttatagcaccaggttctctaatttagagcacttaatggagttgtaagttctcattaatttgtctgattatttaataattctatatcttcctccaccaaattgtaggaaccacaatttgaggacccttggcctttttccgctcaccactgaatcccaacacctagcatagtgcctgctgtacaatgggagctgcataaatagttgttgaatgaatggatga

SEQ ID NO: 16480 - DNA, 225127 bp, Human
  misc_feature (1)...(225127): n = A,T,C or G
ccccgtctctaccaaaatacaaaaaattatccgggcctggtggcgggctcctatagtcccagctactcgggaggctgaggcaggagaatggtgggaacccgggagacgtagcttgcagtgagctgagatcacgccactgcactccagcctgggcgacagagcgcgactccgaatcaaaaaaaaaagtgaatgtatttgtttatgaatgaaaatatccagagatagaacttatttcagccacagctcgattccaagctcgaaaatctccatctgggtttcacttttctccaactctcagttctgccttcctgagtatcagctttattttcagacttcaagctctaagctcacatcttcattatgcaaagtccagtagaagagagtccactttcttaagagagggaggaaaaaaaaaagtcccagaatggtggtttttgtctgtttttctctctgattggccagacctgggttacatacctacccatgctaccaggacagaaagccatcactggccagacctgagctgtgggtctaccagtgagtcagcagcggctgacatcacctaaagcaaatgggctgcggggtgagatcaagtggttggatcttccaaaatgaacaggagtactgtttcaacaagagtgagtgctgggaagcaaaaccacaaatggccaatacaaagtatcattagtagaccccacttaatacaattcacatgttagtggaaccaaatgaaatttttaaaaatatatatcattcgattcacacttctaatcaaactatagttctggagagggtaacctcacaccttgaatccaaaatatctcttcagttgctggccttccacttgtcttcaggagctgaaacacatggcatttgaaaaaaactggcgaacagaggaaactcttgcagcctcgcagccgccctggtccagtgccaacggcaggagcaccacaggaagggaccgcgcgggtgcgccccacccttccagcgtcgcctcggggactcgcacccctttccctggccgcacaagacgtttcatccttggcggccgccgccaacccgccgggaggggcggtcggaactggcaggccggggcggaacccccggggtctccttgtcgaggcccgggcagccagatcctcagggccggtccgggcgggagcccggtcgatggaggcggctcccgtcctcagctcccgctccctccccttccccggggcgggcgcgcgcgggccgggagctgggaggcggcggctccccccgggaggcggtggcgagggcggcggaggcgcggccgggcgggtcccagggccgtggttctccagcgcaggagtccccggcgcacccgctgcgctcgccccgcagccgcagcctgagcggccgaagtcgccaccagctgtgtccgcgcagatcccgggcgcggaggggagaggtcgcccgcttgtcgcccccgccggaccccgggcaccgcgtagcacccaagcgccacccggacgaggggccctggggagcggctgaggccgaagacccgagggaaggaggagcccgcggacggctgcagccccaggtaatctccatggaggacggggccggtctcctcgcccagaaacccgatccgggcgccttggaatgcggactccagaggcggcatctcgaccagacaagtttctcgcggcttggaatgagggagtcctgaaaccgacactcgttttatttaaccagcttttttctcctgttttaaataagtttatttagacaatggaaagaaaaaaacaaacagcctcttgagtgactgtgggtttgtaaatataatcctaaaagtttttcatggtgtggttatttgcttgctcatatttattaacctgttaactcttccgctagtcagaaaattgacatgtaaaatattctttgaggaacgttacaagtttgctgttgtattcgggcatcctgttattcatcagcttagttagcatctgtcttcccccgaagtggtaccaaagccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccaggtaagtgtatttatttatttatactgtgcattaatgcctcactcataaatgtaggggcttttaagagataacaactttgctttcaaataatctaaaaatttcaagattgaacaagtgcttcattttattcttgaagaagaaatatagagtattttgattaaattaagtgaaacaaaggaccgtctcattcagggatgattttaaagcttccctttcataagattatggtactaaagaaatgacctcttgtaattgtttaagatattcaccaacttataatgattctgaagtagatctgtttaacagaacacatgtctgttgccttgacagaattttgtaaggaatatcagagactttaaactacctgcctatctacacagtaatgatcctcaaaaggctttctatttgatgcagtttatagacattatttaaaactatacaattaataaaattaaatggaaatggaaagaatcaatctaggtatcaaatacagaaactttaaatttaaagaaaacagatatatcttctatttaatatatccattttgtgggggcaggtaaaagcaaagttacatctttaaggggtttactcagatcctttttcaaatagtttttctaatagctggatactgtttaagcatcagagttatttaatgtcgaaaatgtattagtatctatattctttataaacatattgaaatatagcaacatgtaatctggaagagtttagaagaaaacccttctagacaatgcaaacagctacattcttaatacatttgtattaaattaaaatacaaatcaaatattgagatgtgtgcaactgatctgggacacacactttttttttgttttttttttttgcccttagaaaatttcatgttatcaactactgagcaatgctgttcaccaccagagagcaggatgatatggcagagaaactctagaatatccgatattcagctgaagggaatttttttccctttttcttcatccataccttcctatcaatattatatttaagatggagatttcaaatataagtttgaaggaggctcctttttaaaatagtactgaacatataaagaggcttgcctaagataagctcttttttttctttctctggttaacacagtatctaccatttctaattttgttatcatttttctttatcatcttgatggtaaaacagaagatttgtttctttgtgtaaataatgttaattttgagcttgtcacatgagttaattttcttcatagtctttaaaatgaagaattcttacattactaaaatgttttagataaaataaaacttttatctctttctggagatatttgttatagtttagtttggtggagttatatataccctctttttaaattaattttcttgagaaaagcattatttctgaacattgaggcaaatattaatttttggtgtaactgaaaagtttgttaaaaaatatatagtagaagagataatcaggcattggagattctttttctaaaccatatattctgctaaagaagttattataagctaaaatgtaaatatgtaattgtctacctgtcatttcaaaattttaaaactgtaaagaaattacaattttttttcttttaatcttgggactctgattatatgacttccttgaaacctgattgagtttcagctgctttttggtgattagagccttaaaagtgcatttgttaagatgcaaaatatatttttttaaactatatgtaaatactttgtgatttatatacactataaaatcagggaaattgaattaaggataaaaacactattctcaactaaatgaatgccttgaatttctaattgcttaacagttctgacagtaagggaaaacagtagaagtttactttccctgtgctgtgtctattataaatgagcattcacactgaaatgcatgaactctgaacacctgtccagattaggaatgctgccaggccacaaaagtaacgacctacattataaagataattagtctgaacaatcctcaaaactatttcatgactgaagtttctcgtaaaggggtgattttaatatttcttggtttgtctgtttgtttatagtaaaaaactatactcttagatacctggatatcacagtgagtgatttattctttcatgttactctaaacattttcatcgatttcatgtaagttacaggacaagaaaaaaaaagtagtcaggacctactacaattaattaatgtctataagaaattatttccccaaatcttctacaaattactgagggctataattcttgattacctgttgccaaataagagcttaaaaatcaattattgcagtcctatcctaaaacctttaagcatctcaattatgggtatccattttacatgtgtttcattgctgaattttttttttcattaaaatatttgaaaataacatgaaagtagacctaaattctaggactggctctgccaagacaggagtggccttgaacagctcccttgctggctctggggcttggtttcttcacctgaaaaatgaggattccagagacccttttttatcctgtttgttcaacattttagaaattgatctggaggccaggacgaagatagatgagaaaacatcagtgaataatacaaaatttaacttggtgataagtactattgtctagatttctgctaagtagagatgttacagtttttactcatagaatagttacctggtaccaggcactgttctactttacatattaatttttagctcatataatcttcacaaagattatttaaggtaaatattattcctgtttcacaaatgaggaaattgaggcactgagcggttacctacctgcctaagatcacatccctggcaagtgctgaagctggtatgcagtttgagtccggctccagcacacattcctttaaccgttatactacattgtctctctataggtttcaaatatttgttcttgatatgcctcttgatggaacagaggtaatccatataccactccaacaatttccatcacttcccttacatatgaaatactcattcattcacccaggaggtatttactaagcatctacttttgcaccaggcataaaggagtccacaggacaattaaatgtggtgccttccctagctaagtatatacagtctagttcaggtgatttctttctcctcttttgctactgctgttaggttgagtctcacttgttctaaaatgtgcccaaggtaacagaagaataatttacctgacgcctttattgatgtgtccatagaatagagagtaatagaaccttcaacctcctcaagactccctatatcatattttttcattattcgtttctactctttttgcatcatcttctctctgcagattggctgtctttccttatctgtttcatgtaacctgccctaaaacatagccaacactgatctgtaactttacatctaatggtccaggcaaccaatgagaggccaggttaacactctcttgttcccatgagtctaatgaaggacaaagaaaaggtttggattagaccctaaaagctgcattgtcagcactcacatatgtcatatgtgagcatgtgtgacagaatatgtcagcgtattttgatgcatgcattctggtccaatcttagagggtaaaggcagacattttcccccttaagtcatatagggcagaataaacagcaaacagcagtggggtagttttcttctcttgcatcactggatggcataacactgagggaggtgaataaaacatattcttctcttcataatttctaatacaaagatggagggagaatgataatagaaagtcattttccatttaatgtaccaaacaaagctaatgccctcaagtgcagcttttctcccatccatcttttaaaaattgcagttctagagacagagtgtattcttggtcatactccatgtaaatcagcttcttacttgcctaccacagcagggtttaattaacatgacacaatttcacacattctttcccaaagaaaagcttgcccttgtcaatttttattattattactaaattacttttagcaagtccatgtaacatatttgaggcctcccactgcatttttcaacattataaaatatagttttatagttcattcctttttcagaaaaaggaatattgtcaggatcttttaaatatctttcatttatgttagaacctgaagctctttagttattaatactcattttccagatggtaatcttttttcacttttcttgtactgccaactttaacatgattctatttcatttagaaattgatttttactttgggatgatggtgggtgttagtggaagagaaaagataggttacattgacaagcaggcacttccccttgcagatattgcaatactttgcaaaatatatgtttgtatatattgagttctttcactatgttatggaattgtctgtgattccaaaaactaattgcttcttctgccttttgttaatggtaaataattaatggttaatatttgcttggtggagtctttttaaaaacagatgcattgcaaagcaactctattcatgctgaattctgaaaaatctcagaatggaaaaaataagtaattgagtaaatttcagtgaaaagcacattctggatatgcctgatttatggctctgatcaaggtggtcactgctattcgcaatgtttatattattgccttgactgtttgaggccagtgtgactgatgaaggtagctgttcatagaagatggtttgacttaaatactgccctagtttgtgagtgccagctgctatttgtaaaatttagtagaggccttttttcactcattcaacaaatattcaatgggctattctcacttcaagtactctattagacattaaaaatatagaagtgaacaggacaagtacttacagatgcttccaagctatggagaaaaattgcataactaattataacagaaaatcacataactaattataactttggaacatactacagaggtaaagtagagagtgatgtgagaatgtgtaacagggaggcctgacagataagggggatcagggaagacttttgtgaggcagggatatatatacttagaaccataggatttggaagatgaaaccagatggggaagtggagaaaaaactttcagacaaaggtagcagcatgtggaaagaccctgagacagaaaagagattatctcttttgggaactgaaagaggacccacttgcctggaacttagaagggagagcatcatctaaccaggcctgagagataaaagtgggaagcataccacacagggtcttgtgggacatgtacaagaatatgaattttaaccagcaagtaaaataagcaatcattgacaggatctcagctggaaagaagtaacagagttccactttgatgctgcattgagaaaatggtagaaggagccaagaacatttgtggtgagattagttgctgcaagtaaaagaaggtgttaaggatgcacgtaggtgattgtgggaccatgaggatggttttagcggaaagatcataaattcagttttagacaggttaagtttgcttgtgacatgattctagtggagccaaatagtggctggaatataataagaaagggcacagtctatgtgagttgttgttgctattatatcaagttgatagttcaatataaaatcctagagcttagaggaaggaggtctgagttatgaatgaacattcagaatttactagagtgtagatgataatgaaaaccaagaagtatatgagctcatctaaggaaagggggaggggtgaaaagaagcccaaggacatggtgctggttatgcctctgattgagcctctttctttctttcttctaagatccatccgactttagatctctgcactaagggtgggcttatgtgcttcccacaactctacttaagctaaaatgctcatagctatccctttatgaacccttagtgtactttcattggtcatcttcaggatatttccctcatttcctgtgttatttctattatcatcatcatagcagataaattttgtttgttcattgtatgtgccaaacactattataagagtttggtttttgttgttgcttttgagacaggattttactctgtcgcccaggctggagggcagtggtgtgatcatggctcactgcagcctccacctcccaggctcaagcgatccaaccacttcagcctcccaagtagctgggaccacctgccaccatgtccaactaatttatatatatatttatatatttatatatatatatatttatatatatatatatttatatatatataaaattttgtatattttttgtagagatggggtttcgctgtgttgcccaggctggtctccacccctgagctcaagtgatctgcccacctcagcctcccctcgtgctgggattataggggtgagcccctgcacccggcctctaagagctttaaccctcattaaaatccccttaggagatatcatagtagcccattttcttagaaggaaactgcagcatctaaagataatagctgcccaatatgcatttcctacttgttcctagcatggaaggatcgtgttgcagttatcttcccaggtgtatggtatctttgatgcaggctgttggagttcatatttcagttctacctctactagctgtgacatcatgggcaggttacttcacctctaaagggtccaacacaatttcagtacctatgtaaatgtttattaatattagctgcattactattgttattctatatcttcccatatcatattatttccttcagggtgccttataggaaatcttgatgatgtgttgacatttataactgatccaactttgtaactttctcgaacctaactatttcagaatgcctgtctaagtgatctgttgattttcaaaatttaaaatacagtttcctgatcagtcagcatagtcctcatcataggttgaattcggagcagaattcaaccacaactgtcagttctgtactgctgatcaagacagttgtgtctgtgggaactctctgacatgcaggctagtgtgcttgttctgtacttattcagagtaccctactgaccatgcaaaagtcttcaattttctatgtatttttgtgcaagcatttcacgaacatattcatcactatactgaaatgtttacatgttgatcttgttggcctttaaaagtgttttcatctcatttctttttgaaaaatttgaaaaattactgggaaaaaacatgagccctatgcccttggaaatttcagtctaacaaggaagacagacattagacaaataatattgttaataatatttcatgagagttatgataaagtctccaaagggagcctcatctaaaggggaagaatacagttggtcagcaaaggcttccctgaggaattgggtttttgtagcacattcagacgtgcctgtaacctgtcaattccaaagattttcttgacattttgtatttgtctacatccaactatgttatataacattgtgattttgttatctaatcatgtataacttagtccatctatctatctgaatctgaagtgtgcatcactgagtcaagccaatttcccctcttagttttatgtttctattatactggcatctttatcttctagtccccaagactgctacctcccccaaccataatttaacagtaagcatgttttttttcttctttcttcccaaatatctctcatttccattctctctcaaaaccaccttagtctggacctataccacctcacacatggattacagcagcagccccttagctgggactgtcttgactctgcctacttcttcactctgcacagtgtggcatgttctctctctgttcatattactgctgttcatcattctgggtgtcactactacactaatcatctgtaaacactgtctttatcaaatccctctgttcaaatgcacccaatgctctttattttcaagctcatactcttgtacttcacaatcactttcaaggacattcattaatctgcaccactcttttaatcaaatattatttccattttcaaccccaaacatagtatcctatattttagttaatttcactctgagctaagcacattgtaaccatttcatttcttcaaccttgccagggagttttgcctgacatgttgtccccatcctcatatccaaacccagtgcatcatggcatgtcactttcaagcaccatgtctcttagaaactgccactgactttactaagcttcactaatctctctctttctctctgtctctctctctctcttctgaaacctgtaacagatagtctatactgcataaatcactatttattatgtacaacatactgttggctgctgtctcacaagtctcatttcccttaatagagtccattatctaggggaaaggattattcctaatatcctaatatacttccgtggtgtccacagtatttactacagcactaattccaaagtaggtgttcagtaaatacctgatcactaattgcataatgataagtatttttggtgggtgaaggttttatctaccatagatattatgatattaaatttatcccatgttgggatgctatgattacattaacttaacattgaatgtaatagttatttgtaacttcaaaagataagttaaagcattagaatacagtaaaagtgtcaaattaacctacaggtgtaagatgccattgtattccattaattccacaaaaagtcattgctcctggcacaagtggtgcaatgataggcaaaagaaaggtactatctctaccctcttggagcttccaggcatacagaaagtctgactttaaacaaaattttaattatggcaataagtacaaaggagatgctcttttcacaaagaccatgtatacccactggtcttaccaagtttgaaaagtcagagaaggcaccacagggcaattgtggcgaggagcttaattttccatattcatgcatctgcatgatgcctcacaagtgaagggctcaggtgaagtctgtaactttgcctttgcctactgctacggtgccaccttccacaggaggagtgacagcaacaggtcagtccatcctgaagttttcagagctaacagaaacatggaagagaatgggaagtagctgtccttggatgagtttgtagtatgaatagaaagctctgagaatctgcaccagagactgaagttggcatggcaaagtgagatgtgcaattgaaaaaggtttgcagaaaacaggagaattttaatgtatgcatttaaatatgttagaccacttcctcagggacgtgcactggaattttttctttagcttcagaaggaaacttgaagagcttaatagaaaagaaatgtccttcagcattttataatggcttacagagaaaataactttgatagattcctaatatctgtcctaaacagtgagagcaaatactcttcaccactctgcctcatcacagataagaattgtataagttacatgcctttcacttttgacaaaggggacaaattgtaaaatgctgctatctaaaatggaaaatgtagcaatacattttatgtctagtcaaaaacacctcacaggtaaaattgaaacgtagaaatgggaggatatgagattttgtattctgctgttatgctccagaatattatagtcataagaacgtacataactgtaaaagcgcaattacttatcaaaatgaaataactataattacaatgaaaactctgttgtccaggtaaatttttatttgcttaaatatcatctgtatctataccagagcatttaaaagagacctcacatggcatgccaagttcttgtccccctttctctgcagtgtttgtaagatttgtcccttccctacaattctccctcacctatgatgattaacagtttacgactacattgtgagaaatgagactgcactggcgtgccagatcaactctgtaagattgctctatgatattctccatgttattaattcttgtcccagaaaaatctgttatgttatccccctaatcaagaaagttgtgtgtctctaacagaatatcacagactggataatttataaacattaacaatttatatggctcacagttctggagatttggaagtctaagagcatggtgctggcatctggtgagggccttcttactgtgtcatctcatggtggaaggttgaagggcaagacagcatgcacaaaggggcaagagagcaagagccagccaaacttgcttttatgacactcttgagataagtaacctgctcccaagataatgacatttatctattcatgagggcagacccctcatgacctactcacttcttcttaggccccacctcccaacactgttgcattgggaattaaatttccagcacacaaactttggcggacacatacaaaccataagatctccctacaatctttcacaacctctgtactctcaagtcttagcataatctgggttacccatacatagtcaaatttattttttaagtatttctcactctttcctcccactcattattcatcatccttacccaatattgtgctcattcctgcctctgtaacattccctctatctcaaatgtctcttcaaattactcccatccttcaaggctctacccaaatcctactccacagtacagcctcaccaccccctggagcattccacagactcccccacttgccatggtctctttcttctctcatcctgttatagtcattgtctctaatccacaaccctcacattattatcattcttgtcactatctctgctttataatttagaacattttaaataaattcagtctgctgaacatttatattttaaatagcatgagagctaccccataaatgtttgaatgcatgacatatataccctaaatattttaatgaatgaactacaatatataatttaaaagataaataacacatttatcctgtaaatagaatatactataaatatcctacaattctattctagaatgttatattattcataaagataaacatattgttcaaaatattgttcattgtttatgtcatagaattttggaagcagaatgttattcgtgaacttcatcattttacttggtacagaggcccaaatgacacaataagtaagaagcagatgtgcgatagactctaatcttatgacaaacactaaatacagtatttttcacctgtgcttgttgttgtaccagctagcttttagcctgccttatgtagaatcacaggacctgtcttaatttttttatgttccattataatttcttgcaaagttccaggaccataaaactctaataaggttttgctctaagaagcacccaggaattccagagggggaaggcaagatggccaactagatgcagcaaagaagtgctactcccacggagaaaaaccaagggtttgagtaaatcagcataatttggacagatctctagaaagaaaatgcttaaagtagatggagatgcaatgcagatgctgaggctgagaagggagaaggcaggcacagggtactggaggcagggctagtccctggccctcaacagctccgggggaataggttcatgatgggactgtgggactgcccaccctcacaatgtgcctatgggatcctggcttagagggccccgcatcccccatggacacttgatctgacaaggggatctgattggagagtagataaagacagagcttcatccagaatggaacaggagcctttgtacatggtgcagctctggcagaacatggtaataggcgtccataacccaggtctctccatctccctccaaaaagctctagccacagctgaccactaggccagaagaaagtagagctgacttccctgtggaactggatcatgtctgttctgcaggccttccagcctgccagcccctctcagggccacaccctagcagccctgcaggaacatatgcacagtacagcctctgctgcccagcctgggtgccttgctccacctgattatgttcctcgtggcttgggagcactttggattcctcagagcacccagaatccaactccaagtacctgaaggatggagccccaattccatccaagtgcccgagggctgcagcagccacctcaggaatgccaagccaagttctgtggctggcactcaagtgggagaggagctcacactctcaaagcactgagaggggtgagatgcctattcatgggctggagtgggagggggcatgcctccctccacaggatttgccaggaaaggttgtctcccatctacctgctgcaacttcggaccagggagccctgcagcacagaccacctaacaaaagaaatgcagacgcactgtcagtgatcagagggactcccccaaggtccaagagtggacatggtgaggaggtcacctctctccctgcccactgcagagcacagctgcaaatgtgagaaatacagaggagccatgcagctagataagaggctatctactgcccattactcttcagcatcatctactggatcccagcccaaactatcacgccaaaaatattttgctactatacacccctgtgaaaccaagggcaagaattcagccacaaataaaggccctatagagaggcttgggcatgtgaaaacatccagaaacaaatccaactgaagtactcaaattacgtcattgttaaagaaacactggacttcttagatgcgaaagaatcatggtaagacctctggcaatttaaaaagtcagagtgtctcctcatctccagatgaatccactagctccccagcagtggttctcaaccagtctgaaatgactgaaatgacagacatattatttagaatctggatggcaagaaaggttgagattcagaagaaaattgaaacccaattcaaggaatttatttatactatccaagagatgaaatatgaaatatccattttaaaaacgaactaaactgaactactagagctgaaaaattcagtataagaatttcataatacaattagaagtattaacagcagaatagaccaaactgggaaaagaacttcagagcttgaagactggctcttcgggccaactcaactcagacaaaactaaagaaaaataattgttagaaatgaacaaaacctctgagaaatatgggttatgtaaagacaccaaatttatgattcattggcattcttgagacagaataagcaactgggaaaatatatttgagtatatttccctaatcacactagagaggttgagttgcaaattcaagaaatacagagaacctaggctgcatactatatgagataaccatccttaaggcacacagtcatcagattcaccaaggtcaatgcaaaagaaaaaatcttaaaggcagctagagagaagaagggtcaagtcatgtacagagggaatcccattaagctagcagcacacctttcagcagaaacattacaaccagaagagattgagagcctatttttagcatttttaaaaacaaaatttccaaccaagaacttcatatggcaccaaactaagcttcttgggagaaacagatataaaatccttctcagataagcaaatgctgaatgaattcatttcaactagaccggccttagaagaggttcttagggagtgctgaacatggaattgaaaagcaacacctgctaccccaaaaacacacttaagcacacagcctgcaggcactataatccacctagacaatcaagtcttcataacaaccagctaacaacatgatgacaggaccaaaatctcacagatccatactaatcctgaatgtaaatgagctaaatgccccacttaaaagacacagagtggcaagctagataaaaagacaagacccaaccatttgctgtcttcatgagaccaatttcacatgtaatggtacccacaggcgcaaagtaaaaggatggagaaagatctaccatacaaatggaaaatatacaaagatcaggagtggctattcttatattagataaaacaaacttcaaaccaataaaaatttaagaagacaaagaagggcaatacataacaataaagagtacaatccgacaacaagacttaactatcctaaatatatatacacccaacattggagcacctagattcatgaaacaagttcttcttcacccacaacaaaacttagacaactatacaataataatgggagatgtcaacaccccactcacaatgttagacagatactcaaggcagaaaactaataaactccggacttaaacttgacacctgaccaactagatctaatagatatctacagaactagtccacccaacaaccacaaaatacacatatttttcatctgcacataaaacatattctaagactgaccacatgtttgttcacgaaggaagtctcaataaattttaacaaactgaaatcataccaagaacattcaccaacctcagtgcaatttaaaaaatcaatatcaagaaggtctctcaaaactacacaattatatggaaattaaataacttgctcctgaataactccttggtgaacatcaaaattaaggcagaaaccaaaaaatactttgaaattaatgaaggcagggacacaacttaccaaaatctctgggatgcagctaagttagtgtaaagaagaaagattatagcattaaatgccttcatcaagaagttagaaagatctcaaattaacaatctacctttgtacctaagggaactaaaataaaggaacaaacatacccccacagctggcagaaaaaaataaataactaatattaaagaagaattaaatgaaattgagatgccaaaatccatataaaagaccaatgaaaccaagagttgtttcttagaaaaaaataaacaagaccgatagaccactagctagaataacaaagaaaaataaagagaatatccaaaaaagaacaatcaaaaatgacaaagataacattacaactaatcccacagaaatagaaatatccttaaaaatactatgaatatctctactcacatgaattagaaaatctagaggaaatggataaattcctggaaatgcaatctcccaaaactgaatcattaagagattgaaactctgaaaagaccaatatcaagctctgaaactgaatcagtaataataataaaaaaaaaaaaccctacccaccaaaaaaagcactggagcagatggattcacagccgaattgtaccagacatactaaaatgaactggtaccaatcctactgaaattattccaaaaaattgaggagaaggggcttcttcctcacacattctgtgaagcaagcatcagcctgataccaaaatctggcagagacacaatgaagaaaaaaaacttaggccaatatctccgatgaacatagatgcagaaattctcaaccaaatactaggaaaacaaatccagcagcacatcaaaaatttaatatgccacaatcaagtcagctttatttctaggacgcaaggctatttcaacatatgcaaatcaataaatgtcatttaccacataaacagaattaaaagcaaagccatatgatcatctcaatagatgcagaaaagctttcaataaaattcaacataccttcatgataaaaacccttaacagtctaggcattaaaggaacatatcttaaaataataagagacatctatgacaaactcacagccaatgtcatactgaacaggcaaaagctggaaccactactcttgagaactggaatgagataaggatgcccaccctcaccactcctatagcactggaagtcctagccagagcaatcagacaagagaaagaaataaagcatccaaatagaaaaagaagtcaaactatctctctttgctgatgatatgattctatacctagaaaatgctaaagattctgccaaaaggtccctagaactgataaatgacttcaggaaagtttcaggatacaaaatcaatatacaaaaatcagtagtgttcctatacatatatcaataatgttaaagctgagagtccaatgaagaatacaatcccatgtacaatagccacaaataaaatgaaatatctaacaatacagctagccaaggaggtaaaagatctgtacaaggagaactaaaaaacactgatgaaataaatcaaagacaatacaaataaatgaaaatacttttcatgctcatggattagaagaatcagtatcattaaaatggccatactgcttaaagcaatttacagattcaacactactatcatattacaaatgctatttttaaataaatataaaaaaactgttctaaaattcacatgaaccaaaaaagagcccgaatagccaaagcaattctaagcaaaaagaacaaagccagaagcatcagactacctgacttcaaactatactacaaagctacagtaacccaaacagcatggtactggtacaaaagcagacacatagaccaatggaacacaatagaaaactcagaaataaagccacacacctacaatcatctgatctttggcaaggccaacaaaagcaagcaataggtaaagcactccctattcagtaaatggtgctgggataaatggctagccatatgcagaagaatgaaactggacccttaccttttaccatatacaaaaattaactcaaggtaatttgcctaggctgtaatcctaagcaaattaagtaagcaagttaattcaaatgcaggacatcaaactataaaaattttagaagtaaatctaagaaatactgtttatgatatcagccttggcaaagaatttttggctaagtccccaaaagcaattgcaatgaaaacaaaagttgactagtgggacctaattaaactaaagagcttctgaacagcagaagaaactatcagcagagtaaacagacaacctacagaatgggagaaaatattcacaaagtgtgcatccaacaaaggtctaatatccagagtctacaagaaacttaaatcaataagaaagaaacaaccaaccccctttaaaaacaggcaaaggacatgagcagatgtttcttcaaagaagcaatcaggcaagagaaagaaataaggcatctaaatagaaaaagaagtcaaattatctctctttgctgatgatatgattctatacctagaaaatgctaaatatcctgccaaaatagtctctttattaaaagaagacatacaagtagccaacaaacatgaaaaaatgttcatcatcactaatcatcagagaaatgcaaatcaacaccacagtgagatatcatctacaccagtcagaatggcaattagtaagaagttaaaagataacagatgctggtgaggctgcatagaaaagggaatgcttatacactgttggtgggaatgtaaacaaattcagccgctatggaaagaagtttggagatttctgaaagaacttaaaacagagctatcacttgaccacagattccattactgggtatatacccaaaggaaaataaatcattctactaaaaagatgcatacacttgtatgtttatcacagcactattcaaaatagtaagataaacaatcaaactagatgccaatcaagagtgaattggataaagaaaatgtggtacaaatacaccatggaatactatgtggccataaaaaagaatgaagtcatgtcttttgtagtaacatggatgtaactggaggacataatcctaaacaaattaactcaggaacagacaacaaaataccacatgttctcacttacaagtgggagctaaaccctgagcacacatggacatatacacaagaacaatagacactgtggactattagagggaggaagaaggaaggaggacatacacggtggaaaaactacctattgggtactgtgcttactgcctgggtgacgggatccataccgtaaatgtcagcatcccacagtatccccaggtagtaaacctgcatgtgtaccctctaaaataacggttgaatttttttaaaaggaaaagaattccttaggtgcccaggtaaatccaagcatggctgtacattattttggatttgactagccaggaaatatgtgtttgtttcccattagttcaactatctgagaaaaaatattgttcagttgacagagatatatacacagtttgcttaaccttcatgcactcaaaatactcttaacagtaaatctgtatcagtgtgctgtgataccagaggaagtgtaatcctaataaatgtagaacacccaaataaaaaaagaagcactcatgtttctttcttattatttttcaaagttactaaattttcaaaggttactaagacttgaaagggatttcaaattattgcacaacaaagtgtttcatgaagtctcagttgttttcattacatttttaaaaacatttttggagtagtttttcacataattactaaactcctcaaaaagcggaaatagaatggtatagaaagtgaatcaataggtaaatttgctcttctccaagagtatatggttcccaatggtctcacaccagatttgcagaaaccctgggaagtattttattcctcatattcatcttaccacatgactgttttgatttttggaaaatgcaactatgaaaatatgcagttctaaaataatgaattgcattgtgggaccatatatgcattttgaaagggttattttaatgagagcaattatcataaggttgtttctctaatgaatgtaaaatgtgtatacaatgataaaattgactgtgccatcgactttgcagaaaagaaaaacacatgttttaattatggcataaacattcagtacctgtgattaaaaacaaacagcttgagtatgtattacataatgtatagccagatggcaagaaatggcagtgtatgacttaggtgacctctccgtggtctttgttgtatagtatctacagagtttgatgcaaagcacagtgaatatcatgaaattttctgttagcccaaagtcttttttttactaggaatagagggctcaatggaccccttttcctctttctatcagtcccatgtcctcacacagatctgggagaagaaaagggagggcttcgaatttactatacaccagttcatctgccaaatactctgccacttatgctagtcaacaagataaaaacttgcttattttaatgctgcaaactgactgttttatattcttttctatttttcagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattattatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggtaaggctctattttctcaagtttcaaagttcagttcatcttccagcagggatacaactatcccagtttgtactacaactgggttacccaggacatgggatttactgggaaagtctgggcaatctaggattatcgctcaccctaaatcaactaagaagattatgtatttctatctgaatcaagaaaaataaagattttactaaaagattgagtgtggcaggatcctgaaatggttttctacatgtatttacaactagagtagaagtcattttgtttaattactttccagaaactatctacctcaaaaaaaagctattactaatctcagacttagctcatttaaatatgaaattaaagtgaatttgtcttaatgataataaatatttccacaaatttcaagaattacagatctcattgtagcaagttcagatacttttggaagtcagatatgcagtgcattttctcttatcatatttttctgaaactgaaaatcagtactactaaatatgaagatcaatgactgtataagcatatttattcacatttaaacatgaggatttaacttgatttcagtgaacacttctgacacatatatgaagccaatcatgccaaatttaaattgtattacatttcttattgtgtaaaactgctgcccttaaacagaaaacaattatttgaaatagtttgtcattattatgagttgattgtgttacataaacagctgattgtttactattaaaaaattttaaaattaaagttatctacatttgtcttagtttcccattcgaaatgtcataggattctatctctgttatactatgtattgatttctcataaaagtgagacttttgatacatagtttttattctacagttttgaccttttggtagaatatctagaatcaaatcagagagcaaaaaatacatcttgaaaactttgttcttttctctagtcactaagcatctggcaaataatagtaatgttcatcacactagttaagtgggctaagaataccagaaggaccattaaatgttactgtaagagagtgtgaagactgaaaagaaaaaaaacttccatattcttggcactattttagtctcttccttttagctaaacagaaattaataaagaagctgtatttaagtttccattaagtctttgtacttacttttgaaaatatagctaaattaaaactaagctggtagtttaagcatttattaggtgtttgaagattacaagcaatatataattcttccattttttttccatttcaaatgattttggtgagaaatgttttcaatatgaatatatttctgaagtgaaattgtttgaaactgtcaaatatatattgttatagaattttaaaatatggtaaataaatccctgagttttgtatgtagccccctgtttcccctaatattatacaaaatacaaaatgccatttgtgctccagaagttaagccagttttcaggggtatgaaaaattagaggcttattgaacacattaaagaaaaatttggcatgtctactttatgaactgctcatatttagatagaaatatattttctaaactaactaaatgcttttttaaaaaatgtgttttgaataatctgggttttttaattacttctaaattgcatctgtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgatatggctatatcccattccaggcatagaggcaggctttagggatacaatgataaagcgggggtgataaataggtaaatagcttgcaacatggtaagcacaatagcaaacatatcgacacagtttcatataaattatgctgtgggaaacactacagtgtgtgctgtgtacctgtaacttaagtatgtacttaagtatgtacttaagcatgtaggacagagttcaaaggcaagactagattgatgtgatgatttggaaagatgtagcagtaattcagacaaagacagcaatttcttgaaaccaggaaattggagtaagaatggagaaggaaggaccaaattaagatctatttaggaagtaaaattgaacaacttagtaattggctgaatggagatgaaagagaatataatcatgacattagaatttgtcatgaaagagaatataaggatgactttaggatttttggcataggttgataattgttgatgatgtgaacaacagtaagtaagaggatcatagtgaagatcattaaaggtcataataaaaatttcagttttattaaagtccatgtgggatgcagagcatttcacaggtagttgcctcacaggaaaagtctgggtaggaaatacagatttcaaattcatcatcctatagggaatcattcaccacatgaaagtgtgtgagctcagccagggaaaaaatttagagtgataagagaagatgatcaaatgtagaatattgaggaaaatcatcatttagaagacaagtagagggaaatatcccttgaataagagtttgaaagaacagtcagagaccaggaagctgagatgctatagcttcagaaaaagagtgatcagcagtataaaacccaacagcagggcccactgggctaaggactggagagtctcctttgggaaaagacaaagatcactggggactcttgcataatctatgtgaatggaatgatagagaccgaagcccatttgcagtcagttggagtcaggagttgactaagggggtcaagatgtgaagaaagagagtgtagagcactcagtggagacatttttgtataaaggaaaaaagagaaattatacagtagctagagggtagactggttctaggaagaccaaccgtcctggtttgtccaggactgagagtatttgttgctaaaacgtagagtccaagagttagatagggtgacctaactaaatcagataaggaagaataatcaaaaatcatgaggtctaaaaaaatcataaattttgtgattaagagtatataattagtataaatgtttaaatcaattattttatttaattattaccaatattatattttccctatttgaagtattgggaaaatttaaaagaatgtgagaaaatcaaaagttacataaactgttatgtacaaaattggaaggagagtgcaagacataaattttaactagcaaactaatcactgcatggatgttattttttttcttatgtggaatagaaaatgtgcttccttatttaatgggaagatttgaatagcaatgcaatatcagctttacccacctagatgttgaataatatgggtatattttaaagatcctcaaagccacagaagaaactgtgacatggcacaaagtgtttcattctttgtgccacaaaaagacaaaaaaaaaaaaaaaacagacctaagttgaggtctttgtttgtctaggaatatgcaagctacaagccatagcctgtaaagaaccaaagaagaaaattgtttagataattcaaatattcctttaaaaaggcaggacaaatttcagtgaaattgaagtcaggaaaagtgtgtgtgtgtgtgtgtgtgtgtgtgtgtgtgtgtgcacgcatgcatgcaaacgtgttccattggactattggatgagttttagtgacgttcaaaatttcaagttccttgtgatctacaacctaccctcaaacttcccgactaagggttttgggagagagaaagtgatgtttctacaattaaaaaaagcttctaccattaaagcatttgttttacatgaaagcacttcatgacccagtgaacactaataacccatgtgatcttttaggcgcattaactcactcttgttgtaagatccattatacctttagacctaccatttcatataacatttatctcccaagacatctgagaagtcaaatgagaagattctggagaaggtggtctttcagggttttactgaactccttgcagttgaatactctcaatgcataaaagaggttacatatcactccctcctgcatctctcccttcctctctctctttgatttctgtaataggtacacattcctttcaaactttgagaaaattcctaacattcttcggaaaatgaagaacccgcccagtcacatctgagcttactgaagaggtaactgtggctcctcctggagcatcttgtacttctttctggaggtactcaacagccactttccttttttaactaccccagacctttctcactattttcttacatttcaatataccataacttgtctatttgtggattagcccttaaaaaatctacatttttaaagtggccccagaagaaagggaagttcttaaatttttaatacaatgtcatgagtggctatatcattattttcctctctaatggaagatcccagagtacctagagaaaagaaagtgctgaaaatagaagtgggaagctagaaaactgtgaaaaataagaggtatcaagctcagaagataaactcagctgacttttcagtcttgcttggggctgactgtgggaagctctaattggaatgtaaaggtgcgctctgtgctgcttgacttcaccacgaatattcaccaccccagctaagcggaagccagaggcttcataaaatcactaaaaaataacaacataccaaatattgggaggaggaggaaaacacaactgcaatcaattattctgtcataagtacacataaaagggtagcaaaaatttctccagacagttcactattcatgtgctctgtatgaatgtcaagatctgtacattgtacatagtattaatgttttgtcatttttctcctaaactcatatttcttgagttcctttccattatatctgatgtttcttatctcttatttactgatattcatttaattttattatgctatagaagcatgtatctgcttgatcccattacttcaaatttgctagatttactttataactggatacagtatgcctcatgtacttgataggaacatatattatctaatcaaggtataccaacacaaccttgttaactacatttttcaaatctgtcttcttactgtattcttttttggggggtgagggaatggaatggtatccctgatgctaccaaaagagttatgtttaattttccaactctgatggttgattgtaaatatttccttgttctgaaaattattgccttctatattttgaagctatgttaagtgcacatattttgaaattgtattttaatatgttttttcattctatgttatctttttaactttattaatgttgttttgcctttgttttgcttaatgctaatacagctataccagctttcttttgattactatttgagaaatatatcttactccttttttatatatttttaatctctctcctgtctttgcactgtaaattagctttgaaaacagctcctaggtgaactttgcttttggtctactctgtcaatatttgtcttttaattaacaagatcaatctacatatagttaattggattatcaatgtatatggatttatttcagctactttattttgtgctttacatttgccccacttgttatatttcttctcttctttctctctcttcctttttaccttcatttgaattgtcagtttctttcttttttctatccattcctggtttaaatgaatgtattttatctctttttttttagtagtttctccaaaaatttaaacacatgcactaaacaagtgccaatatcttcatacctcagtcaaaaggtacaaagttctttatctccaataatgctctctctcctttggcggttgggttattctggttctagatgttaatgttgctgtttaacaccggatattaggcactgttgtttttactaccatcaaagttttattagatttgccagatttctactgtttcctttgccaactgttcaccttttctcatccgatgtgattctcagcttctacaccttacccctttctgtaaagagcagacagtcatgccattgacacgtaattttgatcatgaccccgctctgctcaaaaccctccagcaacttccagtgtctttatctctgctacacgcccagctccttttccctcacgctactgcagcctctctagtatctttgctgttccttgctcctgtttcagaattttgcacttgctgttctttctccctaaagtgtccttcccccagattggtgcatggctctcttctttgcttcctttagatctttactcaaatgttactttctcagtgaagtcttctctgaccattctctttaaagttgcaacctctaaatctcccatctttccctgagagtgttttgttctggcacttatgatcaccaatgatgtgctaaaactggctcacattggcttacaaggtcaattttgtgcatctccttctagctttatggaaggaatatttacactgtaaaatagacaaatgcgacaaatctgggctttttattcacacagacccagttgttaaaggcttcacagcatgctaccagacataccatgtattttactaatttattaggttggtgcaaaaataattgtggtttttgccactactttgttatttggactattaaaatgtaagctttattagggcaagatttttttcatctattttgttcacggatgtatctccagcacagagaaatgtgcctggctcagtatatatttgttgaatgaatgaattgcattctttctgaagtatatcctttagacatgataaaagaaaaacatcagctgaattaaatttaaaggagtttaattgagcaatgaacaattcatgaatcaggcagcctcccgagccagagtaggttcagagactccagcgcagccacatggtggaagaagatttatgaacagaaaaaggaaagtgacatacagaaaacagaagtgaggacagaaacagctggattggttacaggttagtgtttgccttatttgaatataatttgaacacaactgactggccaaaacacagtgattggcacaagtgtagactacggtctgtttacacctccacttgttatagctcacaatgtacagaaaaacctttaggctgaactgaaattatgtaaggaggtggctttagtccaaactttattttaaagacttccttcaatgagaatctattcatggtaaaccttctcagattttatgcattgtaaatgtctttattttccctcatccttaaaagatagtttggttgacttcacaatgcctaattaagttccctcatatatatccattgctgctcacactgggaagattggtcctccctggaagtcacctaaacatttttggtaatagaatgtccagttccactggtccctaatagttttatgattgtcacaatattaggcaatttgagaccattcttctctccctccctctccctcactctctctctttgtttggtggaatacttacttatttctacatttgatataacgtgatcatattaaaaatacacaggaaaataaattactgtcaatattattatcacattcaaatagccatagtgtgctagcaactatacaactgtacagttattttaaggaaataattttataatttaacatggggaaatcataaaatagattagcaaagggaaaaaacatttcatattcataatctatttacttttaatatattgtattaaatttgttgttacattgtgaaatggaatgtttctctactattaaggagtgatttgttatgcaatgacattctaaaagaatgagttataaattatttaaagaaagcaaaatgctgttactgaacacatgaatatgtaaacaggatacttggtgactgattacattttttaaaggtctgatacagtctgggcacagtggctcatgcctgtaatcccagcactttgggaggccgaggtggtcagatgacctgaggtcaggagttcaagaccagcttgaccaacatggagaaaccccatctctactaaaaatacaaaattagccaggagtggtgacacactcctgtagtcccagctactccggaggctgaggcaggaaaatagcttgaacccgggaggtggaggttgcagtgagccgagatctcaccattgcactccagccccggcaacaagagtgaaactccatttaaaaaaaaaaaaaaaaggtctgatgcaatgaatccaacccacgcatgatacaggagggctgtcataaatggtaccaaagctcaaccagacaatgatgagttctacacactgtagtagcagaagaatacaagaggcaaattcagaacagagatttaggttctagagatattaagaaaattatgcacatttactttgttaaaataatgtcataagatttcaaaggatatgctgatgaataatgaaacacatttttgataaaggaaatcaaaaaccttggagaaaattgtactatttgccagttactggattatgtccttctcttggttaagagaatttatttcttctaacattccatgtttctagaaaataaatcagcatgtaaaaaatcttttttgtatctctatgctggtgatttaaacctgtacagactgcagtaagttactcccaaaataggtaacacttactgagtatgtacgttgttttaagtgctttgcttcatcatttaattatcgtagaaatcctataaaacaaagattataagcagcatcattttacataaagaaactgaggctgatagattatgactaacttgcccaagatcttacaactagtaagtggcattcctagaatacaaaatgcagatctacctggctccaaaatctgagcttttccacctcatgtgcttcacagttatgagcttaacacaactggtgttaggtggtgtccataaaaatttcttcctaccaagctccaccttacggtaaattacatcctatcagattctgttatagtttgatgggttgtatctaaagctttgccctagatttaccgataagtctggaacaaaaattagtattagtcacttcttgaaatgtcttgggctgaaataaattttggatgaattagagtggcagagtgacagcatagtgacaggcccttctggcgctcaatcaattaaagaaccaaaattgcccataattctgataatctcactttttctatctgtatgtactcagattttaaagtctgtgtgatgttgtaaagtgctttatgaaggcattcctaacatttttttaaagcacacaaacaaaatagaaaaagtcaaggaaattctgacatattgtcacttagtctctgggaaacatgaattagtagctaaagcacttttttattcttaacttttataggcttccatgaataatgaaactggagactgaagtacaaaatggatcttaaaatcatgatgttaatataaaataaatcatgagatctacttgacatcatttataaactgtttataaccaaagaaatatagccaacttattaaacttctagataaactgaaatttttaaaattaaaattaaaatttacctataaaatacatattagaattttaccttaaaagattatatgctttctcattttaatattaatagttataatgattatacaggattattaatagttattagttacaccaattactaaaacagctatgtatggttttctattaatgccaaagcaaattaccaccaacttagtgtcttaaaacaacccaaatctgtcattttgcatttctgaaggtcagacatccaacatgggtcttactgagctaagttcaagatgtccacagggctgtgttcctttctggaggctctaggggagaacccatcaccttgctttttccatcttctagattccgcacacattccttggctcatattcccttccttcatcattaaagccagaaatactctctgtgccttatttcatggccacatctctctcaaactggaaaaggttctctgcttttaaggatccgtatggcccacctggataatccagaataatctccccatatcaaagtccttaacttaatcacatctgcaaaatctcttttgccatgtaatgttcacattcacaggttccagggattaggacatggatttcttggcgggggaggtaaaggagatattattctgtgtaccacaagctatgctcttcaggtaatcatgctacaattcttacaacgactcaactcccgcaagaaactctgctactctactactgttttcctcactgggaaatgaaatcttgatggcatatacatgctcaaacaattactctagatctctgagtcaacagtagttaactagggaaaattaaattattgtgctgttaaacgcttcatatcccttacacacaggaggttaaacatgggggagcaagtaactcttccttcacttagatgtcttaagaaatgtacctcaccaaagattgcttggttggagcagatgtgtgactatcatcaattcattactttaggagtttctaatatcatgtttctagaagtgcatcaattatgagactagagactgttttgaaagccagttgattaggactaccacatagtcacctaagcacagtttaccattttcattgttaccatttcattatacttttatttttctattttgttctctttgatttatgtttctgcatccacctcagtttcagtgcccttattgtattggcctttccccctttggaatttctattctaactaccccaacctaaaaacaacaatggtgttttatctgttcatcccttctgtctttatctcccctgctttgatatcctggtgcctggtgcagtaatgtacctttttccccccttcatacatagatctttattttatgtaacttcttgtctctattttcttctctgactatataaactgagtagaatcagatttctgggaaagaaaaatattgcgtgtagaaattagaccaacttgttgaggcactgaacaaagatctatcctcaaaaataataataataagttcttcactattcttttggattaaaatatatattttatatataacatattatatattatatatattatataatatattttatatattatatatattatatattatattttatatattatatattatatattatattatatatattatacataatatattatatatattatatattatatatattatatattatatatattatatatattatatataatatatattatatattatatattatatattatatattatatgttatatattatatgttatatattatatgttatatattatatgttatatgttatatattatatataatatgttatatgttatatattatatataatatgttatatgttatatatacattatatatatgttatatgttatatatacattatatatgttatatattatatatacattatatataatatgttatatattatatatacattatatataatgttatatattatatatacattatatataatgtatatattatatatacattatatataatatgttatatattatatatacattatatataatatgttatatattatatatacattatatataatatgttatatattatatatacattatatataatatgttatatattttatatatatatatagtgctagaacaacatataacagagtcatttttatctaagaatcctaagagacaaagtagttgagttcacagagaaagacaacttacttgatattcttgaataaatgaattcaagtggttttgacaataaaatgaagattagagttgctgccaatggggtaatgaatagttatatcctgccaaactcagatttctgatatgctgaaaaatacttctaggaaattttgtataacatttaacaaaaattatttgacaatattttcaggaaaaagacattataatgaaaacccattttaactctagtgtgattgctttaaaaaagtaagttaggttaatattcaaaggatctcgacataatttgctaatctgctctagaaatgcaataagtatttaaaggaagtaaagggagaaaatactttcccagtctatgtcatttcttatgtgatacagggacactgtcattgctctaactgaggggcaaatgaacaatggaaaactaaagacacatttttccttcttgctaggactgtcctgctagaagcatatctccaatagcattgtcatttgcactttgcaagaactaattagtactcagtcaccattctcaaagaagacacagctgctcattgtattcaaaaaagttatgtttacctaagtggaatctatctttaaggatgccagtggcaagaggctgttcatcaaacttcagaatagttcagagcctctgaagaggcctaggagggcctatgttcactgctccgtacttagaaattgacacaatgtcagtgtggagggtgggggtgatgggaggaagagcatcaggacaaatagctaatgcatgctgggcttaaaacctaggtgacggattgataggtgcagcaaaccaccacggcacatgtatacctatataacaaacctgcacgttctacacatgtatcctggaacttaaaataagtaaataaataaataaaaagaaaaaagaaaaaaaagaaaagaaattgacacaatttcagtgcaacatcctcaaaagcaaggaaagtctatgagagtaattaattatctttgttttcaagccatcagcagacttcagattgtttctctattgtaattgaatgtctctaaggagcaaagttattacttaattaaaactaatccttctggtcacttacatatgacatagtcaacagcttatacttgatctcttttttttttttttttttttttttgaggcagagtctcaccatgttgcccaggctgaacttgaactcccgggctcaagctcagccttccaagtagttaaaaccacaggcccatgccagcacacccaagtatacctgtacttttattattgatgaacctaaaacacagatattactgggcaccagtgatgaatctactgttaacttgtaaatgaacagaaagcaaagtcctactgtattttttttaaagaaatggttcaagaattcgtcactagtttcttcttaatcattcttttactctgtgatgttcagatgcatttaatcacttatcaatacaagacaattttcatgagtttccaaaccacggaaaagccaagaaacatcactttaaatgtttgcttaaaaatgcagattccccaattccacactcaaagatttttgtcttggtagatcagggggaagtgaggggcccagatcacctagatgattctaatgcaggtagtagaaatgcacatttggggaaacataggtttaaatagactacatttgatattattgtaaaatatgaagacctgggtcctattattttttcctgtagaaagtatcttaaaatcatgttgtataaaaatatttaattttacatatataagcaaatatataatggaaagaggtcacaatagaattaatagttttgtgactgagtttaatctgatgctggaagagttcttacatttagttattttgaaccatgtaccaagacagtgtgataatattttggcaaatatgtgtacatgtgaaaactgcctatggagatcaatatagtggattttacatgaagggacagaaacagaagattgaagaaagtaattccaataagtggatgacttgttagtattgcctagtaagaggacactggataattttgacaaagtaatgaaaggtacattgcttctgtgatctttcaggaacctgtgcatcagatcagtcagaagaaagattccagcagagaaggttatgatcaggaggtgtaagagttaggatagagaaatgggaattgttttcctaaaggggaaggaacagagagagagagaggttaattatacttcaggtttaattgaatgtgcttctaatgaaatagcaaataaattacaaaagagatctgaggttgaattatataggtgggatagagtaccccattaggtgatttttttaaatgttagcaagagaagtaattttgaatgaagaaattttaccttgggaagctttaaacattcgcctttgagaaactacaattagagtgagccctgtttggggtttttttgtctaaatgtccaaaatgaaaataaatttttattattttaaatatataaacaatccacgcactttgtaatgaaaataattaatatagaaaactacaaagaagaaagcaaaaagcaattctctcctcagtctctctacacgctggatttagtcaatctttaatgtttgcaaatctaataggtaaaattttttatttcattcattttttaattcttatttgtatttgtaagaaagagttaatatggtcacttatgtttattgtccatttgtattccccttttgagaattgtttcttgtcaatcgttttccattggagtgtttgtttttgaccaatcagttattatttttcctcttatttcacactccataaatggaacagcatgttcctttgttatttaacctttatgtatttatattcccaggaagttttaattattacaaattaagtttaaaaggttttattaatatcatagagggggaaggctgatacaacctctttcaaaagataccaggttgtagcacctggtacagtgttcctgcagtgagcaacttattgaaatgtgtactctcagagctcatttctcccctgcaaagatggcaatgaaataagaatgcagcaaacctatgagtgtgaaagcactttacaaatcataaatctttatctctgggtttgtttcttttcctgggattagacaattagatttaatcattgctaaggtctcgaccagttctaactctgtgaaattctttaaaacattactaaggaaagcccagcaccaattgacttgagcagagtaattatatggtgaaatagggtgaacagaacactgcttctgagaattaggattcccatccttcctccacatggtatgctttacataacagccccagtgaatgcatgtgtgagaaggctggttggcctccctgacttctggtgaggcagagaattccaagactctctggtttccctgaataacattatccatctgttatataacttgtttaaaatattctgtaggtattcatatgattactccctacagtctattattttgatacagtccataagcttacttttaatttgaaacaaatttcccagcctgtggttcttatcaaatccgtcatctatgtgttcaaccctcaattctgtagacctcaaccattcttttttttttttttgtacactttaagttctagggtacatgtgcacaatgtgcaggtttgttacatatgtatacatgtgccatgatgctgtgctgcacccattaacttgtcatttacattaggtatatctcctaatgctatccctccccactccccccacctcatgacaggccccagtgtgtgatgttcccctccctgtgtccaagtgttctcattgttcaattcccacctatgactgagaacataaggtgtttggttttttgtccttgcgatagcttgctgagaatgatggtttccagcttcatccatgtccctacaaaggacatgaacttgttttttgtccttgcgatagtttgctgagaatgatggtttccagcttcatccatgtccctagaaaggacatgaacttatccttttttatggctgcatagtattccatggtgtatatgtgccacattttcttaatccagtctatcattgatggacatttgggttggttccaagtctttctattgtgaatattgccacaataaacatacgtgtgcatgtgtctttatagcagcatgatttataatcgttgacctcaaccattcttaccttgactttcatattttcttataacttttatttcagcttcaagggtacatgtgcaagtttgttatatggtatagtgcatgtcacaggggtttggtgtacagattatttcaccactcaggaaataagcataatacccaatagttagttttttgatcctcaccctcctcctaccctccaccctcaagtaggtgctgttgtctattgccttcttctttgctttcatatgtactcattgtttagctcccattaataagtgagaacatgcagtatttggctttctcttcctgcattagtttgcctaggataatggcctccagctccatccattggggtgttctacaaaggacatgacctagttctttttcatggctgcatgatattccatggcatatatttacattttcttcatccagtctactacttatgggaatctaggttgattccatgtctttactattgtgaatagtgctgccatgaacatgcacatgcatgtgtctttaaggtagaacaatttatattcctttgagtatatatccaataatacggttgcaatggtagttctattttaagttatttgagaaattgccaaactgctttccacagtggctgaactaattcacattcccactagcactgtatgtcatcttttcaacctcaccagcatcttttatttgttgactttttaagaatagccattctgactggtgtaagacggtatctcattgtggtttttatttgcatttctctaatgattagggatgttgaacattttttatatgaagatcagatggttgtaagtgtgaggctttatttctgggtgctctaacctgttccattggtttatatgtctgttttagtaccaataccatgctgtttgggttgctatagccttttagtattgtttgaagtcaggtaatgtgatacctccagctttgttctttttgcttaggattgctttggctattcaggcacttttttttgtttcatatgatttttagagttttttttctaattctgtgaagaatgtcattgatagtttgatagaaatagcactgaatctgtaaattgctttgggcaatatggcaattttaacaatattgattcttcctattcatgagcacggaatgctattcctttctttgtgttgtttttggtttctttcaacagtgttgtacaactctccttgtagaaatctttgacctccctagttagctgtactcctaggtattttggtttgtgaatggctattgtgaatgggattgtgttcttgatttggcactcagctttgatgttgttggtgtacagaaatgctacttatttttgtacattgactttgtatcttgaaactttgctgaagttgttcattagatctaggagtttttaggcagatactgggtttttctgtatataaaattatatcatctgcaaacagaaatagtttgactttctctcttcgtatttggatgccttttgtttctttatcttgcctgatttctctggataggatttccagagaatatgttgaataggagtagtgacagtgggcatccttgttttgttccagttgtcaaagggtacgcttccagcttttgcctgttcagtatgatattggctgtgggtttgtcatagatatcccttattattctgaggtatgttccttcaatgcctagtctgttgacggtttttaacatgaaggaagttgaattttatcgaaagcttttctgcattaattgagataatcatgtggtttttgtttttaattctgtttatgtgataaaacacatttattgatttacatatattgaaccaaccttacatcccagggataaaacccacttgattgtgatggattagctttttgatgtgctgctgtatttgatttgctaatattttgttgaggatttttgcttctgtgttcatcctggatattggccttaagttttcttttttactgtatctctgccaggttttggtatcagaatgatgctgatctcataagataagttaaggaggagtccctcctcaattttttggaatggtttcagtaggaatggtaccagttcttctttctatgtctggtagaattcagctgtgaatccatctggtcctgggcttttcctggttggtaggctttttattactgattcaatttcagaactcattattggtctgttcggggtttcaatttcttcctggttgaattttgggtagttgcatgtttccagacatttgtccatttcttgtaggtattctagtttttgtggatagaggtgttcataatagcctctgagggttttttgtatttctgtggagtcagtagtattatccactttgtgatttctgattctgcttattcggatcttctctctttttctctttatttgtctagttagctattgatcttatttattttttcaaaaaactaacttctggttttgttgatctcttacatgcttttttatgtctcaattttattcagttcattttttcacatctcagtttcattaattaagttccaatattggttatttcttgtcttctgctacttttgcagttggtttgctattgtttttccagttcatctaggtgtgatgttacatttaagatatttctaactttttatgtgatgttacatttaagatatttctaactttttatgtgagcatttagtgctaaaaactttcctcttaacattgctttagctatatcccagagattctggtaggttgtatctttgttctcattattttcaaatagtttcctaatttctgacttaatttcattgtttacaagaagtcattcaggagtaggttgcttaattttcatgtaattgtatggttttgaatgatcttcttagtattgatttctatttttattgccctgtgatctgacagtttggttggtatgatttcagtttttttaaatctgctgagaattgttttatggccaattgcatggttgattttagactatatgccatgtgcaaatgtgaaacatgatgttctgttggttttgggtggaaagttctgtagatatctattaggtccatttggtcaagtgtcaagcttaggtaccgaatatctttgttagttttctgcctcaatgaagtctcccattattactatgtggttatctagatccctccatagatctctaagaactcattttgtgaatctgggtgctctactgttagatgcaaatatatttaggatagttaactcctgttgaattgaaccttttatcattatgtaatgcccttctttgtcatttttgatcattgttggtttaaaggctgttttgtctgaaagaaggataacaactcctgcttttcttgttttctgtttgcttcacagatctttctccatcccttactttgaggctatgggtgtcactgcatgtgagatgtgtccttgaagactgcatacagttgggtcttgcttctttatccaacttgccattctgtgccttttaattggggaatttagcccatttatattcaaggttaatactgatatgtacaaatttgatcctctcattgtgtttttggtgggatattatgcatacatgattgtgtagttgctatatagtatatttacatctgtttttgtggtggccagcaaaagactttcatttccatatttagcactcctttaaggacttctttttttattattatactttaagttctagggtacatgtacaccacgtgcaggttagttacatatctatacctgtgccatgttggtttgctgcacccattaactcatcatttacattaggtatttctcttaatgctatcccttccccatccccccaccccatgacagaccctgatgtgtgatgttccccgccctgtgtccaagtgttctcattgttcaattcctacctatgagtgagaacatgcggtgtttggttttctgtccttgcgatggtttgctcagaatgatggtttccagcttcatccacgtcactacaaaggacatgaactcattattttttatggcatagtattccatggtgtatatgtgccacaatttcttaatccagtctatcattgttggacatttgggttggttccatgtctttgctattgtgaatagtgccacagtaaacatacatgtgcagtgtctttatagtagcatgatttataatcctttgggtatatacccagtaatgggatggctgggtcaaatgatatttctagttctagatccttgaggaatcaccacactgtcttccacaatggttgaactagtttacactcccaccaacagtgtaaaagtgttcttatttctccacatcctctccagcacctgttgtttcctgactttttaatgattgcccttctaagtggtgtgagatggtatctcattgtggttttgatttgcatttctctgatgactagtgatgatgagcattttttcatgtgtctgttggttgcataaacgtcttcttttgaaaagtgtctgttcatgtcctttgcccactttttgatggggctgtttgtttttcttgtaaatttgtttaagttctttgtagattctggatattagccctttgtcagatgggtagattgcaaaaatttcctcccattctgtaggttgcctgttcactctgatggtagtttcttttgctgtgcagaagctctttagtttaattagatcccatttgtctattttggcttttgttgccattgctttttgtgttttagtcatgaagttaaggacttcttttaaggcaggtctggtggtaacaaattcccttagtatttgtttgtttgcaagggatcttatttctcttttgcttatgatgcttagtttggctggatatgagttattggttggattttcttttctttaagaatactgaaatgggcccccaatcttttctggcttggagggtttcttctgaaaggtctgctgttagcctgataggtttccctttgtgggtgacctgctccttctctctagctgcctttaatgttttttctttcatgtcaactttggagaatatgatgactatgtgtcttgggaaaggtcatcttgtatagtatctcacaggggttctctgaattccctgaattttaatgttggcctttctcacaagtttggggaaacttttgtggatgatatcctcaaatatgatttctaagttgctcattttctctctgtttcaggaatgccagcgagtcatagatgtggtctctttacataatcccatatttctcagaggttttgttcattatttttattatttttcctgtaattttatctgactgagttaattaggaaaaccagtctttgagctttgagattctcttcacagattggtctattctgctgttaatactttcaactatattatgaaattcttgcagcgagtttttcagctctatcagatcagtttggttctttcttaaaatggctgttttatcttttggatcctgtattgttttgttgtattccttagagtttttggattcagtttctactttcttttgaatctcaatgatcttcattcctatccatattctgaattctacgcctgttatttcagctatttcagcctggttaagaaccatttctggaaaactacttcagtcgttttgaggtaagagggcactggttttttgagttatcagagtttgtgcactcgttctttctcatctgtgtgagctgatgatcatttagtctttgatgttgctgatggggtttttgcttttatcttctttgatactctttgaggtttgattgtggtataaggttggttcaattgactggcttcaattctgaaagatttcagggggccaaggctcagttcagcactcttgggctacatgctctaactctgaggaactggtacagggcccttggctttgttatctggcctcttgaggtaaggaacctgctgcgcaggaagggccaatgtgttcttagtccactggccacactctgatgggggggtgccagccaaagtgcttcactggggcaatggcaacaggatccatactcattcacatgtgccaacagctgcattggtgcattggggtgcacatgcgtcagttggggtggggtgccagcaaaaacctctgccttcgttttcacagatagaacatactggcaaaatattttggtgttgtattttgggctgtggtccagtagatggcgcttaagagtgttagcagatagactcttggcggcatggctctttgtgctctgtggtagcaggggagagagatgacaccctcacctaatctgctcctgggtcttggaagagccccctccaatcactggctttatgcctgcatttcttttcttgggtgttctggtccagagaggtccctcaggcagggaccacgtttggcagacaggtaatatacttgcccagctggcccttcggagggaggtacaccccatgcctccactggcctgtggcatctcatctctctcagtgatccaagagtgagggctccttcctgcttgggcaccacccaagccagcaagtctcacttggcgatgagcagcaggagtgggtggagcccacctaatctgctatccaagtacttcctggggaacatgggattgtgcttgcctgccgagttcaggtagaagcagtctgctgggctgtaagctctagcaggcatggcccacctggctaccagtggcaggagtgagtggggttgcccgcccttctgtccaggtgattttcaggacaacagaagatcactccccttggactcaagagttgcccctgtaaaacttctgggtggctctgtgcctcagtttagaagtgtgggggatggagcgggcatggaggagagccaggggattttttcattcccagtcttgcacaggaccccacggggctctcactcacttgccttttcccattttggagaggttcttctggcctctgcactcagcccagacaggctggtgcccagcttcactcctctctgctctctatgtctccctgctgccttgatggatcccaatgtggttttttaggtgatcagcttgtagggtcagtgttcactagtcagtgaaaatgacacacgtgaactgcttctagtctgccatactgacccaaactccccaacttccacatttttatagactgaaaggcttctcatcatttcatctttctgattatttacattttctagccagttgcataggtgaatataatattcctgctgaaaatagcttgagagttaagatcagtggccgggcacggtggctcacacctgtaatctcagcactttggaaggccgaggtgggtggatcacgagggtcaggagctcgagaccagcctggccaacatggtgaaaccctgtctctactaaatacaaaaattagttgggcgtggtggcggatgcctgtaatcccagctactcaggaagctgaagcaggagaatcgtttgaacctgagaggcaggggttgcagtgagccaagactgcaccattgcactccagcctggccaacagagccagactctgaaaaaaaaaaaaaaaatcagtgtgggtccaaatctcaagtctgcccctttccatttaagtaaccctaggcaagtgtttaacccacttcaccatcagtttccatatctttaaaataagaatcacacttacttcatagcatgaaagtgagaatgacactctatgtcaaatgcctaatacaagttggccctcaatatttacactattttttttactgtgaacataacatgtactgggagaatatatttgagcagcattttggaaggaatactaaaatgagtaaaattaattcttataaatgcttcagaagtataaagtcagctacaagaaaactagaccatttttggccattcactcaaaaaatattaattggtgtctactatgtgccaggcattgttctaggagctggtggtgtagtggtagccaaaatgaacaagtctgctggttacatatatcttacctctaatgagaggaaaaagacaagaaacacataagaacctgagcaaataaaataatcttataggaataagagagctacgaagaaaatgaaacagggtcagtgggatgcagagtggtggaatatgccagggaggttcagcacaaggggaatgctgatttagagaagctgaaagggaaatcttctctggtataacatgtgagctgagacatgaaagaggagaatagcctacaataaacacaaatacataaggtaagagagttctatgcaaaagaaacaggccctattatgaaacaagcctggtgtaatcgagagagagaagaaaggtcagtgtgcgtggagcacagtgaatgtgagggagcccaggatgagaggaattcagaaaaacagacaggaaccagattatgtggggtctggtgggccatggagaggaatttggattctattctgatttcagggagcagccattggatatctttggcaagggaataataaggtctgatttaggttttcttaaaattatactggctgtcgtatggagaatggactgtagaaaaataatggaaggtgagagtccaggcaggtggctactgaattagacccaacaagtgatagcggtggtaataaagatggtgagaagttaacgggcttgagacatattgaaaatgtagctaaaggaacttgctcatagatggtatgtgggaagcactaggaaagaatagaatcaaggatacctcctaggattttggcctgacagcagtgtgttcctccagttggggagccctagagaagagactgtactgcagtagttgtgagacatgcactgtggacaaacactaagtttgcatcccctcttcatcacctgatcctctgtatcaattttctttttggtaaaattagaatcatatagcagcacttattactcagatgtgccttacggattaaattaataaacacgtgtaaagtacttaaaacagtacctggtgttagttattattaacgggatggggagggtgggagcaagaattctcttctacagttgctacatctatggtgccttttagatgtccaagtagagatgtgcaggcaatagggtattcgagtctagagttcagagagatgttgggaggaaagatataaatcaggaactcaatagcatattgatagtatttaaattcctgccactggataaaatcatctgggaaaagacagtagagaagagagtaaaagaggatcatccctggggtatgtcaccatgaaggtcatggccacatatacttagatttcacagaaatgatttgagagtctaaatgaattctttatttcactctttatttttagggaacatcctattcctaaattaattcacgaaagtctcatttgaagttctggatcacaaactgccctccattttacatttcacccatatgttctcccatcagattataggtccctcatggtgatgttatgtgccatatttttttaatgtccttcactcttcctagcacagagtaatacacataggctccctcaataaatgtctgctggaataattatttaaagaaattatgatgaataatctgtgttttccatggcaccatatgaaggactagctactgaggacatgaattattttgctctaaggaagaagataaactgaactcattttattagggagaaaatgtgaaccctgtggaaaaccaaagatgaatctaggcttataaataaacttatcttcctaaaacctgtctttttctactgcacaaggaaggggtgtaaagtgaaaagataatgaggctttagacttaggcaaacttgcgctcaaatctcccatctatataagttgtgaagccagaacaatttacttatgcatgtgaatccatctcatctttaaaataggaatgataataatacctacctcatggagtttgaaaaggtctaaatgagttttgtgatgtgaacagggtcaggtgatgcatgcacatgcaatgtgtggcattatagaagaagaaccctaaagttcgagaacccatatcttttatggcataaattggatactcacatattagtttccttatctctcctaaaaaatacactatatttttatgcaaggtttttgcacttatgaattcattatgctcaggacatagctcacaattatgtgcatataaaactcagtttattttttaaatgatgcatacaatgcaagtgattgtgtgtgtgtgcgagagagagatctgttgatacaaaagtacattgcagtataaaaaatgtacttagttttacatacataaatttacttctttcttaatgaaaatatgtgtgacaagatccttcatatgtaacaggagggatttcttacactgtagtaatttgctgcttttaaacagacttagcagcatccagaggcaaaggctgttatggtctcattatttcctgccccccagaggatgaactgtgctaattaagtacatttaaagggaaaaaatgcctctttgctgtgtccccattatgctactgtctctttacttcctgatgcttgttacaatttattagctgtgaattatacctgccagtaaattaacccttctttctccactcaatttgtcagataaaaaagttgcataaagttaaaagccagccagttggattcctgagaatatagatatggaacaatttcctgcagcattgagcctcagaagaatttaacagctttggtgaatctagtaccaatgctcattttcaagccaggagcaaacacataaatcatgttcagcacaatgtacctgcctttagaaagctgtttacagccatgtatatttattagttttccatgatttcaagcagtatgttttctttaccctctccttttccttgcaagcacacacacaaattcctatcacaaagtctctctggtacgtcacaaaacacagcctttgggggtgattatttttcccgagtatttttacatcctcgtgccaatgcttcagatagtaccctaaattaactgtatcttttgctgtccgtggatacttacaagtttccttttgccacttgtcaagagcagtgaagagtcttgagatttcacttgcaaactaacaagtcaccctgacatagtttcatggttgctggcagaaggtgcaacactcttagatcaaagagaaaaggactttattactcacagcattagcgttagccagagtagcagcatgtactccaagttctaattcctacagggtgatgtgaagagtgccagatgatacctgcacatacagtgggttgcattataggagatgaactctaagcttagggaaaccaaatattttataatggacagtaagcctgagtgacctttgccacagaagtaaatattgtctttttatgctgcaaaataaacaaaattgttctttactacaaagaaagacactatctctatcttccaaggctgtttttacagatgtcctcaaaacaacagtacagagcaaaggcactaagtgtctctgcccacaagatatgcataaatgtaagagtactgtattagtctgtcctcgcattgctatgaagaactacctcagactgggtagtttataaagaaaagaggcttaattgactcaccgttccatgggctgtacaggaagcatggctggggaggcctcagggagcttctaattatggcagaaggcaaaggggaagtaggcacatcttacatggccagagaaggagtaagagagaggtaagggagaggtgctacagttttaaacaactagatctcatgagaactcacccacaatcaccagaacagcaagcaggaaatcaaccccacatgattcagtcacctcccaccaggaccttcctccaacactgggaattataatttgacatgagatttgggcggggacacaaatccaaaccatatcaagtaccatgaattattttaaaacaccactgatgctttttcttcatgaatgtgtattacaatttaatagtgttttcaatacatgagtttttacagttaatatggacttagtaacttgaatacataatcccaaaatcaagtcttcttgcaaagaataccctaaaatcctttcttaaactaaatggaaattcaatttttagtaaatgtacttaatcgatgtgtaactcaatttcctcaccagtataatgaaataaatataatacttaattcgatttattattgagtagattaaatgagatagtccatgtagaatgcttaacacagagcctggtattcattaagtgttcatttctccataaatgttaattttaattagaattaattgtcagtaccctttgatgagaggtacttaaaatacccccttcactaaaccaccaccattgagcccacttccaaatgtaccttgggagtgctggtttgccttttgttggtatagaggcattcatcaggaaagggtagagatacaagaaagtaatattcttgaagacttattatgtgtttttagttgactatgtgacctagtgctttcatgtattatttcattccttcttaacagcattctcataaagaatgcattattttttagatgagtggaccgagattcagacattactgaaggtcacaccatttgtaatggaaaagcaggagtcaaaccctgtctcactctagtctgactctgtgcctttacaatttttaaccattcagtcttattttcctgaacaatctttctatcttttgggactaactatgcctttgtgacagaaaatcctctctactctgtagactccattgccaatgagaacaataggttcacagtggaaagagagattatgcctccacctgtattcttctaaaaatgatatccatctcttcatttttgaccttttttgaggaaatgacaagatgtaattcagaggatacaaagtagtagatatgtagcatgaacaagtctaaagatctgatgtaccacatgagaactacagctaataaaattgtactgtatttcggattcctgctaaatgagtaggttttagctactcttgctataaaaacaaaaaaaaaataggtaactatgtgagatgatggatatgttatttgcttcactatagtaatcattttactatctatatgtatcccataacatcattttgtttatcttaattatacatgataaaattgatttttaaaaaaatagtatccacgatgtgttaggcccaagcaacttatggcccaaatgcccctttttgtaccaaagcctatttctggatccataggctcagtcaacatgtttttctcactctttttgaaagtacctgattcctagtttagtgtttctgaaatctctctcaggaactttaatgacagtgtgacatctttgagaaatgcaagcatgacctctgttctgtcatatgttggttttacaagggacattacattaaacagaaaatatgaagtgataataagcctgcaataataacaaaatcctcattcaggaaagtgaaagaacttgtgttttacttttagagatagactcttactattacactaacacaaacaaataaaggttaaaaacatgcctttttaacttagttccataggaattttgtttcttaccaactctgcacgaaagccaattaaacattatttaaaaacaactggaatgggccaagcgcggtggctcacgcctgtaatcccagcactttgggaggccgaggtgggtggatcatgaggtcacgagatcgagaccatcctggctaacatggtgaaaccccgtctctactaaaaatacaaaaacaaaattagccgggcatggtggcaggcacctgtagtcccaggtactccggaggctgaggcagggaattgcttgaacccaggaggcagaggttgcagtgagctgagatcacgctattgcactccagcctgggcgacagagcgagactccgtaaaaacaacaacaacaacaacaacaactggaatgaaaaccaatatagggaaataatcttaacattagaatcaagtatgcggaattaagttttgtatctcctaaaatctttattgacagtagcagaccatatcaaaagtcttctgaaatgcttctagcgctctcaaaaatgctccacatcaagaaacttttaaaataaaataaaataaatgcctagtggaagagttcagacaacagtcccaaaactgcctgaagacattcagaattcctctataatctttatacagatattaagagaaaaaaagtactaatagaaattgttctggtttgtaattgcaagtataatcacacagttcctgaaaataatagattgatgttataatattgggcaagccaatcaatgaacacaatatgcagaatgataagtggtgaaaaaaatgctgcaaccttttgttgataacactgctgaatccaaactccaacccttgttcaagttgaacactctcgtttcattgttgggtaacaacaatgaatattgttgggtaacaattttatatatgcttctctttgggttaggtagtggcttgttgttgttatttgttttttgcttgctttgccctctttaaaatttttagaggaaaaaaacataacagatacataacatggtctcatgagaaaaccagaacacaaagccatgaaatgaagaatttcattctgtcaacctgtttagctttccctgggagttcaatcatcgtatgggcttttatgtgttccgctgagcatttactgagaacatcagccattatgggctgctgcctagctacatggtcatgtcgttacttcgcatttatctggaatcctctattctctcaacagacatttttattctgttccatatgactaccattgtgagaaagctttgttattttacttgaatgaggcagtgagtaggtctttattttttcaggaacatactcctcccctgtagctgtacctgaaaattaggtgactttctcatagctttttcaaacccataaatcttctgtccctttcacgcaatgtacttacttatatttcaattttagcatcttgcaatcaagtctgattcctagaccttgtttaaactttgggctgtttttaatttatgaatcgttttggaaatttttctttgcattgagttataaaatgtagactaaaactctagcaatgtagtaaaatcttttcaaagtttgtctttcatttattgatctgatccagatcctcttgtgtgcatcaccctagaaaccttcaatttaatccattttttttcagtacccctaacatcttaaaacttagtcattcagacaccacccacccgccctctgacaccttcttcctgattgaaagaggcatttatgtatatgagtcacctcctgccagcttcacaggaattacataaaagcaatctgccaaccatcttggcctaaggacaaaaaatcacatttagtgtcaaagtaaaagtcattcttgcttgttggaaaatcacaatagagcactttaggaccttaactcgcaggacatcaggccttaatctacagtctatactacaaatgagggaactcataaatgctatgctttcatcggtttgggtaagcttcttggcctaataatcctaaaaccattttaaatgctttttgtagttgaaaatgaaaggctaattcatattcaggaaagattatacatatattaaggggagaatgtggactaagaaataaacataatattagcaaaacacattatctttccatgctaatacaaaaatattcatgcagaaagttatttaaaaagcaccgcttatggcaggaaaggtggttttatggtctaagaaaaatgaattgaaagatttgcctagataaattgttataactagaaatattggtcaggatatttttagtttttttttgtttctagacaagacagcttagaccatatggaaatatgggtttaaatcttccatttaacctcttatttactgtgtgggtttaaggaaatctcttaacatgtctgagctttggtttccttaaatgtaaagtggtgaaatcgtgcatgccttctctctcttgagttgttttaaagatcacatagatgatatgtaaaaggacaatgtaacttttatgtttgtgtaattgcttataattctcaaaaagcttttacatatcatctcatttgagttggctactgtttttgcaagatcactacgaaggcagggaaagtcttaactctttctagctgataaaaagaatcctggaagatcccctgtattccatatcctttcccttcccatcagcacttccacctatacattcacagattcagggaacctgaaaggaagtcccattgtgtttctcagacacacatttctctcagctgtgaatatctctaatcagttccagattatcctaggaatttgagcctggcacaaatcatcactgtctactagaattgaaattttggctgccaacctagagcttctcccatgtccatacttgacatgtatgattgggcagggggagagaggatgagaatgtgtgtctctaaaatgcatcataagtcaaaccttgcatacaaggttttctctctctgttacaaaggacagcacacagaaaattaaagtacacacttaaggccagtacagacttatgacacttctcccaaggagagacagttccaagctcagaagtctagattttagtgcatgggaggttgaccttaccagttcttgaatgggataggtttctccatgtagaagctgtggaatgtagttagattcaattggagactatctctcataacaaggaaactcaccatatgagggatgttagaggagagttataacgttgtatcatttttttctttctttggtttcaatttccacctttattcagatgaagctgaaaataagtggaacagttggcaataaaaccttagccactaacttgaattttttgtgaaatgccagtcaagtaacaggaatgacagacatgtaagtaagccccagtagtatccatttttaaaaatatgtactgtgaataaaaataatagcaattagagaactttaaatcatattttaaaggataccgtcttaaaataatcactattcagaatttgatgaaagtaaaattttagggttatcttcagttactcatgttcaaataattttctgtgactaaaactttggtcaaaatagaaaatgtgttttttcctaggatgatctaaaggtatttattgtggatggaaagaattacagaatacaaataatatgaaactcaaaattacatcaaccaaatgcactttgttttctcagctgactcaaaataatgagtagccaaggtaatatcggctgcacattataccttctcacagtaccaggatacctgaagaaacaacacttcactcctagtctagtcagcacctttgcaatttttcttggaatgacgttagctgttacataacccatagtagcaagcttgtgaaacaaagaaaccgcaatttagttcggggtaactctaaaatgtttgtgttcaaattaccaataagactcgttttcatgaagggtctttctaaaatacactttctaagccagtgtgcgtattttcatccatattttcaaacagaaaaattaagaacaagacggatagtaactttcttgacagttatgccttggttgagaagtttaggtattaactcacagcttccatgtctagaccgttgctggctctctgatagttaattgcctctattatgatattatcattagagtccccttaagatagacaaaagaaaattgtaggtttctaggtctactcaattaaagcaattgagtttcatagtttcaggaaatgaccaatttaactcctatctggaatttgtgatattggaaacatttgtggaaaaggaacacattctaaagtattttgaaagtttcttaaccagtttttctctaaatcattgttctatagtaaacacagacatggataaaatgaattcctaaagatataaatttggaattttaaattaagatataatttatttggtaacaaaataagtggatttttaaatcctctcttccttagtaatagaacatctattatgttctccatggtatgcagacagtaatgtagaacttaaggggtttatatagttacctagacaattttatcatttactacatttttttgaagttatctttgtaaagaaaaaaaactttttccattaaggaatacatgttatcctggacttctggtgtcactaaaaggtcattgatttacatctgaactgggtcactgaaagcaaacgactatgtggtggcctaaataggtaaaatcgtggcatctttcccagtttaagagtcatctgaccaattataactcaaaatttaaatcaaacctacaagttattattagaagaaatactgagattggtctgaggctacaacataaacaaatgtgatctcagatattggttaattatttcaaagactaaaacattgaagtttatgttttatgcttcacctgtgtatatttgaatgccccacaccaattatacataagatctggagtgtattcccaacatcttcccaaatgaaagacctatgaaaaagtattttataaaaggtgacatatttagagtgagaagggctttatgtaaggaggaacacattattcatcctgagcagatgaaaagtaagacataaactttgagaacaaggtgaaagcagaggtgataactataaaagaatatcttgtcaaagaagaagcccatgtcaagcttactccatcatggagataaatgtcagccctgcttttgctcaaagagcacacctaagaggaaaagccacaaagggttagagtgccaatagaaaaagaccacctgccacttaccacaaatgaataaaacaaatatatatccatagtccatggggcaaccatagcaaaggaccatctgatcctcacgacattgtcttaaagcattccttacatccccattaggaataagaagccgttaaaaccacctatacctacacctatataactagcacattcctgctgacagagcttggaaggcattgagcagttctgcatttgatcctacttttttcacaaagaggtgaatatcaaatattttaaacagcaaactaaagtttcagagcaaatataatttaaaatttggttctgctttgggaaatctgtttaggaggcatttgtaaacagttgaaaggctcattctaaactggaatggattgccccatcctatcaatgcccctgagatgaatatgaagtcagcaatgggagttttttaattctatgataattggctgggagttctttgacctttaattaaacaaaatatgaattaatgaactttctttctatttacagcagaggcttgaaatggtacaagttgggataacaatcaaaacaagatgctattttttcactaacaaataaatacaaaacatgatgctgaaatctgcatactgatattgatctaattatttattttgaacctgtaatttttcatctttcttcactcgaaggaagaaaaaacatcaggaaaaaaaggagctatttcttcttggatatatatgtcacacataagcaattttcaaatgtctcatgagctggtctcagtattaaaagaggcttctttagtctagcagaatttcagacaaaaattctagagcctttataacatagaagagttttatgaaagggtctgattggatgagatgtaaagagataaaatatgtacatagttacaattatattttacaaattaaacaaaaaactttttttcttgttttgcttttttggttttatgccttaactggtgaacatttaaaaatatgctgttagatgagatcgtgccactgccctccagcctaggtgacagagagagactccatctcaaaaaaaaaacaaaaatgctgttagaatatggacacaaagaagagagcagtagatatagataccagatatagatacttgagggtgaagagtgggagtagcgtgaggatgaaaaactacctattgggtaccatgctcattacctggatgatgaaataatttgtaccccatagccccacagcacacaatttacccatgtacaaacctacacatgtatcccctggacctaaaataaaagttggaaaaaaaaatttagggatcattagcagatcattgcaaaatctgctaggattttgcagataaaccataagatccctcgaaaatatttttctttgtagaaaccatgtgagtctatacagcagggtctcaggagtatgagggataggcagtaatatgttcatcctcctgtttagtgagagaagcttccctgcaacagtttgagaaattgagcatggcagtttcgaaggtatcttccagctctaaatccttctttgtgataatcatgagtaatgtgatgcatccttactctgaccccaagcagaggattctctactcaggttctggtggccaaacctctcctgctttcactcactgagggaatggaagagtatttctatgaaggaactcctgggacctctaccctttcctgttacagtagcaatatgtttgtgccccactatcaccaccacatctactgaactagagcccatatagacctaatattagtgcccaaagtattgttgtgtattttttatatttgtattataattgacttcattttataatctctactatattttttctttttcttaatcacttatatgcaatgtctatcatatttattgttatacatacttatgatgactttaaatcctttttatagaattgggatacagcattaaaattttattgtaatgattatgtttccagctatgaggcgttaaatattatgtagtccaaaacttacaactctgtgaggtaggtattttcttatttatttatttatttgtttatttatttatttatttattatattttaagttctagggtacatgtgtacaatgtgcaggtttgtcacatatgtatacatgtgccatgttggtgtgctgcacccattaactcgtcatttacattaggtatatctcctaatgctatccctaaggtaggtattttcattgttttttttttttagaacaaggaaactaagattcgggaaaggcacttgccaaggggaaaagttactcagtgtccttagagctaggattcaagcccaggaaacttccctctaaaaaccatactactaattacctttctcaagaaccttccaattagaatattgtcagaaagtcacaataagttattttggtacttgattaggcatgaaatctttgtcagatagcaggccgtttctgattctgattcctcaagtcagctggccttttctctttccttcttgagtcattatctttttgctttttctactgtcccttcactgaccctccaaacttccagtccaccttctctggaaatatctttccacaattttagttcattttttggccccagaaatgtacctcagcttcaggtctaaactactctaaacttcaggtcagaagcattaattaatttgtttattcattcaataaatatttatgagtgcctactacatagcactgggcaaactgtagtgaagggaacacacatgctccctgttctcatgtttcttatgttcaataggaatagataacactaaacaagtaagtatatagcataacgtatcagacactggcaggtgttgtggagaaaataatgcagggcaaaggaaatagagaagtctgagcctcagaaaatagagaagtgttgttacatttataaggatgtccaggaaaagcctgtctgataaggtaatatttgagcagagacataaaagaaatgtgaatttaaaagtgatgctctgaggaagagacttaggggcagagaaaaagaacagcatgagtaaaggcccagaaacaggaataatcttgtgtttccctaacaatgagaagggctgtgcgctggaactgagtgagaatgaatggattcctaaaattgcttgactcatctataattcattcaagaatggcatttgacttctaagatagccatttttcagaaaatttattttagattatattaattttttatacatatgtttatcgcttcacagaataaaaaaggcttttcccagatattatctccttttctcctcaaaacatgctgtcactggatcatgggtctaatttgatttgattatcccagcaactgacacaagacatgatgcatagtaagcactcaataaatgtatatggaattaattagttgatgtattaattctgcggcacaatttctaatttttcacctttaccatgttcattattattgaacatcagtgatgggactataattcagtgaagcttcagaagctataaagatttatctagccatttgcctgtaccctaacttatatatgtatctaatttttgtgctgatttacactttttctgcctaactcttccattaagttctttaacatctttcttcgcaatcagtttatgtatattcctaacttatcgtatctaatctgctatattcttggaaaccagatcacaggcctgttagacctatatgtatgtaaaataaagtgacttttaagtgagagcatgaaaccctttcttaaagaataaatttgccttagttcatttgtactgctacaacaaaatgccacagactgggtaatttataaataatagaaatttagttctgggagctggaaattccaaggtcaaggcaccagcaggttcagtgtctagtaagggttaagtgtctctgcttccaaaatggaaccttgttgctgcatcctccagaggggacaaacactgtattttcacatggcagaagggatgggaagaagcaagcccacttcctcaagcctttttataaggtcattgatcccaatcacgagagctccactgtcatgatttaatcacctcctgaaggcctcacttcttaatactaccacactggcaattaagtttcaacatatgtattgtggggaacacattcagaccatagcaaaattcactaactttactacttgcttcctaacagctgttctgatctcataggcattttgcttattttcgcatctgcaatgtaattctagtggattaaagttgttaggcacagtatacaattgtgcctttcccccaacttgcatccaaagaaaattataacgcatttcatcccatcaaacttataatctatggtataatctaaagccacattaagaggttattcatcacaccaaactgatctcatttaccagaagtagccacagcttacaggtttgtctgagcccttctttttcctcactgaagcaagggttcccaaccaatattgattatctacccacttggtgcaacatgattgtaaatgtgccccttgttttggggtacacttaatgtgtcctttccatagaagtcattatctctatttaccctttagttaccctatacaaattttcagtcaaatattattctttcctcttctgactaagaattttttggcattaccagtaattaatttattctttaattctttcagcaagactctattgggagcctactacatgccaagcactgctctgggcactgcagatttagcattgtagaggcagaggttacctttattctgttagctaaatgaatagctctaagggtaagagctaaatagatggctataaataaaggtacaccaatagtaatagcgataaattctatgaaaaaataaagcagagaatccaggtatagcgtgataggctgagcatttatttaaaagagggtggtcacaaaaaatatataagcatgtgaagtgatggacatgttaattagcttaatttcaccatttcacaagtacatttattaaaacatcaccttgtacactataaatacatgcaatttttatttgtcaattataccttaacagagctgggtgaaattttaaaaaaaagaaaaaagagtggtcaaggaaagcctcaccaaagaggttatgtgtaagtggagacctgaaagagtaaggaagtaaaccacatgagtatttggggagagcatatccttaagaggaaacagaaagactaaaaccttgaggtgtgaacaaacttgatatgttctaggagtagcataaaggcaagtatgtctagagcatagtgagtaggaaaggaaatgatacaatataaggcctaaggcaaggaccaagtaatgtaaggatttttgaacatcagttgtcactacttcccaacagttcattgtgtgtttgacttggtgctacttctggacagttttcttaaagtcagtgtaaagagcataggacatgtattgcaaataattttggtagggtaacttgcatgataccatattaataaaattcaggagaaaatatggagacaacagtactcacagttgtacattctgtttttttttttgtggttgttgatgcaggtgaaattcacttatgtaaaattaactattttaaagtaaacaattcagtagcattcagcatattcacagtattgtgccactacaacctctgtctaatccaaaacattttcatcaccccaaaaggaacccatcctcattaatcagttgcacccaattttccctacactggcaaccaccaatctactctctctatctatggctgtacatactctagatatttcttgtaaatagaagcatacaatatgtggccatatatgtctggcttctttcacttagcataatgtttttgaagttcatctatgttataacatgtatcagtacataatttgttttcatagttgaataatatttcattgtatgtacataggcaaatttgtttctccattcatccacagatggacatttcaattgtttctactttttagctatcgtgaatagtacaaccatgaacatgtatgtagaagtatttgtctgaacactgtgttttgttcttgtggtacatacctagaagaagaattgctagatcatatggtaattctatgtttaactttttgagtagtcaccaaaatgttttccaaaggggctgaaccacattacagtcccacagcactctgattcttaaactacctctatatacagatgctccttgaaatacactgggattatattctcatgtattgaatgcatgtcacttttacaccatcataaagctgaaaaatctttacttgaaccatcattaaatcagggcttgtctgttctctgcaagctcttgcttcctcataccttatcttccctagattggagctgtttatactgagttatcatactttgccaaaactgataacctgattagttggttctcccaaaccagctgaaatggactttaattagaaaaactaagaaaaataaaattaataaaaatataaagctaaactttagaagctaaaattctgttgcataatttctaacccaaactaccctagtcatgatatatataaaagatagacggatagacagataatcttctattgattctgtttcactagagaaccccaatacatactccattatggctagagtagatagatagatagatagatagatagatagatagatagatagatagatagacagttaggcagatgtattataaggaattggcttatgaggttatggaggctgagaagtctcaagatatgcaggcagcaagctggagatccagcagagctaagtgtgtagttcctgtccaggtttgaaaatctgagaaccaggagaactggtagtgtgcattccagtctaaaatctgacaggttcgatactcaagagtcaatgtttcagtttaaatctaaagataggaaaagatcaatgttccagctcaaggcagtcaggcagaaggagctccctcttacttgcaaaatagtcagtctttttgttctacttaagacttcatgtgattggatgagggccaccatctttagagaaggcaatctgctttactcagtctactaattgaatgttagtctcatccaaaacatcctcacagacacacccataataatgtttgaccaattatctgggcaccccatagctcattcaagttctcatgtaatgttaaccctcacagagtacttttgagccagcacaatttttaggacctcaactgaattcagatggcccttatataacccatgttgtctagagtatttcttattggagaatccacagtatctgttaattatgaggcttatgaaatcattgattagctgaattatttccttactgtgtaccagtaactgtaccaagaagtgaacactaaagatttcatactcaaaaggaaaaacaactcataaataaataaattagaaactaccttgaactatttgaaatcaaggaatagaacagtgattcttaacagtgtggtataatgtcccctatatcaaaatcacccagggtatgttgcctttgctcagaatgattgttctgaatctctgggttaggacccggaagtctacattttgttaagtttcccagataatctttatgtacatagaagtttgagaagcactgataggaaatgcttttattttagcaattttcaaaataatttgaaatcaaatgttttctaattactttttccaatttgaattatgttgaaattcttcaccaagagtcaaaacagtttatgaaaataaaatagtaaataagtgttctacaatggccattttcaaatctttatgagtttattgccttactagatcaatcaaaattcattcatgttcccattcaataaatacttactttcccttctgttcttgacatcacgctgggttttgggaatgcagcagtgaataggatagacattgctcatggagtttacagtccagctttaatctcacattttgtttttaacacataacacaaacctttttttggaagggggtgggttgctgaacatttaattactgtggtttttttttaagtatttagcattttcatgtcttgagcagaacagatgcgctacttaaggagtttcatacctctgcaactaaaaggaaatctatttgttctgcaataacagtaagtggattgagacacctcagtcccctcatgtgaaatcttacagctctgcttccttttctgctttcctgttaaaagcaagtattttaaattaaggtattaaaattatgtttatagtaatatataaacatcccttttctgcacaattgaatgaatgagatttaactaatagtttcctagagatactatatagcaaaaaataatgaactatttttaacacttattttcttttaaaaagtacattagtattttgactaatcatgtcaaccataagctaaatagcatatgcataacaatttcaagtgaatacttcgtgatggtagcacttacttaatagttttctcttttccccactaacctgtcattatttgccaatttcagctcaagaactcctctgggaaaatcattcttcaccgctgtaatttagaggttatatataatgtatgctcaagaccagttaaagtatgtaacagaagtaactcaagattgctctataactcttttctctgctttcacacaaacctttgtccttactctgttattacaatagaaacaataaaatacataagcattcaggtgaagaatgaaaattcactaatgtcatttagaaaaaataccaagaagggtttatatgaaggatataaagccctgtgaagttactataatacagctacttggattatcttcctgtttagtgctgattaactccaaaagtgttacggctcaatttaaaaatatagtttaaaattttaggcatatgcctgatgttttcatgtgagtaacagaaagtaatggaacatggaattttctgacaggacaataaggaccttttaaagttggcagaattacaaaggatttcattcacaaagctaaaactcaacttctgtgtattaggaaaggatttaagaccatatatccatttctcatttgatcttcatacaaaacctgggagttacatattgttattcttgttttccaagggggaactgtgatttggaaaggttcagtaacttgtccaagcctcgtattattactgcatagtaatcaagtagcagagccagagtcctaagtcactcggatttcaatctgctgctgttctgccatggtcatgtatgttggtgaggccaagcacaagaactgcgcattcagcagatggtggccttggcctaaggcaatttaacaagagcgaagataatctctaagactcctcactgtacttagcaaattcctaggtgaaagctcatagaaaacacagtccagcctttggtctttaagactattttaatctggcaggacaaatacagtttctacatttttatatgtagacttcacatttagaatatgggcaactgagagctgagtgattgttttgccattaggagtgttaattaagttagataatgcagtgctatgtctatagatttcttgtcaagggagtttaaatactgttgcaaaaactgactgggtattatgcttcccactagcttacctatctttcctgcattctttcttatttccctgctgaatgtcaattgtgtaggtaggtcaaatagtaaagttgatcctggccttattatttattttcctctaagggtatctttcctctaattgttcctgaggccctactctaatattaacctaattaactgttttcagcatatttcaatgtttttcttgtctaagcacaagtcttgtatagtctttccagttctaaacctggtcagagagagactaaggtggtcattggagcacttcatggtgctccagtgtcctgcagtccaactctgcagattgtacagtgagtaagtgttctttaatctggatgccagtgggtaaacattactagtttggctggtgtggtggctcatcttatgtgtgaacgtaactaagctaagggatgcccatatagctgctacaacatgatttgaggtgtgtccgtgggagtgtttctggaagagataagcttttgaattggtgagctaagtaaagcagatggccctccccaatgtagggggcatcatccaatttactgagggattgaatagaactaagaggtggaggaagggcaaattcactctctctgcttgagctgaggcatccatctttatctgcctcagacataggcgctcctggcttcaggctttcaaactgccacttataccatcacccaccaccaccaccaatttctcaggccttcagatgcaaactgaattatatcaccagctttcttagttctccagcttgcctccacaaccacatgagccaaatcctgtaataaatggcctcctatatctatatccatatctatttcctatcgtcctgtctctggaaaatcctaaataatatagctgactattcactgaccaatctagtcttcccattcccctcatacctttaggctttgaaaactaaaagtgacagttaaatattgaaagtggaaaaaagagcatccttgtcttcgtttctggaagattatgtcaccacagttctgtatgccagtgataagagggttcatgttgtattcttgttgtttccatggacaacagaagcagtgagctttgaaatccaaaatccttgttaagtcacctctttagctcttaaatagctttgtgaccaagggaaagccacttaaactatgtaaatcatgtctaccacttctgaaatgggaataataatctctagtatactaagtatatctgatgcctggaggaggtatgagtgcgtgtacacgcgtgtgtgtagatagacacataggcataggagcttatcatttgctgcttaattgatttcatttactctagcaaatatagacatttatatttctaaatagtatatgattgactataaaatattaactctaaaagtactgtgctcaaacaaaaatatttttatctgctaaaataggccaaaatataatctaagaagcataaataagaaacaaaaaaattatcaagacattccaccaagaatgccacacgtgtcatcaatactaacataaatcttcatgtaaaacttctttgcaattacttttaatttcaatttctgcctcttcatctatttgatttattctgctaacaaaagttagagaaaattcaaaggctatcattttgctcagttctcagaactcagattctttaaattagttcttttttgtcttcaactagatattttaatgcctgcaaactttcttagctttacagaatgaagacttgaaaaaaaaaaaaaaactaagttagtggggtagcatacagattaaaatttggaaagataattttgaaatttttgtgttaaattgtatttgaaatgcaattatcatataattaagttgcacattatgttcccttctaacactctgattagcattttcaactgttttgtttgctaaagcataaacaattattttctgctgcagaaatggttgcttcattgctgtagccatgagtggcttaatgatggaggtgtgttctaaaaaatgtgttgttagccaattttgttgttgtgtaaacatcacagagtatacttacacaaacctagatggtataccctactacacacctaggaccaccaaaatatacatgctacattgttgactgaaacatcattatgagattcataactacataagtatgtgttgatacacagagcagtatttatattagtcaaaaaagtaaacaacttaaatgtacaacaataggataaaatgggtaaataaattatagtatactcatttgatgcaatattctgcattcattacaaaatttggttttggaagattaatgtgataggagaaagcccatgatatactgtcaaatgaaaattcaaaactctgtatttttaatcctgattggtatagctttaatttttattttatggcactaatttacctatataactatatgcctgcaaatattattatatatgtttatttattgagaaaaaatggaaagaaaacacatcataatactttattagtgattttaattatttttaattagaaaaaatgttattttaaaaataataattgatacatggaattgtaaattaccttcctatatatagtacagtattttggaaaaactaaaaacaaaagtcccatttttcaataatcaagccacttttgaaggtagacatctatgttcttagggttcctggattggcatttgaggagaccactaaattgtgcctcttcagacaatcgtgattccttacctcctccatgaccacagtactctatcagatgggttttgcttgcccagaatacatgtggttttctgtctgtggtcgtggagcactgacttaatttattataattagaattttagatatgatcacaccattttagacatgttgcatatacagaataaagtataattttatatcatttttatattttgttcatagtaatgagtagactacttcagtttaaaatagaataatgctgaataaaatcattctagtaatgaagggtttagtgaaaaggatatgacctaagaatattgctgggtacttaagctttttacaagggttaggccagtaacaaatatatttttaaaaggtgggaataatggatgaatgtataataatgttctcataaacatctgcaaaatctggtttacaaaaacaacataaaagatgacaaatatcactgtttatcttaagtatataaaatatcatctagaaataattttcccctctttaccatatataggcataattagtatctgccatctgtttcaatgtatcttttatgtgtttagtgtttatttctagaatatcaaataaataggtaaaatggaaattcaaatctgcaaattcagggctaatttagtaacttaaatcattgtattctagttgactaagaggttagttcgcaggaactttatttagcttctaaggcctaagaagaagacaggtttcttatatatagtttttcttatcaagttttgtaaatgtacattaaaaatgcaatcaaggatcacaaagcaaagttcgaattccaattaagtttgaacaaaaagaaaggcaaaaagaaggttcattttaccaaattgtaagacttaaagcactgaacacaaaaaaaatatgttcaaatagatttcgaatctatattttaaccactgaaagaagaaaaataagagactgaaatgaagtgagtaaaatggaaaaagaagaaagatatgatctaagtggaaggaaagataggaagggtgggctagaatgttcaactggggaacaacagaattgagagaggaagaaggggagaagaaagaaagggaagatattataattgtcagcattatatatatatatttatacacaaaatgtgtgtgtattataattgtcagcagtacaaatatacagacacttgtatatgtatactatatatcttacacctaggtatatccttcctcacaccagggtccagcatctgacctagaagtcccatttgtaacttcatcatgtccagctggctggattcctcctcccccatccaaaccgtgccccaccttgtaaggacctaacctgtccctgatgacattgctgtcagttcattcttttgctcccatagttaggtgtagagatccaccaacaggcctgtcttctatttctgagtgtcatcaggacgcacatattacatggttcagctgtgcacaccaaaaagcttgcttatgttaagagagtagtgataccaaaagaattagatagctaaatttcaaaaacttaccattggctagatgagtctaaatttgaacccagaagttctctacctctgcttttaaaatcaggaagaatctcttgcattcagataaagcatacaatcatggggtagtcaatgaataaaaaactctatctgcttatgatccaaaaaagttgggaccataaacatgatgaggcagaccttccagatgtcagctttataattaagaaaataagatttagttgtgggcccaactgtattaaggaaagggagaaagaagataaggtgtgatagagtagaaggaatgcctaatttggatctatatccgtaagctaggataccactaatttcatctatgaaagatcatttacaaatctaacagcattactttctgcctagttgaagtgaacactcaactaccgtgtgtgtgtatgtgtatgtgagagagagacagagacagagaaggagacagagagagggaatataagaatcagacttaaagattgagaaagaaaaaagaagaaagaaaagtacattaaatactcagcatggtaaatattttataggatataacaattaaaactctgattcaaaatagctttacttatcagaagtaggatattttattagtctgttttttaatgaaagggcaaattagagatctactttactatgatatctcattttgaacaacaatcattatcttttgggaatctcagattttgattttgaaaaccaaagacttgtctgagaaataatctgtttctttcaacatacgttcttgcatagcttcactaaaaatgagtgcccttcttttggcaattggtgatctatatgcctgaagggtaaattggatatattttatgtactagatcgtagttcttttgatacctacagaataaactcttttcatttaacttcctttttccaactgacactttttgctgatttattgcaagctaaaggataaataaatgtatgtgtttcatgtaaactcaaaagtatctctctagttttaaagtgataaagaaactattttccaccatttaattctcacatgtataaggaactggttttatcctctgaatgcaaaaaggatatatcttttggaaactttttaatgccattctttacctgatacattttttaaattatgtatttcaggccctgcttgatactcagaatcttttgcgtgcacaaatcacaaattttacattcaacctgggattttcagggaaattttaccatacaggtaagaaaaagggattaactgttctcattaaggcttctctgatcactctatttaaaattgcacacttttcctgcccacactgtcctacattccctatgttcctccccagcattttatcattcaattctatttaacatgctattttttaatttttgtaaaatattaatggtttgaaagtttatggaactatctgatggcctttcatttttattgaattataatttacatatatagaagtacataaatagtaaatgtgatattcagtgaattttcaacgtgtacacagctgtgtaaagaacaggcagatcaagaaagagaacacttccaaaatctccacttcttgtgcccctcacaataactaacttctctcaaagaaaagtagtatcctgacttctaatatcatgaattagttttgcttggctttgagtggtatgtaaaaggaatcatatagtaaagattcatctgtatccagctcattttgtacaatgttatttttgtttcagagatattactgtctataggttataattctttccttttctttgctgtacagtattccattgtctgaacatacaaaatttacttgtctattccattcagctgtagatggttgggtgtttccagactttgagtttttctgaatagaaatgttcataacttcctgttacgaacatttttatacctgtccttcagaggacttgagtattcttttctgttaatcatcaactaggaatggaattgctagttatgtggcacacttataattaattttagtagaaaatgtcagtttttcaaaatggttgtacctgtttatattcccaacagtatgagtgttcctgttgctctgtatgcttgccagtatttgatattgtttgtctttttaattttagcttttctggtgaacatgtagagatatcatattagggttttaatgtacatttctctgaagagcagtaaatgatctttgttcgtatgttggctggctatttggatatcctctcttgaggagtatctgggttttctgcttttacttaatgatttgtagaaattctttccttgaagtttacagttccatgtgttccaagtactttctcctgctgtctggctgtctcttaattttccttatggcgtttttaatgaacaaaaatacttaattttaggccgttcaatttatcatttttttctttaatggtcattcttttctatcttatttaagaaatctttgcatactacaagaacatgaattttttttctttttgagacaggatcttgctctgttgcccaggatagagtgcagtggtgcaaacacaactcactgcagcctcaacctcctaggcttaagaaatcctcccacctcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccttttagtgctttgttaaacacttttcatgtactttttcactgaatcctagaagttaaagaacgtgttaacttgttttctagataagaacatagaaacttaaaggggcccaaggtcacatagcttgtgaagtgtcaaaaaatagtcttaactcatccttgactagggaagctgaatggcaaaagattctccttatttatagatttgttagctttttatgtttccccaaatcactgagatccagtagtacctgtacattctaattatattatagaataaattaacaatgagaagagcaatgttatattgaatgaataaatgctgatcttatttctagactcaacgtttggccagtgaatgatagttaagggccctgaatttggagttgctcaatctgagttagaactcagaatttcaattcaggctctgtctcaaacctctcagtgagatggaacaagttacttcacctctccaaatgtcaattcccttatctgtaaaatgaagttagcagcagcactcacctcatgaggttgttttgagaataaagtgaaatgatgtttgtaaagtactcaacacagtgcttgacataacaacacaacataaactctcaatcaatgatgattttaaatataatatcagaatagcaaatactacagataaaatagtgtagagaagttatttaaataaatatattaaaaaataaattatagtttgcaataacttcataagatttcagcatagttttgtgataagttaagaaatggcacttaacactgtagaaaagagtttggaaatttctcaaagaacttaaaacagaactaatattcaacccagcaatgccattattggatattatcatatatccaaagaaagaaaatcattataccaaaaagacacatgtactcacatgttcactacagcactattcacactagcaaagacatggaataaacctaggtgtccatcaatggtggattggatgaaaaaaatctgatacatatactccatggaatactacacagccattaaaaaaggaatgaaatcatgtcctttgcagcaacatggatgcagctggaggccattatcctaagtaaatcaatgcaagagcagaaaaccaaataccacatgttctcatttataagtgagaactaaacatcgagtactcatagtcatagagatggcaacagtagacactggggactaatggcagagagggcaggagaagagtaaaggttgaaaaactacctgttgtgtactatgctcactatctgagtgataggatctttcatatcccaaacctcagcatcatgcaatatgcccaggtaacaaacctgcatgtccccccgaatctaaaataaaagttgaaaataaaataaaatacatataatctgcatcttcccagaaaaaggaaatggcacttaaaattgaggaatttgacttcttgttcttctctcttcctccagttctgacaaaggtgggcaaagtagggaagcaaagagtgggcaagaggccacgacagtccaaccaaatgtaattaacccatagttaattacacttcaactaatttttaatcatgatttttttttttttttgagatggagtctcgctctgtcgcccaggctggagtgtagcgacgccatcttagctcactgcaagctctgcctcccgggttaacgccattctcctgcctcagcctcctgagtagctgggactacaggtgcccgccaccatgcctggcaaaattttttttgtatttttagtagagatgggatttcaccatcccatctgaactgagataaatatgtcagaaggcagatatcatttgtctaactcttgcatgattcaaatatatgaatattttagtcacagatttcaccatgatattcaggaaaggacaacaaatgcctgagctatctttttagccaggatggtcttgatctcctgacctcttgatctgcccgcctcagcctcccaaagtgctgggattacaggcatgagccaccatgtccggcccataatttttaaagtaataagcaacagacatttgttttcaatgtaattctaatgtaaaacattctcaaagtaggattaaaagaaatcagataagacaaatctataaagagaagacataaaattgtgcctaatatgaactgagataaatatgtcagaaggcagatatcatttgtctaactcttgcatgattcaaatatatgaatattttagtcacagatttcaccatgatattcaggaaaggacaacaaatgcctgagctatcttttcaaagaaccctgagatctgctgctctgttctgataaataatatttgagcagaggccaactaaaaaaacatgaataaagggaagatgacaggaaagctgcaaggaaagataagaattataggcaacagggaatagagcttaaaagcagtgggagaggagacttctcataaactagggaatatcagctcactgacattgcagggtatgtggaaatcaggaatgaattgatttctgggaaactccaagagactctgcctgctctcaatgtgagaaaataaaatggcaacaaataactgacactaatacagtgtcctggagactacaaaatgttaagcaacaggggagtatcttggttagaagcagagatgtttaaatgcagggaaactaaatgacatcattcttatgtcaagcaaaacatgtgtttaagatcaccagtcacacctacaaaatgcttctttacaaaggtcaccttatttttcacctcgaatttagaaggacccaagaacctgctatggttgggatcatcagagtttctaaacccctgaatccatcttcctatttttcttgcctttctcactatgaagcttccctgagccataagataaccactcagaagcgccaagaatgctggtgactcattcattaatcaggccaatgagttaatataatgatttggtcagttcttgaacataatgtcacctctgccacatagcacctgtgaaaactaccttctcctttcatgtagtattataatgaggaaaaaaaaactcaaggagccatgcaaggaaacgcaagaagaacagaagtaggaaatacaggaggaaaagaaaggggtattataagttacccaatattgccagaattatgtatacactacctccccccaaaaataaaataggtactgctgtccatctctttacctacatgaatacagacattaaagaggtcatgtgacttggccacacaactcaaatatgttggaacctaaaaataaactaaaaccttctgactccaaaggctacacttgttctactatacaatggtaacataagtgtatatgaagaagaaaaaaataaagaaaataaaacattagatttaaatatgtaatctttgtacgtagtggagaggaagttccttcatatcagtagagtacttaagcatgtgaaagtgaaactgaagactgcccttgttgaatgattatgctattccactcactctatagcacttaatctttgtttcttctgtatacatttgaatgaccatgaaatctcatagtatgcctttatctctagtaaaggttttcaatgcccaccaaatcacaggacctgattcttttcctgccaataggctctgcctcccttctttgggaaactgaatgaacaatgttaacaggaactgggtttagttgactggtccagggtagcagtccattctccatctttagcctgtagggctctaataaaacaaatcacatcagagctgccattgaaaatatgggaggagatttttctccacacaaaaaggacatcataggaagaacccactactcagggagcttattggattcaatgttgtggctaaaattcaagtgtggctgcataattttgaaatgactagtattatgatattccaggacagtagtgagcaccttatactgctcttattttatgctatagtaaagaagatatgcctagggaagtacaaaaaggactcttagccccttcaaataaggtaaaagaacagtgaaatttcccacagtcaactgaactgcaggccaaggaaaatgggaggaaataaaatgagttcaagtatgaaaccaccaagaaacaacaacagggctgacccttaaggaaaaaagagtttcgtgatgcaaaatcttcttccaacaacttgagagaaaggacaagcatatggaacacaagtgtaccaccaaggagcagcttggattgttttgatagtggtgaccatgatttcaccacttcacaacttctgtccatcaccttcatccttcagttttccctaattttctcaacaacgatttccacatttccttcttttctctttcttatgtgtcagttttcaccaaatactgagtaacttcttcccagacctaaggaggaacccgaataaaagaattattttgttgtatacacagcccatgtcacaatgacctactactactgaggctgtgacacatattccttgctcatatttcctaaattacatttcctacttatcccccattctctccagactataaactgcacaaaaatgctgaaagttaagagttctaatatccttgggaatggttatatatttccatcttgcagtgatttcatatccatgtctcatgtttaataacatttaagagttttacatggtctctgattatttcctgattaacagattttccttgatacatttgggtttaaagccttatacgtaaaacagaataaatgatggcttctaaatacatatacgagaaaagattaaatagataagtagattgattgatcatagatcagtgtaactggaattaattggataatatttcccccccctaaaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagtaagtaactcactttgttgcattgaagtagtgtacactgattggagaaatgaaaagattcttacattgtggcatagttgcgcttttcagtggcttttccatatgatcatttggaatattttggtattgccgcctttcagtatgtggctcttgagtttgtattgagtgctcaccactatgcttaatgttttgaaggatctaatttgagagggacctcacaaaatacaagatttattatgacattatggtcagagcacctaagacatggctcctgtccagaaggagtttcctgctgcactgagaaggcagaaatatgcatgttaaacaattccccaacaaaatgaaatactttttcaagacctaatgacaaaccttacagccacaaaacccacagttcaaagaaataagtatcactgggagtagcccaagatggattcttctggaaataagattttagatacgtcctgaaataagaataaatcttcgggatcaggattaattgaaatgaaatgaggctgagggaaaatagcaggtaggagaccataatgactgtatgaggtaataaagactcaatctaaacagttaaaagcattgcaaacatatatgctgtatggatggaacatttgtttggctgaagcaaggtacaccatgtaatactgaagggtttatattcaggacagggaaatttatagtaaaagtttaaataagcacattatgaagaaaaatgtgcttgtgatcagagagagtaccgaggtacacttacatggaatggttttctacaccaactgttagaactaagaagtttcagttggttctcacagtaccttactcaaatatatacaagacaaggttagaatgtatacactatattttttttcttgaggatatacaagaccaaatactttatggtggcatcaggggcccatatttgtcttttagcttcaatctactcccccaaataaacaaacagcttcaggtgcacctttgccacatattgatattttgtcaagaaagcaagaatagtgctcctccatgctgatactgtgaaaatgttttgatggtatatgcaaactgctgtgagaaggagagtcatcttttttcctaaaaaaataaacaaataataagcagcatgtaaaattggtaaaacggccccagaatttgtaatagaaagtgctaaaactcatatctcaaaacagcagacattaattctgtcattttcagaaatctagactgttgatattgacaatgttaatcactaataaattatgtggggaaaaaattactttgtggtttacttctaaatctgttgagaaaaagagaaagggatttgtgagagacgaaaatacgtaaatacactaaagtaaagcaccagtaaaagataagatactgagaagtgaggagtgaaattgttgttgttgttgttgctgttttgacagctttccaaaaataatgtaccaaagcagctttgataaaagacatgtcattcactgttacatctgctgaaaactagaatagtatctagaaattacttgaacgaatcaatgaatgccaatattatgtttatgtttaaaacatttgcagatatttggaagtacatatcctaagaatatacttaggctgggtgcagtggctcatgcctgtaatcccagcactttgggaggccgaggtgggcggatcacgaggtcaggagatcgagaccatcctggctaacatggtgaaaccctgtctctactaaaaaatacaaacaattagccaggtgtggtggcgggcgcctgtagtcccagctactcaggaagctgaggcaggagaatggtatgaacccaggaggtggagcttgcagtgagctgagattgcaccactgcactccagcctgggcgacacagccagactccctctcaaaaaaagaaaaaaaaaaaagaatatacttaatacatatgctagaacaggcatgcacaggagttacatgcattttttagaattcccaactaaaaagtatcatgtgtaaaagaataattcaaaaacaatatctggtcattcttaaccacctaagtgttaagcaaagcagatttcttagaagcgtcattcctaactacatgttggcaattcaaattattgtttttgaagcagaagagagtagttgtaatagatcttcagaaataagaccaaatatattatttagtgtttaatcaaatccaggacaagtagaatttattttgttgcaagaggatagatatgaaaaaagactgaatccagaaccagtccctccccagccataacaatatgaaagagcacatataaataaggcatttgggaacagcaattagcatataacactcaatagatggcagctgctgtttttatcattatatctagtatcacaaaattgccatctttaatttttgcccaggctcctgaggtgtttggactgacaggtaagagggacaaaaatccttaagtttaaaagtttactttgtattgggatggcatttgtttaatgtgaattttacccaatttctaaatatgtgttaactcttttactttccattaagcattagggttacaaaactgcattgttgctgactttaaagatataataagaaaagatcaagggtttccaattttaacatatttttattatttcttttaattctcaaattaacccggaattgtaggtctatttattttcccattatagatgaagcaactgagaatcagagaaatgcagtgacttattcatgattataaaactcactagcagtataattaagaccagaaatcttaatgctgcataaattgcagtgttaggtcttctaatgtggcataaagtgtgccccctgccgaggcttcctccctagcctcccaacccaattcacaggtgtgaatcaagatttcttttctgctggtaatccaagggaatatctggttatgctggtaatataaaggaaatggagaacttgaggtggaactcacagggcaacttttccctcggattccctgaagttccctaatataggcagagtctctaaaatgttggagggggtcgaaggggtaggggagacaaaaaactaaatctgaggaaatttccacttgaccaaatatcacttctcatgtgtagttacagaatccactttaattcaatgaaaagtactctggagaaaattctacttcaactcactagatggaacaaagcaaatgtttaacctgtgctaatatggcatttctaaattggattatatcctgctcttctccaccagcttggaggctcttgattttaaaatgagtgttggtatttcccaatgaagaaagtgaaaaaacatgcaaagaagcagtgggctgtcttgggagcaaataggtgttcaaacaagaatggaggtcatggatgcaatattcaaatgggtaattgtgttagaggacatttaaagtacccttccagctaagagaatttccgagactgtgatctaaaacttttgggtttcggcctttgctatcatcatttacagccacatacctgctattttcattgagttttaacaaatacatcttatctattatccttttgcacaatgtggacacatctgactcacaaacaaatttgatgtctattttaatttgtctttgaaagctctaacagtttattatgaaaggtcaagtaaatcctttaagcaaacttgcatttgatgattacacccatcaggaaatgcagctttagaggttgaatggaaaaaatttttagttaccaaatataggataattcaggggttaaactgcaatttcaacaggggatttttttttggaaaggtacaaattctgagacaaggattaaatgtatcattaataatgacctaccacaaaatttaaaatatcaactgtacagtgtgtaaaatagaataacatatcattagaaaggtaaaatagtattctatttaaacctcaaaaaagtcttcaatagtatatactctcaattgaagaactgtatctaaattttggaaaatggtggtggttaaatttttaatgataaaatagttaatagatatttctatcatagaactctgccaatatcagatgatacttaatgcttttatagacaatactattaaaagtagtagtagtagaacaatgttcctgataacataaaatcttactgaagattgaacttctaattgtatcatcatcattcttttaaatggtgtcctttttgcctctcttttccaagtgcagcagaacctgttaatttacattagctggaatgtctattgtcaattataaaactttttagattagtgagcatgttaacttttccaatatggaaataaagattatagtatcaaaatgtaatttaaaatatattgaaagacttgctggcttaaggaatatatgacaatcttttaattagtttgcttgccagctagagaatgaatgaatactaccacttttatttcagtgatgcactttataaaaaggcatatgagattttccttttattgacattgaacacaaagtataattctaggtgtcctaatagagaattccagtcgggttgcaaagagtccactcagctggtaggccactttagagtaattcaagcagcacagtttagaaagacattggccattgttcagagcaaaatgaccaatatgatgaagtctataatttacttcataaaatgaatagctgaaggaaattcaagaaggcaagaggtaaaagagaagactaagggatatattatcagggctactattcaactaagagtactggtatggccatgccagttattacaatattgaaatgtgacaatactttacccctatcctgctaccacatcagattcttccccaaggtgtcccaaatctcccccattactcaggaactaaaggggcctggcccagaaagagtctccagcaccgatctccagctgtccagctggcagcagttctgattggtcagtggcatggcatgctggttggtagatatttttcgttatcattccagaagataatcagtcagtcttaagatttagaagagactagaatcagtatatttataaggaaaagtatggaagtcatatagatttaagaagtagagttcttccaatctagataagttatgtatagagaatggtgcttgacatctagtaggtagtaaatgtttgctaaataaaaataaaagtaaacgtttcttctagctcttaagattctatcattactgtattaaaatgtaggttttattattatacaggtatgatgagtccagtagatcaggagatgactgccattgaaaagatcagtttgttattcccagttaccaagagagggagtgtgccacaaggatgcagggccacaggggaagcaccagggtcgctcaggaggcagagggagcaggggggaaaggtgggcaagagcctttactgtggtttctgcgggaaaggtaaggcaagacagggtaagcaggctcaggattggcgactttgaataatttcagtatgctctgaggtgtaagagctgtctttagtcatctaatacttggatctggggtgattagatcaaagagatagttgctcaacatatgagagtctgataaaggaagcagaggagggtaggagctctgaattgcttgatttacatttgagagtgctctcagggtggtgtttgctatctcttggaattgactagcctgagaacagcaatctctccagagtcagcaaggcccagatatcaaagcatcagaaatacagaaaataaagaggcatgatgctttctcccggttatgtatcttgaagcaattccacaggttttcaaagcccctcaccatcccagctgtcatattcatataatttctaatttgtcgttcttatatcccccaatctgaacattattgtccactgatgtggtgttatcaaagcagaaaatggtaaaatattttttctttcatgtgcactttacttctattaatgtagccaaagatcacattacatttttacaccatcatatcacacctgtgtctgcccgaccctctgtccatgagccatttattaaaccttcaagtatttatttttatccagttgatttttcaaactaaatgctagccttggaattacaattgtccctttaatattccatatttgttatatgttcagtgttttagtatatcaacctcctgctaaagactgactctgttatttaaaatgctttatatctttcctagctttgtgtaatccctatattttacaagtatgacttttgcatcttcaagttattagtattgttgaacatattaatatggttagagatttgtggtagagcaatacatatcctttagctgtgttcccttggtatatttctagcaattgtttcacatctattttttcaccagaatagtttaaaatctgtttttctaaattgaaacatcatatctaattatttttagaattatatattttaagtatcttgaactccaagataacactgtcatctactcctaagttctagcacctccacataggtggcagaatcacagaacattagagaaggagtgtttaggatgaagacaagcaggggaaaattggatgtaagtagacatactggattactaataaattaaccaaagaataggaaataaaatccagctttaactaaaccagtggaagcgggatcataaagaagtgagatgtgaaaagtatttctgacatagattcaataaggttttaatcagatggatgatgaggaagcataagagaataacaggtcaaaaataacattagggtttaagcctcccacttttctatctgtgtgtatctctttaaactttttgcaaaggtgaactgctgctttttctttagaagttctgtatttcacctacatgaggataccccctcttacccatatctacagtactgcaaaatgtattctcatttggatatatcatttgaacttttgaaagtggttttgattggaattcttttctttgtaaattcctgtccagattaccttcttttccatcctatgggaagactccatactctctaacaagatagacattgtagaaagaattcctcaattcctttccctttttcctctaacagaaatactagatttcatcttcaacacatttatctggtaacttaaacgatttcataaaaagaaagataaatttagcacatgtactgcatgaaaatagtgccttactgtccaaatttatgtggacacaaaatgaactaacagcctttatgaattctcctagaaactcatactagtgggctggagtcagatgtgggtatgagggtgggggaggtctatttccagatccattcctgctgctcccgaattttcactgctctttccttttacgcctttcatttacttaagatggagggggcacttgcattctgagaggtggttataaacatggcagagatggaagtgatggcagaagaagtaagagtcaatttcacatgagtgctaaccttggctccgctttggcatttttgtgtctcccactccatgttcccatgcatttaacaatttctttcagttttttttttcttttgtaccagctcctgctccttttcaaaattttccatctctacttcacttccaaattttcagcccacacctagattattgcagcagcctccaaaccagcctccaaactagtctccccaatttcccgtttttttcctttaatttttgctcagatcaggaaacgtgaaacttgaaattctgtgactctgtttccgctgcatgaaacagaaccttacggttcagtgagaaagattcttgactctcttaaggaaatgtaggaagataaattgttgagctccaaaatatttactagacattgcgcttagggctttccatacatcctcggttaattctcccaaccacctgtgaggttgcttattctcgtattgaaaatgaagaaagcaaggcttagagagcttatataaattttccagtgaaagctggagaaagggtttcatcccaggtctgtctaattccaaagcccatgtaacaaccatggtttgtaaaattaacaagtagccatgccattgatactgttattgctgttacacagatctcataatcaaaatgttattacttctttaaggaattatatttttacacaaattcagaatacaatctgactttttacaatgtttttctcctaaagagctgtctataggatttatgtagtttcttgtgtttgcgatctcagtgctgcaagcattactgtcctggtggcttttataaataccagagagtatacggtggttataacaaaaatcaatatcaactttttatgctttcagaaatattaaacttcacttaaaattagtactatgtagacttcaagattcctaatcaaccttgcatattttcagggagattaaatgtgtgtgcaagtactctgagaatttgaggctgtcctggattatttatagctttcttacctctcaaagaccccaaaggtccacataaacttcaaactctgagaaagctgaattaaaccaaactttcaattcctccattatgaatccagataattttattttcagttattttgctacagcataaaaagtaaggcttcatacattcattttttttacatttctataaaccttttcttgtgtttacttgaatacaccccagcaattcaaaaataccaacctgggctgtgcaaagtacaagtgtttacatgattcttttgagtattctcacaaaagcgcatcctttagtgctatgtttacttatgagacactcaacaaagatatgacaacacttcaaaaattctggagggaactctaagacaggaaaacaacatgctcagttaaatgaaaatgtacttgaaataaatgttataattgttagggaagactgggagaaaatcactctcccccaaatatttcttttcttaaaggttacaagtgaaaatgaaaattaaagccaagtatgctaccttttatagccctttttcagtattggtactacatttttagcttaacttttgttactggaatttcttactacgtttggcttacaaaatgtcattccatttcttgaaataatttagctgctaacttgggataatacttaaagaggaatatgtggtgttaagaaggggtttttgcttatgttatttctacagctctatcaaatttatggtacaccagaggtattccttccctcccactttatatgtaatatctaatatgtataatagaagaaatgtatattgtttagtaagactttgtttttagacatgattgataatgacaatgtatcttctttgaggaatgtctgctctgaaataagcactctgaattgtttgagaatggaagtaatggtgagaggagtcttagtttaccttggtttttttgttttgcttgtttttgtttcccccaaataaagaatactgttaactaaataaaagaaaatgaaatggcatttgaccaataactttgtttatatccttcatgctggacaactctgtgagatcattagttttattacccttacttggcaaatgagggaattgaggcacggtgaatttgcataacctgctagggtcctgggaccaatgaagagaagcactgagattgagccggggactcaaatctgtgttctcctaaatctgtattctcttcatgatagtatcctactctctatccctaggattcctggtacaaggaaaatttcattgtcatgggtttggctattttgagatattgaaagaataagactcttttcttactgtatactaaattaaacaccatacactcatctcttttccggagatgagtaactccagagtgataaggtgacacttctgttttataagttgctataatgccattcagttttacaagatctcattattaacacctttaacacttttatccaaagacttttgttacttttattttatagccatattttttgctatcttgtgagacaaagaatatctccttcctcaggtttctggatccataggaatatcactacccagagagactcacctaaacctcaagttccagatttttttatgagggtttcattatatgggcatgtttgattgtattattggccacatgattgaactcaatttccaactcctctcgcctaccctaagatcaggctgatatcaccttgctcaaagctctcattctctaattacatggtgggacttcctggcatgactaaccttcatcctgagtcatcttgttagcataaactcaaatataatttcagggtctcaccataaataacaaagacatttctatcactcaggaaattccacagagttaggagttatctcccaggaatcagggataaggaagaccagacaaattctttattaatacaacagctgccaacaggggatgattcttgaacccttaaaacaaatctactaaaaacaacattgtcatcacagaaatttttttcacataccacccagcaaaccaaaatttatattataaatcaaggagcaccatgtaagaaaactagagaaatagttagtggtcaaatctataaatattaaccaaatttatgtaactgtgtctatcatattttaggagattattccatccttaagtatgtagaaagaaaattgtatatgggagtttaagtttgttcatggattaaaaatagtacattcgtatttagcatctgaatataaaatcatttctaaaaccacaaagattatgtcaaagaaacacagaattataaacctggactttagtgactacttgtacaacccctttattttataattttttagaaaatgaaaaatcagattcctgtgcttaaggtaattaattctttcaagatttttcatttcaaaccataccagaaatattatcatttatcacaggaacatagtctaatatttaataatctttgcatgtagtaccaaatctaaattccctaatctaatgatcctgacttgccttattttgttgtaggctaagaagacagtcagcttcctttgaatagcaactttacatatattgggccactctgccaacatccataccatttcttactttcttccagtgattgcggctactacaggactccttccgcaggtgccagaggttccacaggttcttataagctgaattgtggtgtagcccatcagtgtcaccttaggaaaacaaatcgtcattagaagcttgaaaatgcttcacaaattcaaataattatataattttgactataatcatcctgttgtgctatcaaatagtacatattattcatgctttctaattatattttgtgctcattaatcatgcccacctcccctgcaacatctactatcctacccagtttctggtagccatccttcgactctctatctccacgtgttcaattgtttcgagttttatataccacaaataagtgagaacatgtgatgtttgtctttctgtgtcttggttatttcacttaacataatgacctccacttccatctatattgttgcaggtaactgaatcccattcttttttatggctgaatagtacaccactgtgtactattatactgtgtgtatgtatgtgtatatatatatatatatacacctcataatatacctcactttctttatctattcatctgttaatatacactggttgcttccaaatcctggctattgtaaacagtgctgcaacgaacatgagagtgcagatatctctttgatacactgatttcctttcttttgggtatatactcagcagtgggattgctggatcatatggtagttctaattttagtttttcgagaaacctccaaactgttctccatagtggttgtactaatttacatccccaccaacagcgtataacggttttcttttctctacatctctccagcatttgttgttgcctgtctttttggagaaaagccattttaactggggtgagatgacatctcattatagttttgatttgcatttctctgatgatcagtgatgttgagcaccttttcatatgcctgtttgccatttgtatgtattcttttgagaaatgtctattcaagccctttgtccattagttattcagattacgagattttttactatagagttgtttgagtttcttatatattctggttattaatctcttgtcagatggggagtttgcaaatattttctcccattctgtgggttgtctcttcactttgttgaatgttttgtttgctgtgtagaagcattttaactcgatgtgatcccatctgtccattttttgttggtttcctgtgcttgtggggtattacccaagacatttttgccaagaccaatgtcttggagagtttcccccatgttttcttatagtagtttcatagtttgaggtcttatgtttaagtctttaatatattggtttgatttttgtatatggtgatagacaggggttcagcttaatttttctgcatatggaaatctagtttttcaagcaccatttgttgaagagattgtcctttctccaatgtatgttcttggcacctttgtcaaaaatgagttcactgtaggtgtattaatttgttgctgggttctttgttctattccattggtctatgtatctgcctatatgccagtagcatgctgttttggttaccataactccttagtataacgtgaaatcaggtaatgtgattcttccaattttgttctttttgttcaggatagctttggctattctggatcttctgtggttccatataaatttttggattatattgtatattttgtgaaaaatatcattggcattttgataaagatttcattgaatctgtagattgctttgtttagtatggacattttaacaatattgattcttctcatccatgaacatagaatatctttttatttttttggtgtactctttaatgtctttcatcagtgttttatagttttcattgtagagatctttcactttttggttaattcctaggtagttaattttatttgtggctactataaatgagattacattttgacttgttttttacattgttcaccattggcatatagaaatgctactggcttttgtatgttgatcttgtatcttgaattttactgaatttgtttatcagttctaatagttttttggtggagtctttaggtttttccaaatataagattatatcatttggaaacaaggataatttaactgtttcttttccagcttgaatgcccttcatttctttctcttttctgattgctctagctacgacttccagtgctatgttgaataacagtggtgacagtggnnnnnnnnnnnnnnnnnnnnattttattatggtgaggtatgtgccttctataccaagtttgttgagggttttttatcatgaagggatgttcaattttatcaaatgctttttcagcatgaattgaaatgattgtatgatttttgtccttcattctgttgatatgatgtatcatattgattgatttgtgtatattgaaccatcctcacatcccaaggacaagtctcacttggtcatgataaacgatctttttaatgtattgttggatttgcattgttagaattttattgagaatttttgcatcaggattcatcacagatgttggcctgtagttttctttttttgatgtgtctttatctggtttcggtatcaggataatactggcctcatagaatgagcttagaagtattccctcctcctctatattttggaatagtttcagtaggattgctgttagttcttctttaaatgtttggtagaaatcagcagtgtagccatcaagtcctaggtgtttctttactgggagacgttttattatgtcttcaatcttattacttattattggtcttttcaagttttggatttcttcatggttcaattttggtaggttgtatgtgccaaggaatttattcatttcctgtaaattttccaacttgttggcatatagttgctgatagtagccactactgatcctttgaatttcggcagtatcagttgtagtgtttcctttttcatatctgattttatttatttgggtcctcatccttttttttctttgttaatctggctaatggtttgctgattttgtttatcttagaaaaatcctttttgtttcattgacttttttgtattgttttcttcatttcaatttcgtttacttctgctttgatctttattatttcttttctcctattatttttgggttcagtttgcacttgcttttctagttctttaagatacattgttagattatttatttgaaggttttttcttttttgatgtaggcacttacagctataaactttcctcttactgctgtttttgctgtatcccataggttttggtatgttatgtttccattatcatttcttttccagaaagtttttcaatttccatcttaattttttcattgacccactgatcattcaagagcatattgtttaatttccattgagtttgtatagtttccaaaattcctcttgttgatttctagttttattccattgttgtcagagaagacgtttgatattgtttagatttgtgtaaatgttttaacacttgttttatgacctaacatatggtctatccttgaaaatgatccatgtgctgagaaaaagaatgtgtattctgtagcctttggttgaaatgttccataaatatatattagattcatttgttgtatagtgctgattaagtccaatattttttgttgagttcctgtctgggacatctgtccaatgttgaaagtggagtgttgaaatctccagctattattgtactggggtctatctctctctttagctctaataatatttttttatatagctgtgtgctccagagttgggtgcatatatattttaaattgttatatactattacggggttgactcctttatcattatatagtgaccttctttgtctcttctcacagtgtttgttttcaaatctattttgtttgatataaggataactactcctgttcattttttgtttcaattggcatggaatatcttttcacatccctttattttcagtctatgtgtatctttataagtgaagtgtgtttcttgtgggcaacagatcatagagtcttgtattttcatccatttggccactctgtgtcttttgatcagagagtttagttcacttatatttaatgtgattatttacgtgtagaaacttactcctgccacttcgttatttgttttctggttgttttggggtcgtctctcttttcttttcttccttcctgtcttcctttcagtgaagataattttctcttgtgctttaacttcttgcttgtttctgttgtgttttttgatttgaggctatcatgagactagtaaatactgtcttgtaactcattattttaaactgaagacaacttaacactgattgcataaacacagaaagaaaactctacactttaatttcatcaactcactttttaattttttgttgttccttatgtcttgttgtactgtttatatcttgaaaagtttttgtagttattacttttgattggttcatcatttagtctttctacttaagataagagaagtttacacaccaccattacaatgttatcatagtctgtgtttctctgtgtgcctactattaccagtgtaccagtatttttaccttcagacaatttcttcttgctcattaatatcattttctttcagattgaaaaactccctttagcatttcttataagacaggtctggtgttgatgaaattcctcagcttttgtttgtctgggaaagtctttatttctccttcatgcttgaagaatatttccaccagatatactattctagcataaaagttcttttccttcagcactttaaacatgtcttgccaccctctcctggcctgtcaggcttccactgaaaagtctgctttcagatgtattggaggtccattgaatgttatttgttacttttctcttgctgcatttaggattctgtctttgtctttgactcttgggagtttgattattagatgccttgagttagtcttctttgagttaatctgcttggtgctccataaccttcttgtactcgaatgttgatctctttctccaggtttgggaggttttctgttattcctttgaataaactttttacccttatctgtttctctacttcttctttaaaaccaatatctctgagatttgccctttggaggctattttctagatcttataggtgtgctatgttgttttggtttggtttggtttggtttggttttcttttgtctcttatgattgtgtattttcaaataggctgtcttcaagttcactgattctttcttctgcttgatcaattctgctattaagtgactctgatgcattcttcagtatgtcaattgcatttttcaactctagaatttctgcttgattctttctcattatttcaatctctttgtaaaattaatctgatagaattctgaattccttatctctgttaatcttgaatttctttgagtttcctcaaaatggccattttgaattctctgtctgaaaggtcacacatccttatttctccagtattggtctctgatgccttatttagttcatttggtgaggtcattttcctggatcatcttgatgcttgtagatgttcatctgtgtctgggcatagaatagttaggtatttactatagactttgcagtctgggcttgtttgtgcttgtccttgggaaggcttttcagatatttgaagctgcttggttcccaagcccaatatcactgtggtccttgcagactcgtagaggtaccatcttggtggtcttggagaagatctagaagaaggctctggattaataggcagagattcttgttcatttcccttagtttctcccaaacaaacagagtctctttctctgtgctgagctgcctggaactgggattatgatgatgcaaacacccctatggccactataactgggactgcactgggtcaggcctaaagactcagtcagcacagcactgagtcttgtccaaggcccactataactactacctggctaccacctatgttcactcaaggccctaggccactacaatcagcaggtggcaaagccagccaagtttgtgtccttcccttcagagcggcaagttcctccaggccccaggcaggtccagagatgctgtctgggagccaaggattagagtgaaaaacattagaaatttgcctaacattctgttctactatggctaagctagtactaaaaccatactataaagtacttcctgctcttccttcccctttccacagggagaagagcctctccctctgagcaccaccaccagcagcccttggcagggttctgtcaggccaccggcaattttcacttaagcccaagggttcttctgtcagcttgtggtgaatgctgcctggcctgggattcaccctctgcacagtgggttcccctctgacccacagaaggtccggaaatgctgttcaagagcctaggcctggactcagagaccccaagagcctgcttgttgctctaccccactgtggccaagctggtacataaggtgcaaaacaaagtcccctttacttttccctatgcttttctcaagcaggagtctttcaccatagtcaccactgctgggaatgtgctgggtcacacatgtagtaagtgcgtcccaagtgcccaaggctcacagcatactccctggctatcactgatggttattcagggtccgagggctctttaatcagcaggtgataaatccttccaagactggatctttctcttcaagacaatgggttcccttttgtcctagagtatgtcaagaaatattctctccaggagctagggcctggaatgggggcctcatgactgcctggtgccctctcctactgtagctgagctggtatccaagatgcaagacaacgtcctctttactctttgctctcctcgccttaaacagaaggaaggacgcactttcattgctgtgagttgcacttcctgggattgggggaggagtggcgcaagcaatcctttagctgctctggctagtgtctccctaggtcacatgccaccctagtccactggctctaatcccaatccagcactaggagttgcctaggaattgaagtccttgtgtgctagactgtctttcaagtttaccaaggaccttagagcatgttggcccatggtggcaagacttgacaagaaactcaagctctaactgatgacatgcataacttccccttggctaagtctggtccaaatgatccctccatgtgtgagcaaagcctgagcagagcatggatttgctctctgctatgacagggtagtactgagttcaatgtaaagtccccctgtcactgtgctctccctcccccacataaatagaccctccgcacttcatggccactgccgggagataggggaaaggtggcattggcgattcaagactgtctctccaaccctcctcaatgccattttcattaacttttatgaagataaaacgaggtactgcgattgcttacctgattttttgttcttctgatggtgcttttctgtatgcagatagttgttaaaatttggccttcctgcagggggtacaaatggtatacggttctattctgccattttgctctgccctcataatttttaactgcagtctaaaaattgctttcaagtattatttacatagatattaaaatttccctgatagttaccatatgtttattcttcagacgaacaggcagtgtaatgaagataattgagaaagtgaaaattggaatgagaaggaggtagtcagaatcagatcatactttttcactagtatttgttgagtacttgccattggcaagacactgagtatatcgcagtggataaaatggaacctaaatttcatgaagcttactgtttaatgaaaaagagagatattacataaatgtcttttctatgcaaaaaaatacatgcttacaaactgtgctgtgtactatgaaaaaccaaggaaagctactaagagaagttttaatgtcgacttcatttagattggcacttgtcagtaaagtcttctccaaagatatgacagaataaattaccttcagatttatccaggtgaagatttggagtagaaacatttcaggggaagaaaccacatataggaagatgctgaggtagaaaagtgcttggtgagtttcagggaaagtttcatgtgactaaaattcagtgaaggatggagggtggcgcaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgcgattctatgccaaaaggcaatgggataagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagagagagaatatctggtagggctgagatgtggaaatcatgagttcaactattaagactattaattccacttgtgatccaaatacttcatttacgttttatagttacatagccagattcctcagtgtttttgaaccatgtcctccactagaaaaatcttaacatagatttcagagttcctagatctaagatgctactttcaatcaaggatcaatgaaaagactaattagaattaacttttaaggtagactttttgccacagattaaaaaataatatgtgcttaatctcaaatcgaacaatccagaggagagtaatcagccaaaaatttagcatgatggctaaagcttttaaaacctgatagtctgccttccggatcacactacctgcaatcttaacccaaacttttctatacaataacgtttcaggtgttctctctggtgatgaatgcaaatttgggagcaaatttatgttgccttcttctaaaatgaatttaaaagcagccccctactaactgaatgactcacaagctggaactactcggcagtggctgagcatatttggaggaatcagaagagaagcaggcttaggaaggggtagtggggtagaagtcagagttcaccacaggagtctcatgagaaagaatcccaaaatctacagtgaaagtagaaaatacagtctgtctcttttagtggaaaataagtggcccagtagtttcataatttccacattatacttgagtggtaggatcatagcatctaaaaacaatagaggcagggtagtaatgacaacaataattttaaaaatccattaaatgcatatcatgtttccagaactatactatcttccaaaattacctctgaacccctttgaggtaatgcccttatgactagcattttagagaacaggaaacaaggcttagagctcataggtcatttgccaaaagccatgcagttggtgaatgagagcatgaacagccagatacgtctgattccagaagcgatgttttctgctactatgccacactgcaccagcacacaaataaaagatgaaactaaaaaacccatttagtcaggtgtgctggtgtgcatttgtagtcctaactactgcaggaggattgcttgagcccaggaggtcgaggatgcagtaagctatgatcaccaccactgtacaccagcctgggaaacagtgagatcccgtctcaataaattaactaattaattaaaaattgcagtagtttttagtgttaaagctaggaaaaaaaagtaaaaactgtatatacattggttgccaaatatttttaaatccaaaataagggaaatgtctctgctatgctgggccatcctttcatgccatgtgggttctgaagacacagctgactactcgccgttattgaaaactaccttgagcttttgaacagcataatttcttacaaatttgcagatgcttgaattttataacatagctcttgtcattgtgtatttcttcccacactcttcaaaaagttgttaacctcctcagcaccacataacatttccatgtaacaaacctgcacatgcacccctgtatctaaaagttgaaatttaaaataaaagaatactatttaacaaccaccagaaataataaagttacttcagcacattttttaaagttgttaacctataattcattttttaatgtttgtgatatgaattcatttttcttcatctggtctttatcaccatacccctagccttcaatcactttagttgagcacaaattatgtgttgataagggatgtctagtgggaaaaaattagtttagtttgagtttttaaaaaccagtacgaaaaaagcaatgagatatttcaattcaatttttagtggagttctaaatatgatggttatgtagttatggtaatttctgcaaatgatgcaaataaaatgaagaatatgaaactttacctctcacccttcagaaacacaggaatggtccactcaacctccaataccacccatcctctttctcacagtagcaagatagtggctcccgtttttggcatcctcaactacagctgacggaactgagttttgaacaataaacagagtttacgagataagaaaagggcattccaattgaggaagacagtgtgtacagtatacagcaatgacatgaaggaaatcatcagaaattggggcgatgagtgctgatagaagatgaggctatataggtaggttgggaccaaattttgagggccttttatgctgtatcaaggaatttgaacaagtatttaggtaatggcaaaccactggcaagctgttttctttctgcattcaggcacttcatatactttcttcccctcctgttcttatttaggtttaaaaacaaagctaaccatacctctaactttttccatatcagttggctgcatatttctgcaatttaaaccatttagcagcctgatactatgattctgtgtatgtgaaactgttatttggcatgaagacagtcattaatttaaaagaacctatttgagtggaatttttgaagattttttccaagcaattgaaaaatataaacagaaaaataaaaaataactttggagaaaaaaatacctgtcaactactgaagccatgggtgttctatttctaaaagacacgtttcattttgtattactgtgtaattttcctctatgcctttttttttttaactggagtcattttatgtacaagagcttgacttcaaatcaactaagttcccagaatatttggctgtttcagtaccttcaactttcactataagggcttctacttcaaaaaaaattactctgttgaattttaccacattatccaatcaaaagtgtgtgcttctcctaaggcagggaacgttgttactgctggcccacatgctgaaaggacaacagaaatgtggaaaacttggtagaaactgtagagcagacaaaataaaatcttaacagcagcctaatgaacttggaaggtgttctgttcctctaataaacattggttttattttgcgggaagtgcttagttttgtttgtaataagtgtctaacatttaacttgttgacgtatgggcaataggaaaacaggtggctacgacaaggatgtgcaaaatagaggctctttcaaattattcattaaaatcactagatctgtctcaccacccctcaaacacagatgcatcaacataaggactggtgaaatggctaacaggcttcatgacgtctagaggtgttaatacttatatcactttaattttaccacacaattaagtaatgatgcatttaaatatatatatttacagtacatttgaaaatcttactgtaaaaataggatcaagataaatctttacacgctccaattaacatttgcttggtcttaggagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggtgagcttcctccagtatgcatagggtacaactaattctgcaagatttcattcctcacttgaagaaagaaaaacacaaatgttagcagcataaatgtaggaaaagctccatgctgcaggaagcatatttgtcatatctaagcagaaaatgttttaattaaaatcacttcttttcaattcttcaaatataactgaaaaaggttttgttactgacattaccactggtaagcaggcactgatgttaaaatactaaaaaaaaattacatttaacttgcagataatttttagtagacatcacttcttcaaaatgttattcagtatgaaaaactaacaccaactctgtctatattaaccatgctgctctttgacaagccagtcaaactgtgttcttctatttaccatgccaggctaaaaaagaactcaaccatttgcagccagaagccacatgtgaagccctgcataatcattaacatataataatatagagtaaaaatgacaggtgatgctaattaaatcatttgcatacaccatctaattctatcctgggcttctctgttttgttttttacaatttcagcaaatgtatattgtcaaaatatgctactacctcccaaagtaagcaattaaatcctaatttattcccaaatcagaaaatcctaagaaagtcctggtaaagctaggaatgggcctcctaatttagaatcacacactgggaagaaacaccacagaagaacactatgtgatgagccaccgtaacactctgttgaactgatatgtctgaagagatgtctaccctttagaattaggttataactgacttcttttcagagagtttttcaatgtctgcaaaaattacagagtggatagacatatagcttagatcatctcccatcttgacttttccctcaataaaaactgttgtaaatgctagacggggacataatggccacattttatcccaatctgcccttcctctgtactgaaaatgaacctactgtggctcaagctgccagaattctgaccagagggagtttagaagacctgggatatattttttcatttctcctgaaaacacatttttatctgtattataaatgcatgaatcatgcaggtaatcaaggctctaacagatttcctgttttgatggaactgtccctgtggatctgcttttgcagcaatctgtggaaacctatatttggcttgtgggctcttggatgagagtttccaagtgggaaatgttcagcagacagttgattacacaataagcgagagaaaataagactaggagccatccaaatagagaagcaagtagagaccacaggagccaatatgccctcctagggagagaatgcatctagaaatagggaactgaggagtgaactttagatcacactcttattttgctgtatgagagcaacttttttctgatgatccattcccaaatctaactcaaaaggtctcattatcttcccttcgaaccggctattgattgtgccattatccttaattcagttctgtaattcaaacatcattctatccccctaccaccacttccaatcagtgtctatatttcatcaataattcctttatatcttttttatttcctttcccactgccaccatcttaatttacttccttgactttcatgtgtgaacctggtgctgcttcctactttatctatttacaggttccatccaccacctcactgcagtctatcccatagacagtgccaaccttttaatctttctaaaatgctgcctttatcctggccttcctaaccttgattagttccagttgcttccatatcccctaatgtgcccttcaggtacctgaaaaccatctggactgtctacctttctatttcctatttccctatggctgaagcacactcactccaaccaaaccccataatagtattgctgttaccatgcctgtgtcattctttccaccttgagagactttctggccactatctacctatttctattccctttattcttcaatatcaaatcccatatcttaaataattgaaaacaaagcaccttagtatatagcaactcaatacctaactcatacctacagggatcttattctcctctgaattcctacaacacatcattttgtattttcatcaggaacataaacaccaattacactttaagctgtttgagccctaaccaaagtctctggacccctagttttattgcattttcaactgagtcattttccttcagccaagacctgatggaaaccagcactctctactctaatctctggttgttgaatatgactctctggaaagaaccagtatattagtccattctcacattgctatgagtaaatacccaagactgggtaatttataaaggaaagaggtttaatggactcatagttcagcatggctggggagacctcaagaaacttacaatcatggcagaaggcaaaggggaagcaaagcaccttcttcacaaagcaacaggaaggagaagtgcagagcaaaccgggaagagccccttataaaatcatcaggtcttgtgagaactcactcgctatcacaagaacagcatgtgggaaactgtccccatgattcagttacctccacctggtctctcccttgacatatgagtattatggggattacaatttaaaatgagatttgagtgaggacacaaaccctaaccatatcagccagagacctctaaaaaattagactacacatcctatctacttactgtttttaatggaaatgcccattggtagagactcattaatcctgctgtaaaccctctaagtggtctttattggtatctccccagaagtatttgttggcagttgctcctgaatgagccttaggtacaggatattgacttcagtccacattggccaagattcttgttgatcatggctttcataataaactcctagctattttcagcagcaatagggttctcaggggttcatcggcatctcaaagtttgactttgatactgttacattcccagaaccaattctagggggcagtccacagcagaatgcctaaaaatgtttctcatcctttccgtagcataagaaagctgtttcaaggaacatgctcatcattcggtgccactgcatttatggagcaaggcagtggaatatgacccttatcacactcctgatcatctccttagcctcctgtagtggtccactgactccccctagggctctctatggggttcataccctcagcaggagtagtgctcctgcagttgcagggtaaagcctgccacttcctcttcactgcattgaaattcaaataatttgagaaatagacaaaattcaaatatctttttgcttctctcttcgttttgcacagaatcagctaggcaatcaagtcccaaagatggctctgtatatatcctataattttccaagcaaaatattcaaactgaaccctagaagtgattcagtcatagtcatacacttttaaaatgttaaatgccatttaacacgtgagcattttattatgtagcttttgggtctttcccattaccccaatatagcttaaatccttcaagagtagaaaacatatatctttctgttctctcacatgggctggcatggaactaggatatggatctagtattctagcataaaactaactccatgcaacctattaacatacagtccatagctagttccactagcacttaactaaatctattctgtgggctagcatagagtttagaataaatatttgttaaataaatgaataaatactatataaagtatttattccaaatgctttccaaattcaaaatttcatttttaatttccaaatattacatttataatagttgttaggaaatatatttaattccattagaatgcatttgcatttagttgttttttgttattatttttgtgtatagataggatcatgaggatgcataatgcttttaaacatagacatcatcagagctaatattttatacttaaacagaagttttttaactattttattaagataaaatagcttctaaggatataacttctaccaacttaccaaaataaataggatatatagagtttttatttatgcagatatactgattgagctgtctgtccaaggactagattatacaataggttgtattatataaccagtattatataatactatccaagggctagacgaaaatttattttaatacacattcaaactaaaataaaaaataaaaataaaataaaataaaataaaaacactagtatatttctacagggttgcaaaacatgggaagtcctggacaggtaatattttgaaagcatttactgaaccaaatgtgctttaagactcaagacataaaacatgaagattgatttacttaggacaataagcagaagacctgtccctatatgattttgtaacatttgtagctctctgaagtatactcattaatgttctgctacttcaaatgtatagtgacaaacacaggtcaccatgaagtcattgtaaaatattctgcttaaggctttattatcttgcacaactttaattcacaccttcttttataattgcaaaaggctataaaaatttgaaaaaccttatcacgagtgtatataattgaagcagataatatatatatacaaaggatgaagagaagacctcttactaaatgaccttttatcattttgttgttacactttctaaaagtaacaaaccaagtgaataatctctttcttacagtaggaactggcaggcttcacacttagaatctgaggtaattactatagcctgcagtagtcctttcagacgagaacagatactgtgatttgtgtctcaaatattcattctaatttaaaatgtcattccctaagaagcacactgagttgataactgacttcattttctaatgcatggcagaatttggcagaaaatattttcttaaaattattgcctattaagattacagtatagcacagacaatccaatactttttttaaagtctcatttttacttctttttttttaatctcttaagatgctagaacctactaggcttcataaaagaagtactcactttgatatttaaaacagacaagtagctaaaataacacaacacctattttagttttaaaatatttcttcaactttcttcactattccttccatattaacatcaccttcccttgcctagagtatgatagattgtccaggccctagttagacctgaataattcactagcttgtgcatcatcttgtgtgagcaaaaagctaagtttcaacaaattgattgaaaaaaaaaaagcttttccttacttttttcatttttccttcaggttctcccaagacaaacctgtgggcttttcactcacaccattttctacaaagaatatccagggggtcctaaagagctggataagagtatccaaggaggagaacttttcttcactgtcgtcctcaaccctgtaagtactttattctccaaataaatagtgaaaaatgatagggctggcaaaaattaccctggcaaagaggctagggattgggcagtcatcagccaagccaatatgaagttctagctctgaaacagtagtaaaaactaaatggaaccacatctagaaatgggaacaaaccaattctacaagtagcagtaacatgaggaactcatggcagaaccagggaagtgctccagcggatcctcctttgcattgcaaagtgatcagaagctttcatggggaataaaatttttcacctgtaaaactctcctatttccacggggaaccatttttttttccatttagacaacagttacctctattattatttttattttactatttaaagttaacgtagaagcaaaatagtagaggaattaggtaagcaaatctagttatattttctacttcatgttagattcgtcttgctaggtcataggctgaagcagagcaggcctatttaatgggctacttttttttttttgagatggagtctcactctgtcacccaggctcgagtgcagtggcgccatctcggctcactgcaagctccgcctcccgggttcacgccattctcctgcctcagcctcccgagtagctgggaccacaggcacctgccaccacacggggctaattttttgtatttttagtggagacgaggcttcactgtgttagccaggatggtctcaatctcctgaccttgtgatctgcctgcctcagcctcccaaagtgctgggattacaggcgtgagccaccacgcctggccgggctactcttttacttcttcatacttgtgtgtcagctccacaatgaaccatttgcatatatttctgcttgaggcaagtattagaaagttgtgtagagaaagaacaaatggaagtaagctgcataaggaaaagaagggattttatttcccttttgaaaatcactatcataaaaagtaaagctaagtttatttatcagaagatgtatgggtttgcccttggcattggcaatattcaagatggaaaaaaaattattatttccaaatgtaaaaaaaaaaattatcagtgaaaaaagttggatagggataaattgaataaaatttgcaaaacccctctcttgaccttagttttatagtccctgcaaataaaattgcagatagtgttcaccatctacttgtattcaaggagatttattgtgctcaattctgcttgtattcatcactatacctatgttttaactcctagaaaatgagatagaagaaagagtaactcatctttggacaaaacctgctcgtgtattcaaaaatggggatagtttggaggaatgtgatatttggacttttgaaagtttatcaaccttcagatcccaaaaatacaaataagtctggtttgaacatcagaaatataataactcttctaacttacctattttcacaaatggaagtattttgagtctccttatacagctttcttctcttttttctcaattcagccagtacagtaatatacagtcaaaaagagttaaaccaatgcctggttatgaactgaagaagcagttaaaacactcttaaaatgctaacattttcaccaataattttaagcactttaatctatcatctgtaaaattctgatgtttcacatttactttcatcatagagcaacagaagtattaacaaataatcatgaacttcttaaaagttcacagtaggattttatctccgaatttctaaaccaaatgagtttcatttagtgtggaagaaattcaaagttaaatcattcatgtacaatggatttatactaagaatttcatccattttgtgataagaaatattacattttttattaatttaaaaaccaaactattgtctttgtttttaaaaaccttacagtaaagtttatgttaatcttggacactaattggactaactgagcaaattccttaacaaacctcgctatttttcaggcctttatgaatgatatttggcaattttatgtcttgaggaggagattcataagaataaaggtggcaggttgggggagccgcacaaaacttgttctttcctgattcagaaaactttcagtagacaattactttcagaaaaaaatccctagactcaaaataaatgacaaatcttgtcagatgccacaagacagacaaggaacccaaagctaacgttatctggcacaccaactctaatactggaagcaattctactcacctggaaacaaaaggttaagaagcccacatctggattcagcccacatctagccggaggccggactactataattagttagtgatgtctgtcttggagaacagagtaaggagtagtggcatgtttcccatgaattctccatcctgaaattaagtgcttggacaaagtttgtattgaaactaaggaagatccagatgcagtaaggcatgccagtaatttagcagatgacattttttattaggccaggatggaaatgagaaaaccttgatggaatcaaagtatacattagctgcaggaaagtcatgaattttaattatagtggatttgaaagatagccattgtaagtttaagtaataccccaggcctcaattagaagtgccattttctgagaatgccaagtgaggttatcgtttactacaaaaagatagatgtgtattggaaacatggcacttaaatacattcacatacatttgagctgaaaacaaaaatataaacaggactttaattaatgagggttttaagtttttcccatatgtcaacataatatcaaggtgctatactaacttaccagtactggggtgagaaagggttacaataaggtgcccctcagagttaaactggaaagatcacagcaaaggtaaaaaaaccgttaaacagaataactctctggcctgaaatgttctaatgttaccaaaatatttgtcatgtaaaagaaagaagtatcaatcaagtgaatttaacaaaatagagaattacaaagacaaatgttagcactgtctggggaagagaaaactttggtcatctctaaatgagcttttccaatgtcacaggcctggacaactctcacgtaagctggatgcaggggttttgattaatagactttgaagtttagatccatttgggggaggtggacctagcaggctatctgagcctggaaccattgagatttccatttttctaatactacttttcctgattctaaacccaactgatgacttcctcattatggtttactttcccacgtagatcctactataggaaaagaatatgttaatcataggaacttgtactctctgggacaataatttgcaatataattttataagttttattttaattgatcaatacttcccatgtaaccggactacctggaaagagccctctaattgtatagacagtaattgaagagtatttcagttcctctctaatttataattacccattttaaactaatagatggtatcctgcttttattcattggtttcatgagcttttgctaatctgattctgccccagaaaaatactgactctctctgcaagtgtactgaatcaggttttggagcctgtcggtcagaaacagacctcagagtgttcgttgattaaggatggtaatgagagttacctcatgatataccatgggagagagccactggaagtaccccagagtcactgctagcaacacacaggcatgagatttctacacaaacatgtaatatacctagatacaaacattcttgatcaatttacaattatacagagtactcatatatattttcaaaaattgtgagattctatttactttagatacttatataaaataaaatgcagaagggtactaagaactgaaacttatgaagataacaaaaaggattaattggcaatgactgcatctgccctcaataaataaaactctatatatgacgtatatacttagacaaaaggaactagtacgactatagtgttcattttaacaagtttccagttccacctatcttaggaagatgcagtaatagttaattaatatgctgattggaaaagttccggcttagacaggtttgtacttcttgtgggagccatattatcatctcatatgcactaaacaaaaatgtcacttttttgcttcagggttcttatctctaatcacaagatgttatgagtctttgcttatgcacttgttgaataaatagactccaggtattgagtcattaacaactatagatatagaacactttgcctcccttcaacatgcttgataataaagtcagtgcttacctattaatccaaaaaagcagctgtggattgccacaagattcatgccaatgggccaggcgcagtggctcacgcctgtaatgtcagcactttgggaggccaaggtgggcagatcatgaggtcaggagatcaagaccatcctggctaacacggtgaaaccctgtctctactaaaaatacaaaaaattagccaggcgtggtggcaggcgcctgtagtcccagctactcaggaggctgaggtaggagaatcactggaatccaggaggcagaggttgcagtgagccaagatcacgccactgcactccagcctgggcgacagagcgagactctgtctcaaaaaaaatgcgcgccaatactacacttgcttggaattcaggtgaagcaaatccctgaccatgtaacaatattgtgcctccttcatcaaaccattaaccatcccacagaaccattagctaacccctttatgcacgcattttattaaatgctttttgtctctctgtttctcaatttgatatagcatacttccaccataccctacataccctcctactcaaatccctaaaagttaaatctaaattgtgtttctcttattataaacatggatgtgaatagagtgaatatcttaaactaggattaacacatagattgattacaactaaaataaataaaacagaattcactcaagaagaaagcctttataaaaagaaattaacccacattgaaattgaaaaaaaatactgtaattttatatgtgtatgtgcttttctctaaaattcatctgaaaggaaataatacattgacctaatgggaagttttatgtttctttttttgttcgctagttctggaacacattctaataataggagacccttcgctgaaaaataaataaatgataataactttagacctagaaaagtaattcctggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctgtgttttggtaccagtaccatgctgttttggttactgtagccttgtagtatagtttgaagtcaggcagcgtggttcctccagctttgttcttttggcttaggattgacttggcgatgcgggctcttttttggttccatatgaactttaaagtagttttttccaattctgtgaagaaagtcattggtagcttgatggggatgacattgaatctctaaattaccttgggcagtatggccattttcacgatattgattcttcctacccaagagcatggaatgttcttccatttgtttgtatcctcttttatttccttgagcagtggtttgtagttctccttgaagaggtccttcacatcccttgtaagttggattcctaggtagtttattctctttgaagcaattgtgaatgggagttcactcatgatttggctctctgtttgtctgttgttggtgtataagaatgcttgtgatttttgtacattgattttgtatcctgagactttgctgaagttgcttatcaacttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgaaagagggcatccctgtcttgtgccaatttttaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattttgtttgccagtattttattgaggatttttgcatcaatgttcatcaaggatattggtctaaaattctcttttttggatgtgtctctgcccggctttggtatcagcatgatgctggcctcataccataaaaaccctagaagaaaacctaggcattaccattcaggacataagcacgggcaaggacttcatgtctaaaacaccaaaagcaatggcaacaaaagacaaaattgacaaatgggatctaattaaactcaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatagcaatcattcaaaagtcaggaaacaacaggtgctggagaggatgtggagaaataggaacacttttacactgttggtgggactgtaaactagttcaacccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatgcatgaaattggaaatcatcattctcagtaaactatcgcaagaacaaaaaaccaaacaccgcatattctcactcataggtgggaactgaacaatgagaacacatggacacaggaaggggaacattacactctggggactgttgtggggtggagtgagaggggagggatagcattgggagatatacctaatgctagatgacgagttagtgggtgcagcgcaccagcatggtacatgtatacatatgtaactaacctgcatattgtgcacatgtaccctaaaacttaaagtataataataataaaaaaaagaaatattaaaaaacaacaacaacaacaaaaataaaataaaataaaagtaattcctgaacatgcctaatagtgagtactgcctgagatgcttgaattttagaaatcaaacttaatgcatcagaatctctaggattgacctaggggctctacatactcaccatgcgctttaggtaaatgttaggatcaggcaaatagagaaatattgccgaggaagaaaatggagaagtaattttggtaatcaaagattaccaaaaactgttatagaaattgtaaacctagaatcaaggtttcagaatggaaaatggctccaaatctgcaatagaactttaaaaaacagtaagaattaatgttttcctaagtgaccagagaactctaccttaaactggattttaaaatagtgtttactgctgttcatcccaaaaacttagtgtaggggtcaccttcctcaggaaactttttctactctgatttagaggcccctcctgcgtttctatagcatcctctgcagactctttcaaagtatttattatcctgcatcataattgtgggttgtattagcctgtacgcttgtggttgtagagaatgtgtctgtcatttccaaaactatcccagtgtctaaacataatatgttttacctagttttttattttgcatatatttgttaaggaaaagaaattaacttttctaatgaactgatttaaaaagaaaaatgaatctattcataaaaggaaatccaagtcctcgtaagaaaattctcaaatcaaaagcataaggaaaacctgtttcctgaattcactggggctgaattatgtatcgttgtgttctgttctttacacatgcatttgtcttcctgtatagagactcatttgtgttgagttgatatagtttaaagactagaggctcattcaagttacctcaggtaatgggactccagaaagtaatattacttcaagtaatgtgggactccagaaagctacacattcaggaatcataggacctagagggtgttctgagaccaaggtagctgtaaggtccataaaaatcagaatttctttaaaacttatgaattgtttactattgaaatttttcatttaatttttctggaccacagttgacaattggtaaccaaaaccctggaaaaggggcctactgtaaatatttttctgatgaggtcgctttacttacaatagaaataaaactttaaacaaggtaaagaaaaaaatgagaaatgctaatattaatcttgccttagtgctttattttgaacccaacagatgcttttcacatgtctaactttctcttttctgtactcctgactaaattaatattccttcaaaaaaagtgctgcttgtttacggtttctgcagtagttaattaatcttacaaatggcccaatatgaatgcatcagatattctccatatcaagattcagctccagttctaactgctgactgcctcgtccgctggattctcaggtcgaatttccaagcaagggaatccacttgcttcagctcacctttctgagtcagcccatatcagtcctggccttctgtgaaatgtccattcttggttcatatccccacatgccccccacttctaaactatgactgagcaacggctacctgagaaccatccttccagcaaaggcttgcaaaggcaggtgcgatggcagctatctatcttgatctgaatcctgtgagaacagtcattatggtttctagccaatcccacagatttgggagtaaactgaacctctttggagaggctcaaaagattcattttgaagcttgcaaagtctaagtagaataagtagctctcttagatgggaccagctaattttatcattttattatatgtattgctccatacccacttggaatgcaagttccaataggcatttatatcttgtgttttgtttactctaaacctcaacactaggaagagttctggcattataaggtacttaaaaaatattttataaatgaatgaatgaacttaaatgtccaaaagggagcagcggagtggccagtagcaaaataaattatgttcacccttatgtaataaaatacattatgtaataaaatacgctatataataaggtacattcaggcatttaaaacatgttgtgtaataagtttggctgggtgtggtggctcatgcctttaataccagcactttgggatgccaaagcgggtggatcacctgagttcaggagttccctgaccagcctggccaacactgtgaaacccagtctatactaaaaatacaaaaattagccgggcgtggtggtgcatgcctgtaatcccagctacttgggaggctgaggcaggagaattgcttgaacccgggaggcggaggttgcagtgagctgaaatcgcaccactgcactccagcctgggcgacagagagagactccatctaaaataataataataataataattttaatgacgtgaaatattcatgatcttctcaatgggaaaagtaaattacaagaaaatgagatatgagtatggaaataaactagaaagaactcagcagattgttagcagtagttatcctagatcacacaattgaagatgatttccattatcttcctctaatttttataaaatatctatagtgaacacctattagtgttataaccagaaacttcatacacatgtacacacacagagacacaacacacacagagttacacaataaatgctacactaaaaataataataatcacttaatagtgatgtacataaaatggaattattttgtgttgttggtatatcaggaatagaatttctatttactcagttccaattgttctgtatctgtaagtcacatatgttgcctaacacctgccccacagtgtgattatttgtgtgtgcatcttttctactgtataatggggcattcttattacagaggtaatctgtgtgtgtttcatctttgtgctttccattgtgtctagatcaatgtttgaatctaataagaggttgctaaatgtattttaatgattgactaaacgcatgaagagttatatttcaggggcatgacttgctttaaggtatatccaaatgtgaatagcaagcctagttttaataaaactacatttggcagagtctctgcttgcaagtaaatgaaatttagacttcagaaaatgtttgaatggccctaaatctttagcaggttttcataagtgatgatgaaatttacctgacacagaacaaaggactattaaactggaaaagaccaggaaggttatctatcaatcttttaatttttgatggagaactagaattccaaaaagattatttagttcactgcaggtcacttctatagtattccgaccagaactctgttcttcctgactctcagttcaccacttcacccgctacaacacactgtttctgcacgcctggctaaattggtcttgacgtgatgtacattccttcttaatatgagtcagtgacctggtactgggaaaatctgtgagtggtttaacatgtcaggctattgtctaagaaaaagcaaaccatctccatgtagggttaaaaagcaaaaaaatagtgcttttgagaaaagctgtaataagcacttgcagttaaggaaaaatgtctaatgtacttttaaagaactacgaataaagaactatgttctctttatcttaatacattgtattgatattacttataaaatggtaagacttttaaatttataaagccaaaacattttatttcatctttttgctatcctccatattagccctatttttctattattaatgttcttcatcactaactgtggtgttagatacagcaggtccttaaataatgttgtttcatttaatatcatttagttataatgttgataaggaaaacatcagttcccatccagggccaatctgtgtgtagtttgcacattcaccccatgtctatgtgggttttctcctgatactctggtttcttcctacatcccaaaaatgtgcacatcaggttaattgtcctgtataaattgtgatggaataccatattgtccagggttggttcttgccttgtgccctgaactgccaggataggccctggcccccaagcaatcctaaactggaataactgggtaaatgattatcttacttgtttttattactctttcctaaatatatgtagagctaacatttatttcaatgtttaatattaaagttctttggttcctatttagaagctgggtgatgttttgggggccagaaatatgtcataggaaattaactcttgtttagattatttaaccaatggtaaaattggttttgttatatgtcatttggtttacagtttcagtttccaagaacctaccaataacattaagtgagaacttactgtaattacttgtcactctgagattaagaaaaccacaagaaagcatgattaagttgtgctttttatttgacctccatagttaagaaaaataggagtttttggaatggatattatcttaaaatgtaagaaaatagatattaagttggagaaatgaatattatgttattctttgttcaatcctttgatagtttcccatagcaatcaatgacacccagtagcaaagattttaattcctacatactaaatacaaagtgctcagattttaattcctaaatactatttctagcattcaggatagacagaaaatttcttcacttgaaaaaaatcaaatctggctcctgtccacttttctcatcctttttttcaataatttcttatatgcacctttcactccacccatacagaataattcatagtaccttgaacaaaactttgtactatctcactctatgtcttaaagtgctatcacctcaagctggaatgccctcctgcaaatttgaactcatacatcatttttttaaagaagacatccccaaccctccagcttgatttctaaggtttctcctctgtgttctcatggtactcaggcataacccaattataatttgcctacagtcctataatcaattatctttaccttccagtaatttttgacttccttgatggaagacatcatgccttattctattttacattcacagtacactgcaaaagttttggcacatagtaggttctaaataaaagacaatgtgtttcccatgacttcccatgactacatacatactatctttggaatttgaaagaaatttggttgccttggaagtacctcaccacagaattcacttgattacagagggtttgagtaactggtttttattgtctcccaacatggcattttattgaagtcattgagtttatgagaatatgctcagtttcactcataataagaaaaatgcaaagtaagattatattgagacactatttcttacctaccagattaacaaaaattcaaatgattgctaagatattctgttagcaagtctgtgggaaaacaggtactctcatacatcctagtgcgtgagcaaatggtacaaccctaatggaagaaatttaacaacatctaacaaatctacatagcacttgctctttgctgcagaaattctacctttaggactctaccttaaagaaggaattaccacaaagtcaattttttaatgaacaatctgagtgcaaaccattttttcagttattcattaccggattatttgtacatcaaatagtgggaacaacctaaacatccatccataagagactagttaaaaaaatctgtggtatagccatacaagagactactatacaaataaaattaagaagattttgatgtgctgtgatttccacaatatattaagggaggaaaaagtgggcaatctgaatacatattgatatttacctacttgtacgaaaagaaatacaggaaaaacacaccaaaaataataaaagtgttttgttaattattaatagaaattttaaaaatttaaattattaataaaaagaaaactacatttaaaatggggggatggtgggatgagagcagaaaagtaagggggtgagtgggagaaacacttcactacgtacattttttacacagttttgtttttgttttttttttttttgagacagagtctcactctgttaccaaggctggagtgcagtggcgtgatctcagctcactgcctccgcctcccaggtagcagcgattctcctgcctcagcctcccgagtagttaggactacaggtaggtgccaccatgcccggctaattttttgtatttttagtagagacagggtctcactgtgttagccaggatggtctcgatctcctgacctcatgatccacccacctcaacctcctaaagtgctgggattgcaggcatgagccacctagcccagcctatagctttgattttgaaccatgaaatgttttacatatagtcaaaataataaatgaaaaggatgagggagagataagcaaacctgaaaattgaagacaaatgaacaaataaacctaacatggatgtgtatgtaatatattacacaaaataattaattaaaataattttgagtacagtattctaactgcatacgtttagtgaaatataggacaaaagtctgcatggaaaatataaactttattaataaatttttgttgaattatgaaacatttctcatgtattgtcagatagaaaaaaataaatgaatatattgatgctgttgggaactgagttttcgccataaaacgaataaaaatatggaaagaaggataataagagagaattagagtatttaaatttgaaatgaggagattaataagaacttaaggtttcctacctctatctagaatcaatgacacttagtagcaaagagctcagctagtgctcaaattttaatttctaaatactatttctccccaaaagtaagtgggctttttggagaaaaggctaaattcaagtcagatacatggaaagtacaaattgagtctggaacaccttgtaccagaaaaaagggaaacagtcactcaaagactaacaagcttgtattaaacaggacagaaatcagctaaaagtgctcttgatatgagataattttagcatcaaaaaaatggaggttatagacatactcaaagtatgaaaaaagaaggagagttcttctgtagagaagacaccagtgccagctgatgaattcaggtagaatgatggaattcaaagatcatcattttgcagacaccaatgaaaacaattgattgaaaaaagaaacatcaatagttgctgaaacttttgggtgaaagattacacagccttaaggtttaattccatagattacttattaattacaaagagaaaaatcattcttcacaatagagaaatctgacagtttcttactgtacccaagtgatcagaattaacatcaccaaaggtggagtaacttaacaagataagctgatattatgcacctcctgtgattcaatacaaaataaagtagggtgacatcagcaaaatgatgaaatagaaagtcccatatcctccttccttccatagagtcatcaactgaacaacaatacatgaattaattccctttgtgaaaaatccagaaacaaattaagacactgctggaccccaggcaagcgcaaaaccagctgcatagaggccagtaaaaaaattcacaacactcacttgccatagtccctttcactgactcagcagagagcaactggaagaaaactcccagcttctagcttctcccacagtcccataggaggaaaagatttggcttgtacatttttgtacattgaacatttaggcttttggcaggggacagaggggcagaagggtgggtggatggttgcccgagaaactagtttttatcttatctgtctccaagtgctgacaggacccaatatattctagaagccaggggctgctgacaacaaaagacagcttggcagcttatagcagctccagagaacaccagaaggagtaatagattacaaggtcttggaagaaaatcaaccagtaaatccctctaattgagaatttacacacacaagtctattgcagatgtatccacagactagaggtgagaggacctcagaatctcttacttggctgattggtgaaggtttgttcctatacaaaccctgttttttacagagtgagagaggaagctattttttgaaatgcacagaccacaacaaaaggtaacaaggcgcattaagaaaaaggaaaatatagaccaatccaaggaacaaaataagtctccagaaaccaacttaatgaaatggagagattaaattacctgacgagaattcaaaataatcatcataaagatgttcaataaactcaggagaaaaatggatgaacaaagtgagaatttcaacaaagaaatagaaaatattaaaaatggaatcaaatagaaatctcagacctgaagaataaaataactgaagtgaaaaaatcactacctagttttaatagcaaacatgattaagctgaagaaagaatcagggaacttgaagacaggtcatttgaaattgcccagggagcaaaataaaataaaacaaaataaacagtgaagaaagtctaagggacttaggaaacaacatcaagtttgcaaatatttgtattatgggagtctcaaaaagagaagaaagagagaacaatgcagaaagcttattcgaagaaataatggccaaaacttcccaaatacggaaaaggaagtagagatccaagttcaagaaggccaacaaactccaactaggaagaactcaaagataaccacaccagaaaaggttataataaaaatgccaaaattcaaaggatgttaaaagcagaaaaagaaaactgattcatcacataaaagggagcctccataacactatgaggagatatctagcagaaacctttcaggacaaaatggagaagggagatatattcaaaatgctgaaagaaaaaataattgccaactgagaatactatagcctgcaaaattgtccttcaataatgaaggaggagcttctgcacaacaacaaaactgtcaacagagtaaatagacagcctacaaaatgggagaaaatatttgcaaactatacatctgacaaaggtccaatagccagtatctataaggaacttaaacaaatttacaagaaaaaaaaaaaacaactttatttaaaaagtgagcaagggacatgaacagacacttttcaaaagaagacatacatgtggccaataagcatattaaaaaagctcagtatcactgatcattagaaaaatgtaaatcgcttcatttcattcatttcatcttccatcactaatatcctttcctccagttgatcgcatcggctcctgaggcttctgcattcttcacgtagttctcgagccttggctttcagctccatgagctcctttaagcacttctctgtattggttactctagttatacattcgtctaaatttttttcaaagtttttaacttctttgcctttggtttgaatttcctcctgtagctcagagtagtttgatcgtctgaagccttcttctctcaactcgtcaaagtcattctccgtccagctttgttccattgctggtgaggaactgcgttcctttggaggaggagaggtgctctgctttttagagtttccagtttttctgctctgtttttcccccatcttcgtggttttatctacttttggtctttgatgatggtgatgtacagatgggtttttggtgtggatgtcctttctgtttgttagttttccttctaacagacaggaccctcagctagaggtctgttggagtttgctagaggtccactccagaccctgtttgcctgcgtatccacagcggcagctgcagaacagcagattttcgtgaactgcgaatgctgctgtctggatcgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaattcctcaaacagctaaagacagaactaccatttgatccagcaatcccattactagatacatacccaaaggaatataaattgttctatcataaacacacatgcatatgtttgttgcagcactatttacaatagcagacatggaaccagcctaaatgcccatcagtggtaggctggataaagaaaatgtggtacatatacaccatggaatacaatgcagccatagaaagaacaaaatcacatcctttgcaagaacatggatggagctagaggccattatccttagcaagctaccacaggaacagaaaaccaaataccacatgttctcacttataagtgggaactaaatgatgagaacacatggacacaaagaggggaacaacagacacttgggctgaccacagggttgaggctgggaggagggagaagaacagaaaaaataactcttgggtaccagtcttgggtacgtgggtgatgaaataatctgtacatctaaccgctgtgacatgagagtacctatataagaaagctgcacgtgtaaccctgaatctaaaattaaaagttagaagaaataaagacctatataagcaaatactgagggagtttattaccactatatcgcctttacaagaaatgctaaaaggagtccttcaagttgaaatgaaaacaccctaggcagcagcagaaattattatgagaccataaagctcactggtaaaggtaaatatacagaaaaatagataatactgtaatattttagtggctgtgtataaatcacctttaattctgatactcaagttaaaaggcaaaagtataaaaaacactataactatatgacaataataaaaagggcaagggaggtgaaagaatagagttttatatccaattgaagttaaagttgttatcagcttaaaatatcaactttatatttgttacaactataagatgttttatgtaagccccacagtaccacaaagaaaatactttttaaaaactaccaaataaatgagaaagaaatcaaagcctatcactatacaaaaatcaacaaaacacaaaggaagacagcaagagaagaaaagatggacagaaaagcctcaagacaaaacaattaacaaaatggtaatagtaagtgcttccctatcagtagttacattacatgtaaataaattaaactcctcaatcaaaatggatatagtagctgaatggataacaaaaacaagatccagctattgttgtctacagaacactagctttagatttaaagacactcacaggctgaaagtgaaagcatggaaaatttattccatccaaatgttaaccgagagagcaaaagtagccatattcatatcagaaaaaatggactttaagtccaaaactgtcacacaaaaaaagaaggacataatctagtgattaaaaagtcaattaaccaggaagatataacaattataaatataaacgcatgcaaattcaaagcacccaaatatgtgtaataatcattgagataactgaagggagaaatagacaataacacaataatagtagaagatagcatcctactttcaacaatagaacacttagaccaaaaatcaataagaaaacaatacttgaacaacactatagacccaattgacctggccaactgatacagaacattttactcaacagcagcagaatgcacatgcttctcaaactcacacaaaatacattccaggatagattacatgttggatcacaaaataagtctcttttcagaacattgatatcataccaagtatcaattcctaccacagggaatgaaactaaaaatcaatagcagaaggaaaaatgggaaattaacaaatatgtggaaattaaataaaacactcttcaataacaatttgggtacaagaaaaaaatcaaaagagaaatttaaaaataccttgatataagtaaaaacaaaacacctaccaaaacttatggaatgcaacaaaagcagtattatgagggaagtttatagtgataaatgtctacatttttaaaaacagaaagaattaaaataaatagtttaattctacctcagggaaactcaagaaactagaaaaaaaagagcaaactaaactcaaaattagtagaaaggaaacaataaagattagagcaaaaataaatgaaatagaaaatataaaaataagagaaaaaatcaatgaaattggttttttgaaatgattaacatcattggcaaacctttagttactaacaaaaaaggaagaagactcaaataaataaaattggaaatgaaagagaagacattacaactgatcactggaataaagatgatcataatagtctataatgtacaattatacactgataaattggaataacctagaaaaaatggatatatttctaaacacatacaacccccaagacttcatcttgaagaaatagaaaatctgagcaggcttgtaactagtaaggagactgagtcactaaccaaaagccttccaacaaagaaacttccaggaacagatgtctttactggtgacttatatcaaacatttaaagaactaatgccaatccttatcaaactctccaaaaaaacggaatagaagggaactcttccaaactcagtctatgaggtcagcaatagcctgataccaaagccagacaaatatactatgagaagagaaactataggacaatattcttgatgaacatagatacaaaaatcctcaaaaaaatagtgcaaactaaattcaacagcacattaaaaggttatacaccatgactaagtggcattgattcttgggatgcaaggatgtttccacatacaaaaatcagttaatgtaatataccaaaataacataattaaggataaaaatgttatgatcatcccaatagatacagaaaaattgtttgacaaaatgcaatatgatttcatgataaaaacttgcaacaaagtaggaataaaaggaaattacctcaacgtaataaaagccatatatgaaaaaccccacaagtaacctcattcttcatggtaaaaacctgaaaacttgcctgaggaacaaggcaaggactcccactgtgatcatttctattcaacattgtactggaagtactagccatagcagttaggcaagaaaaaaaaaaagacatccaaattgtaaataaaagagtaaaattatctctgtttggaaatgacatgatcttatatttagaaaaccctaaagatttcacacagaaacatacacacgcaggcacacatgcatgcacacacacaaaaacaactgttagaattaacagttccaggatacaaaatcaacatacaaaaatgagttatgtttcactaaccacaaactatccaaaaagaaaattaagaaaacaatcccatttataatagcataaaaaagaataaaatacatagaaataaactgtcccaagtcagtaagcaacttgtacactgaaaactgcaaaatattcccaaaagaaattaaagaagatacaaataaatggaaagatactccatggtcatagattggaaggttaatattattaaaatgtccatactactcaaagtaatctacagattaaatgcaaacctcatcaaaatcccagtggcattttttaccgaaatagaaaaaacaatcctaaaattcacatggaaccacaaagggccccaaaaatccaaaacaattttgagacaggagaacaaagctggaagcatcctacttcctgatttgaaaatatattacaaagatatagtaattaaagcagtatggtgatgttacaaagatagacacatagaccaatggaacagaatacagagcccagaaataaatctatgcatatgttgtcaactgacctttgacaagggcatcaagaatacccaatgaggaaaagatggtctcttccacaaatggggttgagaaaactgaatattcacatataaaaaattaaaatggacccttatcatacaccatacacaaaaatctatttaaaatggattaaagacttaaaagtaagacctgacactgtaaaatattccaataaaaacataaaggaaaaacttcattacattagtcttggcaatgattcttgaatatgacaccaaaagcacatgccacaaaagcaaaaatagacaagtggtggaattacatcaaattaaaaagcttctgcacattaaaaaaaataaaataaccaactgagggaaaatgcaacctatggaatgggagaaaataccctcatattgtatgtctaataaggagttaatattcaaaatataaaaggaactgctacaactcaatagcaaaaaacaaaaacaaataatccaattagaaaataaacaaagaacttgaatagtcctttctccaaagacgacatgaccaacaggcatatgaaaagaaattataggtcaatgctcctgatgaatatagatgtttaaaaaagtcactaatcatcaatttttatataaattcatatatataaatataagtaagtgctagtgagaatgtagagaaatttacatacatacaaaagtcactaatctcatatatatacacacaagtgctagtgagaatgtggagaaattagaactcttgtacacagttggtaagaatgtaaaatggtacggctgctatggaaaactatggaggttcctcaaaaaattaaaaatagaactaccatatgattcaacaatttgacttccgggtatacatccaaaaaaactgaaattgggatcttgaagagatacatgcactctcatattcactgcagtattattcacacagccaagatgaggaaacaacctaaatgtccatcaatcggcaaacgggtaaaaaacgtagtatattcatacaataaaacgttattcagccttgaaaagaacagggaaatcctgctatgtgtgacaacatggatcaacattgaggacattatgctaagtgaaataagtcagtcacagaagaacaaatactgcttgattccacttaacatgagatatctgaaacagtcgaactcataaaagcagatagtagatttatgattgccaggagcttggggagggttcaatggatataaattttcaattatgcaagatgaataccctctagagatccagtgtacaacacacacacctataattaacaatactgtactgtatatttaaatttttaagagggtaaatttcatgttatattgttgtatttttttaccacaatttttaaaaagaaaaaaagaaagaacttttaaaatatctttttgtattcttaatctaatgaagaaataatcagacaaatgcaaacactgatatattctataaaacaaatagtctggacttttctaaaaaggacaatatagtgttttttaaaaataggaagaaagaggattattctagcttaaaagaaactaaaaggcataataatgtaatgtaatttataagcctaagctttcattggatctggaatttttaaaaatatacatctataaaagtcacttttaagttattttttagccccaaaataaagaggcttaaaaaaacattaatcattttacaatctctcatgatttctgtaggtcagaaatcagaaaaacctgaagtgggccgggcacagtggctcacgcctgtaatcctagcactttgtgaggctgaggcaggcggatcacctgaggtcaggagtttgaaactagcctggccaacatggcaaaaccccgtctttactaaaaataaaagaattagcctggcatggtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaagagagctgaactgggtgatcctggctccaggtttctcatgaggttgcagtcagatggtaactagagctggaaaaccaggtggcagtgactagagcatctgtgagctggtgggcatctcttcatgtagtcccagggcttttccatgtgatctttaccggggggcttatctgggtctcttcccagaacaatcagacagctttaaggctccatcaagtgttgcagcaagtaaggcagaagcagaattgccttggattcagaagtcacagcatcacttttgctgtcacaaaagcctgcccacattcaaacacagaataaataaattatctctctttataggagactgacaacattctggaagaaagagaaattgtggtagtcatttttggaaaatagaatttaccacagacaacaatgaggcaattggggaaatttaaatctggactgtataatagatgatactgaattaataaccagttttcttaggtgtgatgatgagattcagttatataaaaaatgtacttattcttacatgatacatgccaaaagatttaatggcagtgtcttgatatctgcaacttgttttcaaatgattcagcaaaataaaaaataaagagagagaccgggcaccatggctcacgcctgtaatcccagcactttgggaggcagacccagcactttgggagacagaggtcggcagatcacgaggtcaggagttcgagaccagcctggccaatatggtgaaaccccatctctactaaaaatacaaaaaattagccaggtttggtggtgcacacctgcagtcccagctacttgggaggctgaggcagaagaatcgcttgaatccgggtggtggagattgcagtgagccgagatcgcaccactgcactccagcctgggcgacagagtgagaccccatctcaaaaaaagaaacaaagaaaaaataagtgtggtgaactgtaagtaatcagagaataggtaaaggttacacagatgttcactctactaattatttgccttttctatagatttaggatatttttctcaattaaatgaagagaaagtaaaatataagtcagatagcattatttttctgctcacaaccctccaatcttctctcttcggagtagaaggcaggctgcttaccaaggcctgcaagatcctgtgtgattcccaaagcttacctctctgatttcatctccaggcaaaggaaacagcaagtacaaaacccccatgagtgtgcttggggtgttttagaaacagcaagttgtttacaatttcctacttttaattgatgtttcaaatatcttctacttaaacctttgtgtacacttcttagagaattcctattttgacctcaagtccctgcctactcatttctttctttgtagtagaaacttcagccctaaaagaactcagtcaaagccaaatcatttctcactacccccaaaaaggcctacaaatttgggccaggagaggcaatcctggcaaggaaatttttttaaaaaggtcccagttacactcaaattgggagtttcactaaattgatatcccccttaggatgcttaatgctcagcttcaatcttacctccagggcatatgatattgtatcatatctgagatttagattgctgaggcatttcctatcctaactcagtaggttcttaagattttactttgcagagtttaatccactggggtttttttgtctggttgcttaggctaatgctgcttggtgttctgagcgacctcacttccctgtggccctagagtgtggggtgacctgttgcagatgttagtaatttcctatcttgggtggaggccctcacagaagctttatttgcatatgagtgtatttgcccctgatgttttggtcttggatgtcagcggaattgtccgtccttctgaaggtcatacaataccgctttccagggaggtattataacacagataattgaataattgggccctctctgttttccaaaaggagtgggtttgccacatcttttcttgcaaactagcaaacctagggttaagtagggcttgttggtaaatgtagcgtgtcaggagctcacagccagatatgagccagtaagcaacgtaggtgtcctgggatgacaaaggaggaacatacacacctcagttgtcttgctgattctactctgtgcttccatgtccccttctgtaaaaatgtcaataacactacaataataatagaggtctctcttatgagaaattggttatttagtagacattataaatcaaggtttcaaaaagtattatcgggccatctcaatgttcattgcagttggcatcagtaaagtgaacatggtcaaggtgatattctctaaccatagtaaaataaagggctgaggcattcatttggtgtaaataggacaaacaccagggaggcttggccaggtgtcttttgtagtaaaattgggattctgagattgctgttttccaacttggcaacagccttaaacatcttggtatcctttaatgttatgattccacttctagggatgtctcctaaggaaagagtgctaaatagagaaaaagtgtaaattgtaatggcgacagaaaatagaaacaacctgaatgtccaactgaagggaaaatgtgtaaataaatcatattcactttatagatgattgtacagacttaaaaatttatgcttatgaataatttggtgataacatgaggtatgagagatatgtataaaaagaatacaaaattatacataaatggcaaagttttaaaacaaaatgtcattaaaataacaaaaagatatggatctttgaatgttgaggattgggcatatttttctttctgctcttccatattttttaatttttctttaatgattttatgtcactttttctaacaagaaggataaagcactgattaaaagtgctaagatgagttcttagcaaagaatgattattcctatctaattatgtattaacatttatatgaatcatactaacattatatgactcattttaagataatatattaagaggttcattaaaatgatactttttgagtatataaggaatctttttcttcacatttcaaaacattaactctttctaaaagtccatagtgtgagaggtaaaacactaataatatgtaaactatcagcaattgtacttctcgccataacaactgtatggattgcagacaagaacaaggaaataaataagaaagtccccttgagaagggagagaagacaaaaggaatctactttgtgccaggcaatgtgctacatgctttcataaatgaccttatttaatcctcacaacaactctatgaggcatatatatgtgtgtgtgtgtgtgtgtatatatatatatgataaaataagatatatacacatcttattttaccctagcagcaattctgttagatgaggaaactgaaaattctaatagatgaagaaactgaggttcaaagaagttgcataattggaccaaaggaaaacaactaagaaacaagtccacattctttccactgtcattgtgctttgttgatagactacccctggcccatgctcatagccttagatagcctcatttttaaacagaatttggtcacacttcttagtctggtttcttatcctaagggatgtagtatacacaaacattagaacatgacagaaagaagagaaggaatgctagagcaatagcaatggggaatgaaagctgacaaaagagtaaaccaccaaaacaaaaaaacaaaaacaaaactcaaccctattaaaaagcagcccaggaactcaaaaagcatagctatatagcagtatggaactattttatgacagaatatacaactctatgtcatgctgaggtaatcatcatattcagtactttattttccatatactctgtatgtacacactctgtatacagtatgtatatgtattagggggaatgtaatatataaaaattttttgaacaatgggtattgccactctttcctttaagggttctggcttgatgaagttttgttcattggtttgtcttgctttgctattgtaatacatagaattccagtagaagatctacaaacacaagctgattcttaaactgagaaagcaatatccagagtcagaacttgctttttgcttatctacctaactaaaagctgaagaataaatgaagcagtgactggttattgatacactttgcaacatttcactagaacaacttaaaactggaattgaagcatcaactgaagatttctgtgcaactgtggtttaaattgaatgctgcgctttgtataaacataattttttgtggtttaactttaggctgttctctgcggtcttcccatataatgggaatgcgtcagaagcacagcttcgtttcctgtgtaggctggaaactgttaactgcaaagtttggagacagtctcagagagctcactgccatatgttaaactaaacttgatatgaaaaatcatatcagtttccagtttcccagaacattaaaaagaaaaataaaaaaggagctcaagctttataaatataaaaagcatctgtctgcacaggaaattctactctgttattttgcaaatgatccctacttatatttacaagagaaatcagatctgatgaactatatggaagtaacacattattttgttcaaaattttgaaatatatatttataattctgtacagctggctggactgtgaactaactatcattgtacagagatctcaacagtgctgcccagcatgatcttaaagcatgtatgtttccaagtgaaaggtgatggaatattttgacagcatgctgctaacttaaacatttttgtttaatgtaatttttgtgtctaagtgctcccaaccaccatttccaagacaagaagactcatgagcattcagaaaacatttggcactgtttcattttaattttttacttctccttgactctttgagcctagaaagaattttctctgtagttgctcacccaggtacaagtgtccttgagttaatcttcggtagctcattttagaatccgactgtgactaaagttggattctgtgactgccttcttgcctgcctctccactgtcacctataattttgtcatttcttttgctctgaaccagcttgctatgctaaaagccatcccttcctttcacattttataatcctcataagattaacagccaaaatccatgaccagaactctgaccacgtacagtctacagaggacttcatgctaccttgataataccccgtattttaccagcaaccatctctcagacttgactataaccctctggtgtacctcatcaattcaatgctccagtgtttatccttgatttcattgttttcttgcctcacagaggtacctagagattttttccaacagaatctttctgcctttttcacttaatagcctatctatgccagtattcccaagtaaactccctttaactgtaaagccattaattttttcttctgatttcttcttttctctttcccacctttgtcttgcccagtttttacttattttcattcctctagtaacttaggcctcctcttactctcagttccttttattaccattattttctctaaaatcagattaatatcatatattaataataattagtcatccatcactaagtagtgcccacatttactaacttctctgacttaaaagttgctgtcttatctatgttcttttctttcctagacaacactttggaatagtatcttttctccccctaccttatcacaagaagattaaaatgactcttctagtaacaattacacctaccctctcttatctcgcacactgggaggcacacgccatgggccctccttgatagaggtgaagctaaaccatatccttgtggcaacttataaaaacctcaattgtgtggtttgcctctgcctgttcctgagggcatgcagacataacgaacttctctctcagcctggacctgtgctggaaaagagtttgacgcccactaaaacaggcatttcactgtgaattagaaagcctctggagaagagactttatgtaaatgtgtgttctcagtgtggaattgttcttccatgtttacaattgtttgtgtgtctttttctctgtgccaaatttcaggtgactggagactgattagctggtctgtgctatccttactccactttagccaacacattgcacattcttacctccaaagtggcaaaaaatgcaaatgtgtatcattatgctttattagctttagtaaaaagtttgccatattaaaggttaaaatttttggcaattttttgtactcctcgaatatctaattatttagattaaaataattatataattattctagttacctttcttgaatttaagtcttaaaaaaaaccctgcaagcaaacatttacctatgtaacaaacctgcacatcttgcacatgtaccccagaacttaaaatttaaaaaaaaacctgcaagcaaacctatcccctacatattttctcatacttcatccatacatttaacattataaattcttttaactgtttcttcttaaattactttgcactatgccttcataacattatatgcagatagaaagttgcatattattatgaccaaaggtcatttattatctaacctttcatcttggtgttgatgatggtcagctcattaaattgttcttctcaacctgggagaattaagccctaatgctcttatgaatccattgcacgtgatgagttcacttctctagctttgtacccttgttgtgagaattatgaaaataggcagttgaattattttctccataatgatatagagaaataataatacagagaatgtggaatgttctcaaaaactggttaagaaaggctacattaagaaatatttattaaacttctaatatgagacacccactacactaattgatagaacaaaaaagctttgtaagccataaccctttctcttaaagaatttacattttactttatgagatatgaaataatctgatgaaagatctggaaaataatcaatggaatttgagattgaattatgcagcatcaacttgaaatttgaaagtaaaaaaaactatgtgaacttcatcaataatagaggtcttcaaggagaaggtagatttaagttgaaaccttaatttagatttaaatgaaaattgaaaatagacaatgaattatctatgaattgtgaggaagtgaggaggcattcaggacaaggaagaggaaagccataagacagtaataagcaaatcaggtgatagaaccaagagtcacaagcaaatcatttaaataatccaaatatcaaatttcttaactattaaaaaaatagggaaaatgtcagtctcacagggttgtggcaaagaacaagtttgtgaagataatgtatgtgaaggtactgggaaatatagagacagtaagggctcctggtaaataggataggattcttaggataaagacagcttaggaaggtttttgccatttgcctctttctcattaaaatggcatgcagattattcagcatcctctatgctgtacagcatgaattatttctagaagattaatcaccaaatcaaatgcaaaagcatccttctaccaagttttttcttgtctttgatgaaatcactgggttcactgcttttatcagttttcatttggataatatttaaaatgctcttttatcccaatttgaataccctcaatcaatgtcagcctcttttaatttggtttaagattacaggaaaacatcatgaccctatagatttttccaccacaactattaagaacaatggagccagacatattttaacaacaaaagaacatgaatggagtttgccttttgacttatcatttaagtcctgggtttcagatcatgataaatatttcagaatggggtaatcctggatcatgattataaagtatatcaaggctgcaacacaagtgctgctgggattttttaaagggaaacattcttatgagtcttgaagtctcaatgaagaatggaagatttgaatgagttttcctggatgatcatgattcggttaggtgaaggagtggagaaggcaacaatctgcaggaagaataatcctggaatgtttagaaaatccaggaggggctttactgaaatggaaatctaatactggagaacaatgagaaataaagttggatagttacagttaagttgaatgagtaactaattcagtcaccacacacaccctattttaatttcttaagcatattctgagggtctcaaggacccacaggaaaaaaaaaagcataagtccttttaaaaattgtattatatctacgacatccatataacaaggctgaaattagaatctggatgtgttattttaatatttttaattgtgataaaatacacataatgtaaaatttatcatcttaattatttttaagtacagaactcagtagtgtcaagcacattcacattgttgtgacacaggtctccaaaacattttcatattgcaaatctgcatctctatatccatcaaacagcaattccgtattcctcctgccccgaatccttagcaactactattctgttttatgtctctataaacttgactattccaggtacctcacttaagtggaaccaaacagtatttttcttattgttactggcttatttcacttagcataatatcctcaaggttcattgatgttatcgcatgtgtcagaattttcttcctttttaagactgagtaatattccattgtatgtatatatcacatttggtgtattcattcattcattgatgaacacttaaattgcttccaccttgtggccattgtgaataaaagctgcagtgaacatgggtgtacaaacatctcttcaagaccctgttttcagttgttttaggtatatacccagaagcagaattgctggatcatatggtaattctatcttcaattttttgaagaatcattatactgttttccatagcagctataccactatacattcccaccatcagtgcacagggattccaactttctcacaaccttgccaacacattatttcctgttgctttgatactagctatcctaataagtttgagattattttagtattgccaaatattgtgatttatcctacttgcaagctaaaagttggccagctacaattcatggatgctggaagaaggcatgaggttaaatataaaggacagcaatagcaatagccagaatatcagatatattacctaagaggaactccaactttagagaacccaaatctcacataataggcaataaacctgtctgacttttgccctagaaagtcataatttttattatggtggacaatagacaaacctgacctttgccctggggggagacactatttctgtcttccaaggctgtttactttacaaatatctttaaaaagatagtccagggaaaaaaaggcagtcagtatatttgcttgtaagatttacctaaatgagagacccattgaaagcgtgccataatgagtaacttcacatatttttaacattagtactgcataagaaaacatttattcctataaatcagatatgaatagtaatctataaattgaggtttgcaaaaattaggtttttttaattaaattagatcataatgcaagccctcattctgccataattactagaaatctaacttcagttatctgatcaatggtgagaatttggaagtggtaagggagggaaggtggaggtccactcccaattaaacttttttaaaaactagaaaagttttagtgtctggaaaatgaagtaatatcctgtagccttaaacctattattgtgtttaatatatatgtatccttggcttaaatgagcaagactaataaaatccagaaacagcctcattatttttcctgtgcccatccctataagccaatctgtagggctagttcctcccatctccccagaaaaaaaactcaagtaagcctcaacattttttggttattctcagatactaaaaagttctccagtcactttagttgtgaataagtctcaatttagtaagtaatgtatccaatattatataataatcaaagtactaaatgtaatttaaggttgaaacttttaacccctgccctcatcctacagctctactttactacaaggaaggctcttcaatgggaaaatgaggatgatagactttgtctctatttcctaccttacgcctccagttaacatggttcttaacacatctagggtgaaaatagagggggagtggaggaagaggagaggtaagagccaaagacaaagaaatagggtttgtttgtttttttaacctttattttagattcaggggatatatgtacaagtttgttaactgagtgtatttcctgatgctgaagtttggggttcaaatgatcccatcaaccaggtactgagaataggacccaacagctagtttttcaactcttgcctctctcccttcctcccctctctggcagtccccagtgtctactgctgccatctttatgaccatgagtatccaacgtttagcttccacttataagtgagaatatgtggtatttggttttttgttcctgcattaattcacgtaggataatagcctccagctgcatctatgttgctgcaaaggatatgatttcattgctttccatggctgtgtaatattctgtggtgtccctctttgagtggtacaaagaagtacacagatcaacttaggagacaattcagtagcctgttcaaaataacccactaaatgccaggaagtaacagtttggagacaaatttggttagataggtgacttttcaatttagctttggtttaatcttgagtcttctcagagcctagataaaagcctaagaagaaagcaccacaggattgggtcatgtagtgcatctacagtgtacctagttgtacagacattttctagaggctggtgggtgacctaaggtcaagtagcccatttcttgaccagcttatacttttacagtcatcttatttttcagtgatgaacactctaatatctcctaagtgccctcacctaaccacacaggaaaaagaggaaagaaacgaaatacctgtgaattccaacagccagagtttgtgtcccctgcagtaataaccatttactgtaaccactgtcagttacctttaaaactacagctcttgccaatgactcatcaggcaaagtgccacctcatagcacaaactaatccttggtacccaaaatgccaaagaaatcagatatctcaatgtaaaggagagcaaagcttcagacttgaggggaacctactcacgattctcagggctccatgaggaagacagagtactccaaaaaagaaatcagtggcaccttccctgtgttgttcctcaaagggtatcagagtcaccagaagtctcctttaggtctcttcaggtagccacgagaactctattccctcttagtaatttcccatctcctgaccaccaaatgaaggaggtaggggctagaagagaaacgtatcaagaatgcaaggaaactggatggaagataaacgatggttaaaaggaagaaggaggagcaggaaatggaaagaacagatctgagaggagccagtttgagatcttgttttccaaaaaggccagggaagttccacattatcttcagcaaaaataatgccgacaagaaaggaagcaaacagaagggctgagcatttagttagcatgagtttgagaagcttcaattaactgagaagctcccatgggagaagcaagatccaatacagagaccagagaggccttaaataaattataccctgaatatcaacttccaattaagctcacttctgaccatagagctcttttaaatatcttttcaaaaattatcagatttcggctgggacaaacagcaaatattcttggctctattttctcccattaagccaacaatattgaactaatcttatttaccagagattcacctaagtcacatgaaagtgaaaaacatttgggtttgttactatattttcagcagttttaggtatatttagttaatatgagtgtccatttatctataaggcaatttgaaactcatttaagggattcaacaaataaaataaaccaaaattttaaaccaaaggtatacctaataggtgactcaggacaaaaattaataagccttttatgatttaaccaaggattcacaagtcatctctgcagaggtgcaaaaatgcagccctctcaaggtccagagccacttcccaaagacagccaaaagagaaaaagattcagacaatgctttgagagctggcaatagtaggtatgctagctacacatggggttcaagccacatttttgtctggccatattttgggggccagaccacttttcagttggttcatcatggaagcaggcccaataaaatgcatgccctgacaggcaggaagccaagccaagttctcgggacacgaattgaaacaaacaggaaaacaaaagctgttcatgggagggaaggattagtaacaaattggtaccccaagaccaaaaggcacaattcaaacatttttcgtatagtgactcaaaccaataatactatggaaagttcaattccagagactaagacagcaaagacttccattgccacaggtagtaatgacagtatttatgtaaatggtatctccagtctcccacaaaaaatctgggatgcctccagtcacaaatacagtaatctgtgacaacaggcaaatgatactgggatgggagtttccctttactaaccaagcaatgaggacaaggacttcttataagacaaactcccctgagaattgaaatgatcaaaggaaacctctgggttctaggccattcagctggctgcctgacacaagccaacactttgcactttcctaaaatggaacagagagaatgtcttcaatggtcacaaagccaagatctcaggatataaaacaaaagagaatctcaggatataagacaaaaggagaatctcatccagtttttgactcagttacctacagcaaagttagtttaactaaacagaagtctggtaagaactacaaatccaccagcctgtcaggccagtttgagcaacaaccttagaaagcctatgcctgtgctccttgccctgtgattctgctgtttatgataaacaatacaaaagacagacaacagaaaacaaggcagcatctctgcaagggaagggatcagaaaataagactactcataccaaacaaacaaacaaacaatcaccagattcactatacccagcaactcgtacatacggatgattttctcctgctaacctgaattttggaaagaagagatgagaaaattttaccttccattctccaccagacgacactacaggcagagatccaggagggctgtccttggaaaacaatgtttaccatttctttgctggcttttcatctgttgttccagaatctcatctgcaggctctggagcaagtcaagtgtcccagctgccccacattgggcaccagaactataggaataattgactaaatcactgggcacatgattgagctcggtttccagcccttctcttctttctcatccttctgaggattcaaggatactggtgatatcatttgattcaaagctccaccagtctaatcaaatggtcggtctttctggcagggcctatccccatcccaaatcatttcattagtataagctatctagggccccaccatgaatcatctcactagtataagctatctggacccaccatgaataacaaagaactcctatcatttgggaaatttcagagaactagttttcctctcaagaactagagacaaacactaatcaaattctccattacacaacaatcttcaagtggatgaatgaccaaaggttttttaccacctcccttgcaagacaagtggttcaggatctcactctggaatttaggataattgctattgtcttctggcctcggatgaaaactcagtctaaaacatatttacatatgttgcatatttacatcctcttaatcgtaaattggctaagcctgcatgactgcagaagggccagcagatctgtggcttctatgtgcgtcaggctgggaaaagggcaccttgactaagtttggaaacccagaaatcttggctgtagcctgcacagatgtaccacggggcactcactcaaatgcaaagtcctaccacttactcacggtgctagaagggtggctcaggccacccctcactcacagaactcctgttccaattttagttttacagagtctcacttctctctcctcttcttacctagcaaaataatgtcaaaaaactagatgtaaggagaatgaagttgacaaaacagtttaaagaatcatttcattgcacatggcactgaagaacaaaatgaaatcatttctttaaaaagtattcatcctctgccatggttaatcttacgtgtcagtttggtaaggccatggtactcagatatttgttcaaatattattctaggtgtttctgtgcaggtatttctttagatgagataacatttaaatcagtagcctatgagtaaagcagattaccctccataatgtgggtgggcctcatccaaatatttaaaagccttaatagaaaaagactgacctccccagaagaggaaattctcccagcagattgtgcttggactcaaactgcaactcttctctgtgtctccagccctgcaaatctggggcttaccaagtctctatagtcacaagccaattcctcaaaataaatctctgtctgtctgtctctcattttctctctgtctccctttgtctctctctctctctctacacacacacacacacacacacacacacacacacacacacacatattctctgtctctgttggttctgtttctctagagaaccctaagacatttttaatattgtataacaatatgcaatattaagtatacataatttattagtagaaatgtgctttcattctatgcatcaaaggaatactctgtactatgtacttacttgctgtaagcatgtttgtggtctgcattttcacatgtgccctctgactatgaaagctgcataattacaaactatctccaggcctttccattttccatgaagtggctttttctttattacttaccttttatttctgcattcctactcaactggcaaataaattgaggcacaaatgaataagactttctactttaatttaaggataataaatatgagtcactaaatttttgtacaacatatcctattagtttcttatatttcgttaagagacaccaatgctaaagagacatgtaacagggaatagctgtttaataacatcaaagaatgttaaaatataattgaaatgatgggtacatatgctactgtacattttttaaatgtatattgaatttcaaagaaatatttgatatatgttaccattaattatttaatatggaagaaagcattttacttcatgctgtgtgtatatacaaactaaacacatttttaattgtctatgcatttaaattatttatgaacataagggaagcttaccaaatttagttcactttaacaggaaatcaaatgcactggtgtaataaaatttgtgatgataaatgcttgtaaattaaagccaataagtataagataaagtggtatctaataatatgtatattacacatttattataaattatatatattaattttataacatacatatgatatatgtagatatcattaaaagaaaaaccttagacaaattaaatttaacagtttaattgagcaaagaacaatttgcaaatcaggcagcctcttgagccagggtacattcagagagattccagtgcagccacatggttgaagatttatggacagaaaaaggaaagtgatgtacagaacatggaagtggggtacagaaacagccagattggttggttacagttcagcatttgcctaatttggacatggcttgaatagttggctacctttcattggccaaaactcagtgattgacacaagaatgggtttatttatttacatctccatttacattatagttcactatgtatagagaaccctttaggctgcacttaaagtatgtaaggaggcatatgctttatgctaaacttaacaatttcccctctaaaattaagaggatgaccaaaactttagtcattgatgtcactattaccatcataattttacttatttggtcttgaaacccagtgggaaaacagtgggttttataaagtagaaacaagcacttcaggttattttttgggtaacggtcagaggagagggtacctccttgttttggaatcttctgcttacaggagaaaaacaaaatctggtctgttttaggacctatctacttccttaaagtttcagtttgattgtgtcatatttagcatgagtgactccattttagtttggtctggtctgctggggcctactgtacaaactcagtctaaaacaatggctcccataattttctttaaaaaaattcctccattttgattaacttctctgtattagtcagagttctctagagggacagaactaataagatagatgcatataaaaagggaagtttattaagcagtattaatgcacacgatcacaaggtctcacaataggccgtctgcaagccaaggagcaaggaagccagtttgagtcccaaagctgaaggacttggagtctaatgttcgaggacaggaggcgtccagcacagaaaaaaatgtaggctgagaggctaagccagtctgatctctccacgttgttctgcctgcttttattctgatcacattggcagctgattagattgtgcccactcagattaaagtgggtctgcctttcccagcccactgacttaaatgttaatctcctttggcaacaccttcacagacacacccaggatcaatactttgcatccttcaatccagtcaagttgacactcagtattaaccatcacattctcacttaggtaacggtgtgacaaaacttagggccttagtgccacttcagttaccatcattttgggtttctagtttcagcacatcattcataagtcatcatgtcctcatggtcacacatttctttaagcttttgtcattacagttcaggagagaccatttgacattcttgagatggctgcatgcaaacattcaaaactttttaaagaaaacagcacatgagggagactactattatgaccatgaggaggataataccaagagtttggagtatgctttttagccagagtccccatgaaccaatccaactacaattaaatagatcaaagaattagctagacaaagagtctactcatttcaaccaggtagcctgttcattaatcccctagaaatgaatctctataatacccaatgtattccttcacgtacaactagaagtaccagcaactatacagatacttctgtttagccagcaagtaatctagagcaattcaattatttagcataactttcacaagagaattttaagtctgttgtgtagccagagcttttgcagtagaatctgctacagagcctatcatgagggataaatttctaatcattgcctcatctactcccaaccacagaaagagcgatctaacaaatgatatccatccaaaagagagaagatctcctgtaaaggttttctttaatccatgatgtaccttaagaggagtggaccaatgttctgtttttgattgactatgaaggaacaaggctaacatttgttgttcgtattggtccttcatctttcatctctcaaggcataaggttgtccatgtggaagtttggctgcgaaatcttccacaaataaaagtataccccaagagggcacataagagaccccctttttagctctattgttgttagagacataagcaagaaaaaatgagagattaagagtttcataacagcagacaattcttgatccatgatcttgggaaaaagccatccacatcaatgatgccatcttcttggggagaaacctccctggttagctttaccttaagagttccaatgggcatacatttccaagactgtggaatgacccttctcagttgtgagattatgaagccaagactcaagttcccaaagttttgctgcagtgtggatggcaagagcaatctttctctgatgttgctcccagaagacccagtcttcatattctagattattaaggggttgattgtcctcagtcagtggaccataaaaagctttctttaactggtgaaaatacactttggcctaatgagctactgttacaacatcagccctcttgcctaggaaagcttttatacaaccagaaaacatacattgaaaatgaaaattgaatgaaatccctctataaatgtttaaatggcccatcaggtaacagaaatgtacctgaagtttagattatcttcctaggaatatgggtttaacaaaccaaacattgatcataaactattttagcaatttaggacagttacaccacctataaatatcattaatatatgatatatttattatatattattaatatataatatattaataatttatatattaatttggattcctttatcatttccatgatgaatcatggattgtacagcttttaataatgaaaactttaaagactcagaaaagacaaagcagccatctaagttctccctgagtccacatttaacattggacttatgtcctcttaaatccagttgtttctccgatttaggtgcagagcactgataactaataggctatcgcagataatttgacttgcaccatggggtttattcaaattgcatatctaaacagtagtggctgatttagcatgaaaatctgagaaagtattttcttgatattcaattaatttttgtcttgcttgggttagcagttttaaaaaccagtcagtttctcattagatttctgggaattcttatccaggcttcataatatgatccaaaagttatcacaaacctatatccaagagtgcttaccagggtgctttgaatcctttcatgaacctccttaaaaacacagtaccctaagattctatgtgcttgtgaagttttcaaaaactgcatcagaattaagcaattaactgtagaaatgactttaaatggtcatagttaaagacaattgacaaggaaatttggttatttctttgacctataaaataacttcacataataaccataactgtgtagcatatactgagatatattagaattttagaaatctgatataattttagaacatatattaataatatattcattaaaatataacttttttttgagataagtctcactctgttacccagactagagtgcagtgccacaatcttggctcactgcaacctctgcatcccaggctcaagtgaccctcccaccccagcttcccaagtagctgggaccacaggtacacgccagcatgcctggctaagtttttgtatttttagtagagatggggtttgcccatgttgcccaggctggtcttgaactcctgagctcaggtgctctgcctgtctcagcctctcaaagtgctgggattacaggcatgagccacagcatccagccaataacttgaagaaagttaaacatttcttatttgtcactgcttcccatgtaattcaacatgtcaaataatcctatttatgtcttttttggatgtttcaggagccctctgtagcatcccaaaattgaaggtcaaaaaacacaatactgaagctgaaatttgatttggggaagcctgtcaaatatgtcaaaggtttaaaatacttaacacaaatatgattataagtaaccataaaataatagtcatttttttagccaatgtaataattaaaagattttttaaaaccaaaacctttactctttgatagaggagactcagttttccaaccaaacgacctaagaaagatagcatgagacagaatgtctctcctctcttctattttttatagtttactcaaaggcgaacaaagatattttactgtcatttattaatactccattgaaattttcctcaaaagagaaaaccaaattttatttttagattactgtattatcaatgctaaagctaattgtaataaaacttataactaaatctatgaaatttgtcatctttcgaccacacaagatttccataggtcttttatgttttacatttttccccaacttcctaggtttatgtaattttgcctattttttagtccttcaatttgaaatgtttaaataacttcaaactagataaaaaaaattttaaatacacattttatgtctttattagtttcctcatcaaaagcatatcttgcttttgtttatacattctgtatacagaattgtttcatatctagtagtagtaatataattatatataaactctaatttaactattagaaccctaatttatagtgaaaactctgaaagtaattttgaactgttttatatcagtatttacaaataaaaaccattttataatttttttcaaaagatggttcaagttattgttttttaacagacctaaatatatttagcttttctgtacaatataaaaaaagtcaaggtatatagaattaaactcatgtttaataagtaatatttcagtttttaacttacaaatgattcagatattttatgtctatgtgttaattaatttagcatagtatgtaagatttgaaatgactgaaataaattttgaaactatgacacaggtaccttccctaatgtcttccccagtcatcttgggtcccaagtagccatgtggcatccaggaggactatgaagggtagggcctgtctgagtcctgaatttgcataccaggtatagaggtcaggacagaagacagagctgtgaagactatacctggagaatctaaccactcccgaagtaaccaggaggcaaagctggggcagggaagaaagggccatattgggtttgactttgctgcatagttgctggtctaggcactgaaaacatgtctccagacctcaccatggccacctatgcagacccccaaacccagaggctctgaaccaaaacataagctccacagtcaaatcaagcaagtatcaaattatattcaattgtattttgaagtcattcctattttaccaagaattttaaaacaagttttatttatcaaatattatcacatacgcataatacatatagacctacaaacacacagacagaagcagattttatacctttcttaaaggattctcatttgccagtttttaaagagtttttcttttccccattcagcctatcaatcttccaattacctattttgtcaccctaagccattgttaactaggcaacaaatttgcatttctaaagggaaaactcttaggtgaagcaagaaaatttctatttcaaaagcacagagctaacactttaggcctaaatacagtaccatttgctcaaaccaaggggaaagtggtgtaagtaaaagttaagttagataagacggccagaaaagcaccttaaacagatatatgacttgtgcaaattaaaacaatgggaagagtttctaatgtacataggcagacatcttacaaatggagatttcctttataggtgtgaatttcttttacaaaagggtttcaggaaagccagttaaattccagaaaggtgtattccagtttgataggtggtgatcttttaaacttagctattgtttcttagctaaaattactgagttcaggatggagtccattaaggaatagagcaaagaaagcattctctaggcctggactcagcatggatgggtctgaaaaagcaaggctacttttcccaagggcctacttaatttttgtgggtatatagtaggtgtatatggggtacatgagatgtattgaaacaggaatgcaatgtgtaataattacataatggaaaatgggaattgcatcccctcaagcatttgtgtaaaaaacaattcaattatgctcttttagtaatttaaaaacatacaattaaaatattattgactattgtcaccttgctgtactatcaaatactagtttgatagtaggattgctgaatcatacggtaagcctattttaagttttctgaggaatctccaaactgttctccacagtagttgtactaatttacattcccaccaataatgtatgagggttctcttttctccaattcctcaccagcatttattattgactgtcttttggatataagccattttaactagggtcagataatatctcactgtagttttgatttgcacttctctgatgatcaatgatgttgagcactttttcatatgcctatttgctgtttctataccttcctttgagaaatgtcttttcaaatcctttgcacattttttatcaaattattatattttttcctacagtgctgtttgagctacttatacattccgcttattaatcccttgtcagatggggagtttacaaatattttctcccattctgtgggtagtctcttcactttgttgattgtttccttcactgtgcagaagctttttagcttaatgtgatcccatttgtctatttttggttggttgcctgtgcttgtggggtattactcaagaaattttgcccagatcaatgtcttagagagttccccaatgttttcttgtagtagtttcacagtttgaggtctcaggtttaagtctttaatccattttgatttgatttttttatgtggcgagagataggcatctagtttcattcttctgcatatggatatccagtttttccagcactatttattgaagagattgtcttttccccagtgtatgttcttgacacctttgtcaaaaatgagtttactgtaggtgtatgaatttgtttctgggttctctattctgtttcattgatgtatttgtctgttttaatgccaacaacatgctgttttggttactacagatctgtagtataatttgttttttgtgggtttttttttttgtttttattgtttccactttattgctctagcatggaacttcaggcaagcctggaccttcatcaacatgcaaagaagaggctgagggggtttggggacacaacctggctgagagggaaaactgacaggggaaataccagaacgggggacagggggtggtcaccatgacaccaggagacagcatcagccatgccatctggggtgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccctctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagagctagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcacacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtattccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccgaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcaccccatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttggggcagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcaaattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacccacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaataaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttctttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattacatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatcagggtattattctcactgcagctgaaacagccctccagatgccagcagctttggcagtaggtgtcctctagtgctgactcataaaggtttgaaattttttatatttctggtctttcccccatctctgcagagatgcctttctaggtattttgcttttaattaagtctttatacagtaccttagctgactcttgtatctgggtcagtcttctcatccctgcaaagccctgggaaaactacttcactgaggttatctttgtgacaaactttacttcttaaaatttcttatttcaatcaaaacagatgtggcttgcataggcccagtcaagccctagtatattctctctaataaaggaacagttcatgggtgactttgttaatacttagcaagtgttcattctttagcattgttctttttgtcctttgagtctttactctctacttaaagaactgggtttctgaaccaaattagtactctcaaaatttgtcaacacttcacaaaccccttcattagaggggctgtcttaaaataaataaattttttaaaactgtaaatgtttgaatatttagaaacttaacaacaattaatcactagctttttcaaacccagcatttttaaatcacaaaataaatatatttgtttggtattttgataaccctctccccccagagtgaattcagccttatgagcaaatatagttaattgaaacctcttagtagtgaagctgatctttgtgattacctaaatttaattcattcacatatgagccaaaatcaaattttcatgtaggtcaattttctggaaagtttttgaagttaaacacatttagagatgtttaatttaatgctcttcctatatctattatattgtggagggagtgatttaaaacaaagaagcaaaatgcttcctgctggaaaataaagatgttttcattgcaaaattaatataacctttgtgctatgctgctgcttaaaaaaggatgtctattaattaatcatttttaaatctatcataagaagtaactgtattcattattctgtcactttctaacactaaaggaagaagaacagctgttgtctggcctctaactaactgcaatggggtctttcagaataatacagaaagaacattagaacagcatgagcaagatacacaattcaaaattaatcgaaaattggtgatctgagaactggagatgttctcatgacatgtaaatatttgttcagcagctaaagtaatagcaatgcattaaaccaatagaattacttttgacacctaacagaaatgttaattgatcatcaatctttagctcgtaataaaagggctgaacttgcagttctgaaagtatagccagaaaaattatgtgagagacataaatgttataaaaaagacaaactgctccaagctaaattgctttaaattacattgacctcatcactgtacctttgaaacctgtctctaattgagagcaattgatttacccttccaactttcctttaaagcctatcagatcccaaattctaaatgttaagaaccctttgccaaagtattctgcaattgagctttcctttgagattcttaagtgatgactaaggcacgagccaggtagaaaaacagtactcagtgaatttaaaccttagaaattaaggtgacatcttttgtctccccctggagaaggtgataaagtgaaagaaatttttagcataagaccattgtaattacacaaaaacatgaaagataatagacaccaaaatgagctgtgagagggacaaacatgccaaaatttctaacacctacccacacccagaataaaaatgtcaagttcctggaaattaaggaggatttgtggggaggatttttggaaagagttgtgctgtgtgttgagcatgatcccaccaccctctatccacgggagaacagaggggtcatcgcctgctctgctgctcagctgagctctggcttgagggtcactgagaccatcagagagcttgagaggtgtttcctgcaggagggggacacagtaggttgttgtctgccttacaactaataaatccaaagtatgagagagagattggctaaagtggtatcagaagaagaaataaccacatataagaattatgtgcccttttttccaaagacagatcaaaggctcccaaatcccagggcccaaatgtgcaactcttaaaaggaatattagcctaggatccttttaaaagggaccctgctgggccgggcacggtgtttcacacctgtaatctcagcactttgggaggccaaggcaggtggatcacgaggtcaagagattgagaccatcctggccaacatggtgaaaccccgtctctactaaaaatacaaaaattagctgggtgtggtggcacgcgcctgtagtcccagctactcagaaggctgaggtaggagaatcacttgaacccgggaggcagaggttgcagtgagcctagattgcaccactgcactccagcctggtgacaaagtgagactccatctcaaaaaaaaaaaaaaaaaagcggggggaccctgctcaagagggttcctgataaaagactaggggagtcactggctaccaaaggaagttgtactgatggggcccagaagtgatgactccaaagatctcagatgattttaaacatatgcatatgacagtatcagttgagtaataattccctgcatccttttcactccttcatctccatgtcccagatactaagggatcagaaacctcagtaagcaagtagagtaaaatcacccactggagaacagagcattgatcagactttcttcccagcctctcttgcaaattctctcctgcaccaggtctcaggaggatgagaggagcagatttaatattgcaacaagtttggaatttttattgttctttgaaccaaaagatttaaactactaaatcaagacttaaagctacatggcaactttctgtcacctaagaggttagggaggccattctgcaagggaaaactacccatactgaacaaattttaaagggacagtgggaaaaagaagtaagattgctttagtaataatatcccatgaatcctaattatttaacatatgagctacataattatttttaagattatttcattcattttatattcagatttttataccatgaatatacatagaaatataaaatttctaagaatgaaataaaaagatttttaaatgtcttgctaatcacagtagcctcacattatgattaacagatgtaaatccatatttcaaatactcttcttcaaacttttgaaatttgggagcctactattgttaaatgtgattatatcatcactgttttcatcgcattaggggctgacaagggttcagactagaaggagcacaggggttggctctggcactttcctttccttcacttgtgctttcattattattaacagcattcactatgaaccatggtttcttataatctttttaaggcgcttggactttttgtgatggttagcctaattaaagctagaaagtacagtccgtaaatctgtgtaactaggctctcataaactgccatgtactataatacactgcaagtaaagtgaacgatgtgcctgtgtcaaggagtccccttgaggaactccttctcttccctcaggcttgcccacatcccagaagagggcttagtgagaaacttcagaaggcaacgactcaaagcccctcacttttatggaccccttccacagcttgtttgggaccactgtttctttccattccactttcccttgtatcaaacatccccttaggacaggtagggttggaatagcagcgggcatctttttggatctaattagaagagggatacagttagttgggttcacaatgcaaataaagcatttggaatttgtatgatgacctgatgaaaaaacatgccacaatgtgcattttattaattgttttttataaataaagcagatagaggcagctacagtctggattaaaagtagagaaaggccaggcctcatgcctgtaatcccatcacttagtgggggcaaggtgggnnnnnnnnnnnnnnnnnnnnnnnnnnnnnnnnnnnnnnnnnnnnnnnnnnnnnnnnnnnnnnnnggggcaaggtgggcagagagcttgagcagcccagaagtttgagaccagcctgagcaacatggcgaaaccccatttctacaaaaaaatacaataattagccaggcatggctgtatgcacctgtggtcccagctactggtgaggctaagatggattggtaaattgagcccaggaggctgaggctgcagtgagctgtgatggagacgttgcactccagcctgggtggcaaagcaaggccttgtttttcattcattcttttataaataaataagaaattattatatccaatataatgtttgataatatcatacaacatagcatcaagagtatgctatgaccatttgcagcagaacaatcctacacctttaaagtctacctgatttggacattttttaaaaaaggatgaagggttttctgaatggctgacttattttttctatacatgaggaaagaaccaaatgagctccaaagtataagtatactcacatgccttcctcagaatagatcaaataattataacaggttagccttgggtgcaagaatttcaagacaagtcaaaatatcatattttacccaatctcaggtaacatgtatttcttgggtacttaactatgttgtcagacactatattgaacttttagcatgtattatctcattgaatcctcacatgtaattcatctggagctgttaaagctaacatttgctcccctatagtctgatgaaagactatttttctaccttccttattagtctcttcacatttggtttctttttcatctgcagttcattattgattgcaagctaaatcgtcaaagctaacacaatttccaaataatgcttcccagccagcaagaatcatgcaaaatgaaaagcagtgatttgacatgaagaggacaatttttctcacagctcgaacataaattgtcaccattcatgaactccagtagactgctcttcctttatgatttgttcttattcatgccccaggtgaacaggaataaagcccagggcactgagccagtgtgctgaacccaagacaggtggcacaataagatactagcctttaaaatatgcattcggttggaacctgcaatttcatccacttctaaaaatttttcccaggaatatagtcagataccaactaagatgtatcaatgatgatgaccaatccagtgttgtttacaacaataaaaattatgagcaaactaaaggaccaagagtagaaaactgactaaggacattgtgataattaataagataaattactatttagccattaaatatatatatatatacacattttaaagtatttttaacaatgtataaaatgctaaagatatattgctaagcagcaaacactatgcatcaagttataccatacattaacatacacatacaaaattttatataaaaataatttatacataatttataatatatacttttttatataaatcctatatataagatttttaaatatgaaaacaattcagaatttttttcttttttgacattttctgttttttaccttgactgtataatttttaaaagcaaaaagatcacttatgatatagacttcaattcaacaaatacttttcagtagcctattatgtaattaaattaagtttaacaaacatttctttaatgaaccatacacatgactgtagatataataaagagtacaacctgatccctgctcttgatgagctcacagtttagcaagaggaacgtataacaagtcaaaacaactaatcctaatagttgttatgaaagagcagtggagatacaaagaggaagtagtcacctcaaactggaaaagcaatggtaggtaaagagacaggaaggtattccaggtagaataaaaaacatctaccaatgtatgctgtcatgcacactggaatggaaagtaaaagcaagtaagtgggaaaatatgaagatgaagaagaaggtaggggcattatcatgatggactcttgaagcattaaggtacagactctacagctgcaccagccacatgtgaattgaattcttgaaatgtggctaatcctaattgagatgtactgtaaatataaaacaccacaccagattttgaagacttcatatttaaaaatgagaaataactcattaataatttttatgttgattacatgctgaaatgacatttttgtgtacattgggttaaattaagtatattatttaaattgattttattcaattattattatttttcataatgtggctactaaacatatattttaaattatacacatgactcacagtatgtatctactggacagcattgttctagaggatagattagaggaacacagttctggaaggaggaagaccagttagaaagcttttaaagaacccaggtaagattcaatgaaagattaaaccaggcaagtgcaaatagggatagagaggatccgttggagttataaaagagagtgcattgacaaaacaagtccagttcaataagaaatgaggatctggtaagtgtctggaatgccctcagttttttggcttgataaccataggaacagtagtaaccttagggaaaataaggaatacaaaaggaagaccagatctgtctgtaaagattcattcattcaaatattatttattgagcatctaccatgtgctagttattatttagctggttaggtgctaggaaactagcagtgatgaagcagatgaggtccctgctctcctggagcttacttacactctattacaagcacataaagagctcaatttagccatgtttaaagtgagatggctatggcacattcagataaaaatgtcaactagacatttaagtataaaatttaggagaaagataggaatggtagtttgagatctggggatcattgtggtgattccacctagagacagcatgtaaaaaacaaaaccctgaaaaacactagctatctaaaggtaatgtggagaaggaagaatcagtgaaaaatatagatagaggagaactaggagaaaacagtgtcaaaaaagccaaggaagaataaaattttaagtgtggtcaaccatgttcaatggagtagattggttaacccaatgactaccaagtatccatatgtagctacgaggctattgcttaccttttggaaggcatttttcatgggatggtggggacaaaacccaagtcacaaatggctgaaacatgaatggaggtgaggagtaaagtcagcacctgagtactgttcctttgaagaacttggctgggtaggacagtggctagaaaagataaaatctcaagagagagcctaagatgagagagattgaaatatgttttcgggtatgagggaaggaccgtggagaggactgaaaatagaggaaaacagaggaatatgtgatagactaagatcacatgggagttgaaagtagatgcgatgaaaagcactgggggatatattagtcttgacaacaaaatggaacacctttgcttgacactccaggtgtcaggaggaatttttaaaagacaaatgtgtagaaagaaggacttgaaagagttcctgcctgatgaccagcactccctgttaattaggggatgattagggaaagtagggagagtggaaactgaacagaaggcctccagagagggatgaaagtttaaaatagctgctgaagggaacagaagagcaaggtgacaatgaataaataagaagaatatccagtagtactaaggattccattgagattggggaccatatgcttatgcgctatgaatagctcctattgtgtgtttgttctctaactgtgctgaagagtccatatgtggaagtgaactaattaaatggaagaactggcccaaagtctcatatttgcagagcattgaaagcagaaagatgatttgggaatctgagggtaatcgtagcagagaagttcaaaccattgcagatagaatcttgcctggtagaagaagtgatcagaagcacattgattgatgcaggaaaaaaataagagggttaagaggttggaaggctgtcctgataaggctggtgagctgctagaaagaaattgtaaataagaaatgatgtttctccaaaataacaataatatatcaacaataataaatagctcttcattattaagcaattactatgtggcaggcagtgtattaaaatttttttaactttacatttaattgtaatgacaaccctgtgaggtaattactattattatatcctttttgttttcttttaaacaagtaaattaaagtactgagagtttaaataacttgctaagactgtagagccagtaggtggtggagccctctttcttaatcactgtacaggccaaaggcaaagacataaagatatagtttatttaaaaaggagtaaggtttcacggaaaacagagggaaatggacagtaagaaaataagtggagactagagaagcagagttcagaaagaagagtacacagtgaatggagataaagttagaggagacaagaataaatcattgaggaggcccacaattttaatggtgctaaaagattaccagaatgagtggcattgaaaaaataactgaccctagaatttttcagctttacaaataagattactggagccagctcaaagcacatacaatatattacagacagttcagagaataaagttgaaaggcccatgccagcccccaaggaacttacaatctagagatgaataaaacaagtatgtttaaaaagcacaaaacaagccaggataagaaaatgtcagaaagacaaaactaggggctctagggcttgcatttttaaaaacattgcatttgccttgagagatatgaaacagtggacatgacactcttgaatacataaaattgagctaagtagcaaagtgaggcagcgtatttacagagagaagaaaccgtataaacgaagccgtggagaggcaagtccaaggaatattgtagatcaacaaccaagacaagttggctggtttgccctgagcacagaaggggtacagaagggaagactggaaagataaactgggaccatgtagtgccttaggttgacacactgaactttattcaactcaaaagctaatgaggcacttatgagagggcccgagccagggaattatagtataggaagttcaggcccagagcatcattagaatatcctttctgctcagaattttatacttatttttcagaatgagacgtgctcatgtgatggagtacaatcttgagagtgatggaactcatacattttccacgatgataaaaatgaaacttctggagtttgttcattgccctatataaaaataaactggtttccttactttttctgtaaagagtgtttctggtctggggatctaagtcaaggagaaagaagaacatgaagtaaattacagtacactcttcctttgccacatagcccttaaaacgtcatgaaataaagcaaaagtgaatgtgaaaggcagccttttaaatagagaactcataagttaacatgcatctgagaggtacatggagaaatgaaaaattttgctttggtaaaaaacaagattgacaaatagacacaataaaaaatgataaaggagatatcaccactgaccccacagaaataaaaactatcatcagagaatactataaacacctctacacaaataaactagaaaatctacaagaaatggataaattcctggacacatataccctcccaagactaaaccaggaagaagacgaatccctgaataaaccaataacaagttctgaaattgaggcagtaattaatagcctaccaaccaaaaaaaagcccaagaccagatacacagccgaattctaccagaggtaaaaagaggagctggtatctttccttctgaaactattccaaacaattgaaaagaagggactcctccctaactcattttataagatcagcatcatcccgataccaaaacttggcagagacaaaacaaaaaaagaaaacttcaagccaatatccctgatgaacatcgacatgaaaatcctcagtaaaatactgacaaaccagatccagcagcacatcaaaaagcttatccaccacaatcaagttggcttcatccctgggattcaaggctggttcaacatatgaaaatcaataaatgtaatccatcacataaacagaaccaatgacaaaaaccacatgattatctcaatagatgcagaaaaggccttcaataaaattcaacatccctttatgttaaaaactcccaataaatgaggtatttatggactatacctcaaaataatgagagctatttatgacaaacccacagccaatatcatactgaatgggcaaaagctagaagcatttccttgaaaactggctcaagacaaggatggcctctttcaccactgctattcaacatagtattggaagttcggcccaaggcaatcagccaatagaaagaaataaagggtattcagataggaagagaggaagtcaaattgtctctgtttgtagatggcatgattctatacttagaaaaccccatcgtctcagctccaaactcgttaagctgataagtaacttcagcaaagtctcaggatacaaaatcaatgtgcaaaaaaatcagaagcaatcctatacatcaacaatagacaagcagagagccaaatcatgaatgaactcccattcacaattgctacaaagagaataaaatacctaggaatacaacttacaacaaaggaccctcttcaaggagtactacaaaccactactcaaggaaatcagaggggacaccagcaaatggaaaaacattccatcctcatggataggaagaatcaatatcattaaaatggccatactgcccaaagtaatttatagattcaatgctattcccttcaaactactattgacattcttcacagaattagaaaaagaaatgaattaaaatttcatatggaaccaaaaaagagcccatatagccaagacaatcctaagcaaaaagaacaatgctggaggcatcacgctacctgactgcaaactacattacaaggccacagtaacaaaacagcacggtactagtaccaaaacagacatatagaccaatggaacagaacagcgacctcagaaataacaccatacatctacaaccatctgattatcaacacaactgacaaaaacaaacaatggggaaaggattctctatttaataaatggtgctggaaaaactggctagccatatgcagaaaacagaaactggactccttccttataccttatacaaaactaaagatcgattaaagacttaagtgtaaaatccaaaaccataaaaaccctagaagaaaacctaggcaataccactcaggacacaggcatgagcaaagacttcatgactaaaacaccaaaagcaatggcaacaaaagccaaaattgacaaatgggattataattaaactaaagagcttctgcacagcaaaagaaactatcatcagagtgaacaggcaacctacagaatgcaagaaaatttttgcagtaaatccactacaaggaatttaaacaaatctacaaggaaaaaacaaacatcatcatcaaaaaattggcaaaggatatgaacagacacttctcaaaagaaaacttttatgtggccaacgaacatacaaaaaaaagctcaacatcactgatcattagagaaatgcaaatcaaaaccataatgagataccatctcacactggtgaggttgtggagaaataggaacacttttacactgttggtaggaatgtaaattagttcaaccatagtggaagacagtgtggcaattcctcaaagacctagaaccagaaataccaatgggattgctgggtatatacccacaggagtataaatcattctactataaagacaaatgaacacgtatgtttactgcagcactatttaaaatagcagacacgtggaaccaacccaaatgcccaacaatgatagactagataaagaaaatgtggtacatataaaccatgggatactatacagccataaaaaggaatgagatcatgtccttggcaaggacatgaagctggaagccatcatcttcagcaaactaacacaggaagagaaaaccaaacaccgcatgttctcactcataagaggtagttgaacaatgagaacacatggacacagggaggggaacaacacactgaggccagttaggggatggggggctaggggagggaaagcattagggcaaatagctaatgtatatggggcttaaaacctagatgatgggttgataggcagcaaaccaccatggcaaacgtatacctaggtaacaaacctacacgttctgcacttgtatcccggaacttaaagtaaaattaaaaaaataaaataaacaggattgaagggaattaggagccaaattcacatgtctgtatgaaccagttctctttttagcaatcttctgaacatcaccacacatctgtcagcagtacagaagccctcaaaagtcatggccaagggcacttaccaagctgttttttgtactaaggacaactctaagtgtaggacattgaaatatatttatgaacttaataaaacatgcttgcttttaaaatgtgtttaaaaaggactactacaaagcaaccaatgggtttgataacctgagttagatctttcctatatgaataaaatatatatttctatggaaaataaaagttcctctgggagaactgggtctagccaggctttctcaaactgtattccaatgatccctgcatcaagaccactagggattattaaaatgcaggtaccagggcctcctccagacctaaaaatcagaatctctgagtataaagactggtgatcagaatgttttaaaacttcccagttgatttgtatatatcataaaccttttgaacctatggtcacccagaagcatactaaagcaaaacaaaactggttggctgagagaaagagtttgctgtaaactctcttctaccttctgaattctgactcttttcatgaacaaaacttaaaagaatgagcagcatatttatatttgcaccctgagaatgaagcagagcatctggcaaatagcagaataatcagaaaaatatttgtggatttaaactgagcagcgtggtcatgaaaggcatagtttataataaataacatactttttttcacatccacatttcctctcctcttcccagccttctctaaagaaagagaatacttactgcattgtcaacagcgtttgcaccaggacctgtattttgctttttattcttggtaatgagccatgcatcccccatacctagagcttagtggattcacagggttgatgctagaaagtatagataaagcttcccacacttttctcttagttacactttgacaaacagtatctgtttcctctctcataaagactaatgtatgtggtatttgacatttaccttttccctttttacagaaaaaaattcacagataaccatctggctatacacatctatatctcacagactagaaagaattgtttcagttgttaatcatataaacattatgcctttggcagtttcaaatgatgtgagttttaagcagctaaacagtccttttggtgacaactaattactcatagtgtgtttatagcaaaaattgttttataaatgcaattgtcacttctattgacactttccatctcattggaatctacaagtataataaaaataatttattttgatcaattttccatctaaaaaaaaaaaacaaaaataaaacctcagtcctgaagcactcttaaaattgtaaaagtatcatctttaggaaaagactaatatctgcttctcctgaactagcagccttttcaagccttttctttgtttctttctatgctgtacagaaattgttgtcaggtgaggaattgccaagaagtgaaatgacattataaatgtcataggtcagtacacaggtaaggaagaaagactgtctagaaagcaagctaactttttaaccaaaacattcttgttatatatctgtttttgtcaattatgttccttaatgtgcataccttcctaagaaaaaagtaacaaagaaagagaggttacatgttcagcaaaagatatgcaatattccatgtctatagaaaatattgtgattcatgaaaaaaaaaagttcaaaaagaaattgaaatgtattatgcctgacaaattatactcccttatggccttcaggggcacaaaacaaatctcaggcttgagtacagagtctaaaagggtcataaggtgacatgcgttacaaaaacattaaaccgtcctttagcttatggtgcaccttgcattatattaaagtgggaatataaaaatagaattgaacatttgggaaaagttccacgcttggaggctaagtaggttttcttttacaggactaagttcaacaccttataagtatcaccttaattcttccaaatcaggttcagtttcatgaaaagcaatgttctttactagctcataactcattttgggttccatctgtctttatcagaaagagtagcatttttttactttccatagtcatgcaggtagagagtagctctctgctttaattgtcagaataaaatgttttctgaggttaaaaagtgaattcaaagggatttcgaatgtattagtatcatgaggttatatagtatctctatttcccattttctgtcccatgcagatattattcaagtgaaatatgacacatatagacttactgacaaatctttcataaaaataaagcaagaaatttgaacttactaaccaggttaaaaatacacatttttaaaattgtatttaaaaaaatttttaggagaaaggtgaccagaagtatcatttttctaccttattaagctacactgaaaaatgtggcatgtaaaacaaatgagtaaagaccacctccaacgacattagaaaaaaacttccaaatttaagaatgattttcataagtttctcaatcacctaatgttctgataaattttacaggagaaaaagaggaaatttaagtcacagaattgaagttgctattaaaaaataaccagaagatttaagttttaaagtctcattttttaagaaagacccaaaatggtaaaaggcttagttcccaattccatgactgcattggtctgctggtacagacagctattttaaatcactcacaaaataatttatttgtaaaagttcaaagatttaatatatgttcaggcagagtgaatagaaatgcaaatattcttgatcacaatgaagctttttatgtaaaagcctgcaggatttgttccataggatattactacttcctcttattcatagttgttaagtaattacatttttcttatttattgtgttaaatattaacataactttttctctcatctctgtcacattacctcaatgaattttcttgaatatttctttcagcctcttaatgaatgacctattaaattcattattatgattatagtaaaccattgttactattcattcacatgacattatatattttaggaaagtactattatcacatgaattattttatgatcttttttatagcagcataaacgtcacaatggctttctttgccattaaaaatctcatgcagaagaattcatttgtcaacactaaccagcaaaaattatctgcattcacttaaagctacaaatacccattctacgtctacatcccagaccaatgcagtctaacctgcagagttcaaatttattttattataaaaagtttcctgcactttctgtgattgtctttcaatgcatggattcaatctaggtcaggtgcttccataggaagagtcaattttatctagccaagcattaaagatttttcttaaaggagatgttttatattgggaataatggaactaaggaatgtgaaaaagggcttgagaaatatacaggttgttattcagcatcagtcttattgcaccaacatgggtatacagcagctattgatgttgaatgtatttttttgttatgaaatataagaaaatttcagggaaaaaatgctcaagtcttgctgataacacatcctccagtatgtattaatataatgagggtttgagggacatgtcccaaatccaaaaacacgccatcaactgaaaccctgtgcagactacttaaggaaaaaaactagcatggctgtgattatactgccctctagtgtcaaaataaatgttatttacactgaagttcatttgcttttttcagatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcaggtaaaattaattaaataattgatataaccagttaattccaggaacataattctgtgagatatcccaaatttgaaaagtgaaggcacctgaaaaaacctgcattttggaaatgttagtaaatttgagaaactactccttcctaaactgtagttgtatatcattgctacatattgcacccaattccctgttcccttgcacattggaaattatgggattcggaaagttcagtgacagattcaatgaatataacgtcttcaatcaggagtgagagataaatctacaggttgcaataggctggaagagtagaagatggtaaacaggtcgtttgttagacaggtagcctttgaacacatccccatatctctaatgactaaaccatattaaaggatctctgagaagagttcagaactgacatctgccttctgaaccacgaggtacaccaacagccaacagccactgaatgtggacagctttcaaaagtattaactggggattaatatgggggaaagcatttcatgggaaaatcactgagcttcttaagataaataccacatgaatacagcatattcagatgactctgggggtaacctagatttcaaagcatagactcttatgtatcatagaattgcaggaacaactttgaatttaaattgtccactccatgatctgtgaaaaataataatcttggcaaataattacatattgcttattatatgtcagacggggcacttgacatgtgttaactcatttaatcctcacaactaccttaagtggtaggtacagttatgatttgcattttacagatgaagaaactgaagcacagaaaggctgagtcaattaagcaaggtcacacagctagtgtgttgcagagcaggaatcagttgtaggccatctggttccaaaagctgtacttcttaatcactgttctaaacgctactagagttacagacagagctgatggtaaaacaataacaatcatcagaagtagaactcagtaactttttaccacagattgaagttgttaactctgaactttatactcaatgcattcagctttcaaccgtaagttaattacctcctgagcacacacagatgactccaagagacataactgcatatttagcaggttaaagttggtggttgtggacttatgactgcatattacttttccgttgttttaacaagcatcttttcattttaaccaccacgaaacatcaccaaatgttagccaatggaaagacatgcaattttcctgctaattcaaccttacttttaaactgaaatcattatttcaggtgacaagttttaaactgtttttttgttttttttttcagaagaacagccaaaaagaatactctcactttagtcttaacatctgttgcttattaaaaataagcagaagtcttatttaacttcacatacctatggtattaattgactagaaataaaaaagtggtactgtttgcccattcctgaaataatattaaagggtactgtaattcttcctccttttctacataatatatactttgttcttaaaatgaagggtgttctaaataggacttgtgcagtggatgttggtgttaaatattatagaccaaaagcagaatccctaaggtagtaattcaccctcattattcccttttgctaaaacttaggactttctagcatcatagtctataaagttacatttttagatatacatttatcaacctttgacggcagctgagacgtatctgctgtctctttagatagtagtattttggccagatccctatccctttgaagcacagctggaaagctcaaagttacttagaataaagatctgacaacttacatttcagttatgtattgaatactgagtgtatcatcttttaggttagcaggaagcataatctctgcccagtaagctaactattaaaaaaaatagaactgctagtagccaattaaactcttcatgctatgagactgtttacccaaagtggaaatactgcctctctccagcctgctctgtagactctcaacctcaacatggaagggagttattcagaacttccatgatgccacttcagggctttcatttttttaaaagagtctattttttatcccagcgtttcctggtatacttttaaagaacacaagttggaaaagctggcacacaatggacacattcatgaaaaaaaatacatctctatgttcttctcccatttagaatccttgcgatgacaaacgccacagagacatttggtctaaagaaaaaacttgtgatcgcttaccaaaattcttggtaataggaccccagaaaactggtgagaactttttatgttatgattaacgagtgtaaattttctgatgactagacaatgagatcttgtcacaataagttcgtaaacttcccataactgctaatgaatgaataacatgtttttctctgacataattttcatttagcccagtaatatacctaaatgcttatcgaagtgttttttaagtgaagggaataaaacagatgtcacactgttcaaatatccagcagtcaatttggtagcacatgttttttttttttcccccaaatgttttaattgaaaagtattgtaattaacacttctaaaatcaaagctgatcactgacaggattgtatcaaaagtcaagagggacacagataagtacctataactctttataataaatcccttctagaaaaatagtcccttaggctgccattttcctaatattgtttatttgtaaactatttcttgcagagatgactattttttaaaagtctaaaagatatttcacaagcagaattcctagacatacacaaaactttgtgctaagaaaggtgtttattcatacccaggagaaatcttttgcaccttttcttaaattgatgtgcaatttttttcaccataaacttctttatcaccataaactttttttttttttttttttgagacggagtctcgctctgtcacccaggctggagtgcagtggcatgatctcagctcactgcaaactccgcctcccgggttcacgccattctcctgcctcagcctcccgagtagctggggctacaggcgcctgccaccatgcccggctaatttttttgtatttttagtagagacagggtttcaccgtgttagccaggatggtctcgatctcctgacctcgtgatccgcccgcctcggcctcccaaagtgctgggattacaggcgtgagccactgtacccggtctataaacttcttgtttctaagaatcagtattaaaatgaagcatcatggaagctttaaactaccagacattcatgctatatcctgcatgataaattatttggggcccttggttactggcttcacagaaaacagcctttacaatcatattgcttgctaaggagaatacattccctctcctcattgatccagaaataactgaggaaaattctgtgcaatgtacacagggagttcagcatgttcatttttttccttaatgtcatttgcagatatcaatctgaaaacaataataaacatgacaaatacttacatttttcttgtccttatttatttcacttgtccttatctatctaaagtcaaaaggcaactaggaaaacatttaaactaaactctcttcagtgaactcccagtcatcacataaccttgtcaagactgataacatcctgaaggcttggtagcattttgctttagaaagtcctgcaggattcgcttcctctcgtgttgtgctggatatgcagacattttgatatcatggttagatggtagaattattacttgtcctcttaaactgaattgggtttccaaatgtttgttacaatttggatatggcatttgtcgttggaaaagaccttttatagaaattgattcttttttatagaaattgatttttcccagttttgttgaatataatttacatgcaataaaatccacccattttaaatgtacaattagctgaattttgaacattgcacacagttatgtccaccaccacattcaaaatacagaacagttgttagcctaaaaaaatttctccttgttcctttgcagtctatcccccccgatccccaccacatccccagccacaagcaactactttgtaccactacagttttgccttttctagaacttcacataaatggaagcatgtattccgtgtagtcttttgtaactgacatctttcatttagcataatacttttgagattcatgttgctgtatatatccatattttgtgaaattgattttttaattaaagtagtttctcatatcagttacatgagaattaaatagcttcatttttaactgtacttttgtcaaaagtatttttctgggccaggcgtggtggctcatgcctgtaatcccagcactttgggagaccaaggcgggtggatcacctgaggtcaggagttcgacaccaccctgaccaatatggtgaaaacccgtcactactaaaaatacaaaaactagccaggcgtggtggcgtgcacctgtagtcccaggtactcaggaggctgagacaggagaattgcttgaacctgggaggcagatgttgcagtaagccaagatcgcatcactgcactccagcctggacaacagagtggactccatctcaaaaaataaaaagtatttttctggataattttgcagatttctagttatctggatattcaagtatttttcagtgttgaggctgacaaaaatataaaaccgaagatttatagatggttatttaaatgtgtgtctatgattatgtagttgagttaccactgacaaaatatatatgcaggacagtttattcagacccaagaatatgtacaggtaaagacagaattcagaaaccacaacttaacaattttttaacacttataaattcattatgccttttactgactatgcaaaataattagattacatccattttttctgtttgtctaatgctggtcatgaaaggctattaaaagtgaacaaatgtatttaatacaattcttaaaaataagattcagaaaagaatgttttcagttgatctaagaaaggaattaatctctctgctttttttctcacattataatggcaatacttatttccaaaaagatatttttaactttaaaaatgcctcatgcatttttctggattatatctcatgtatgtaattgagattcaaatgtatttaatgtatttatttattgtaattctaagttatatctcaataaagtttttatctggaaaaatgccttttaaatattgagatatggcactctttaggtgatttcacctaggttacctcgctaatcctcataaaacactgatagctaagtattttcttccccactacacagatggaaaaactaagactcaagagaggttaaataatttttgttcaaattcacacagctggtaagtacaagaataaaaatcttggtcctagaatttacctgacttcaaaaaacatgctttttctactttaccgtggatttcatgtaatggagcttttttcctccaataaattttagatattgcttcatagttattctaagtcagtgattctcaagggtggttgccagagcagcaacataagcatcaccagaaaatttattagaagtgcaggccaggcacggtggctcacgcctgtaatcccagcactttgggaggccgaggcgggcagatcatgagaggtcaggagatcgagaccatcctggctaacacggtgaaatcccgtctccactaaaaatacaaaaatttagccgggtgcggtggcgggcgcctgtagtcccagctactcaagaggctgaggaaggagaatggcgtgaacccggcgggcggagcttgcagtgagccgagatcacgccgctgcactctagcctgggcaacagagcgagactccgtttcaaaaaaaaaaaaaagaagtgaaattcttgggttataacaaagacttaccgaatcagagatactgggatagggctgtgctatgttttaacaagcccccagatgaatctgatacatgctagttagaggaccactgttttaaggcaagcttgtgaagcacatttttactttgtatatcatagattactgttttattccctataatgatctatgattacagacaaactgttcattgtttggctcagatataatctaggaagactacctctttcaattcattttttaagacaatattgctgttgacagagttattttaacaatttttctattgtatagatatggtagatttaagtaaatattaaagaaagcttaatttataaatacttaaatagtatttatttacttaaatattgccatatttgtaccatttaagtaaataaacactaaaatactaccttacttccatattaatactatttaagggcggggcacagtggctcatgcctgtgatcccagcactttgggaggctgaggtgggcggatcacctgaggtcaggagttcgagaccagcctggccaacatggtgaaaccccgtctctactaaaaatacaaaaattagctgggcatggtggcaggtgcctgtaatcccagctgcttgtgaggctgaggcatgagaatcgcttgagcccaggaggcagaggttgcagtgagcccagatcgtgccactgcactccagcctgggcaacagagcaagactccatctaaaaaaaaaaaataaataataataataatactatttaagtaaatactagcatattaatgctatttaagtaaatactatactatcatattaatactatttatactactattatttaattagtactattaataataccatattaataccatttaagtaaataaataataaagaaagcttacctgaaaaataagaaaattcaaagttttgtacaaatggcaacatgacataattactaagcataattagagtaatttctccaagtgagagaaatattataaggccatgtcttgttactattgctagctattgacttggaatataattatcaagtcctgctccacagattgtataacagtgtaaataatagtatatttctctcttaggagtagccaatatatagaaatacttttatattatgatcttttaaacacagtcacagttacaagtattaaatacatggctaaatctttgacaaactgaacccaaactgccttactttctcttgtaccaatctgactaagctacaccctttatctcctcatttagtcttataaaaccctaactgtacagtttatgacattgctcactttttgaaaaatcacacccttgctccccaatagtcacaaatatatatacgtacctgtgatacaccattctcttccctagtaaatgcaaattctataagttatgtcgctaagaaagggcaccatttttttttccaatttagcaatttaaacaatttttgacactactaagtacattgaagcttaagcaaacttgtggaaagattaaattctgtcttgagtttaattagctttcataggcctctggaagaacttaatatgagaacccaagtattgattttggtaatgtaatatgttaaataataatatatttcatttatatagtgccttattaccgtcaaaatgtcttcaagtacatgttctttcattctcagagaaaatctatgaaataagtaggcaggtgattttccattaagaaagctgagacaggtcaggagaggtgactcactcctgtaatcccagcactttagggggccaaggtggaaggattgcatgagctcaagtgttcaagactagcctgagcaacacagtgagacctcatttctactaaaaattaaaaaaaaattaaaaattagcccggcacagtggtgcatctctgtagtcacagctacttgggaggctcagacaggaggatcccacgagcctggtgtcaaggttgtagtgagccatgattgcaccaccacactccagcctgggcaatatagtaagatgctgaaaaaaaaagaaagaaagagagagaaagaaggaaagaaagaaaagaaaaggaaagaaacaaagaaagaaagaaaagataaaaagaaaactgagacaaacagaagctaaaagacaaagtcacagacaaatcagtcattgagctgagattgaaagccagttctctcaatccctgcaacaggcctcttttcacaccacactatctccattttttagaacctgcttctattaaactgccgattatctattcaatttatttccagcagtagttgtaataaatctgtttggatcattctaatatttattcatgactttaaagtgttgatcataggaaattgtgttttcatttaattaatttctgaacctctattgtctttctaggtaccactgctttgtatttgttcctggttatgcatccttccatccttagtaactcccccagcccaaaaacctttgaggaggtacagttctttaatagaaataactaccacagggggattgattggtaagatgggttattagtataaatctaaaagtatatgtactgtgcacagtataaacttagcactaatatttagaaacatctaagtttgtagtcacaaataaaatttaacctctgtgccttggaaattgattgaatatcataaaggggctcagaaatttttcagaacaaactcttctcagtttataaagagacttgttataccaagaggatcacatgtaatttcaattggcattaattttctttgatggtaattatagatattaagtcagaagaatagcataatattcagaaatttaattcctttctactcgtaaggaaaaaaaattttcatatatttttcttcttgtgcactttttatgaagtgatgctacagccaacatatgtaattttctattttctttgtcacataaaaggaaaaataaataaataaaactagaaatgtttgtatattacatgagtaatcaaagctataaaaaaaactatcaacaatacacagaatttaattcttgcctttgaatcaaaattagaaatatatcaaccatctgaacaaacacttaaaaactaaaaatgtcagaatacacaaaatacagtaatgtagtagagatagatggtacaaactaacatgttaaccataaaatgtctctgaaggtcttgctatgaaggtataatgctgaacagagggtggtataaaggagtgaattataataattctgcagcataaatatattttgcatgtattttagcatagtcatatatatctcttgtcaaactgcatgatctcaattttataattatcagccccctgaggagctgcttatgagaagtccgaatggaaaggaaaagaaatggattgagtataatttgagcacctactaggatttacatatattctaattgttatatatttcactgccaatttttcagttcagggtttgatattgattaattgtgtggtgttacataacagctggaaaatcaagaaaccatcgacagtggccaggcacagtggctcacatgtgtaatcccagcattttgggaggctaaagtgggtggatcacatgaagtcaggagtttgagactagcctgggcaacatagcaagaccccatctctaacaaaaatacaagaattagccaggcatggtggtgtacacctgtggtctcagctaatttgggaggctgagatgggaggataacctgagcccatggaggttgaggctgcaatgagctgtgattgcaccactgcactccagcctgagtgacagagtgagaccctctctcaaaaaaagaaaagaaagaaaccatcgactacttcagctgtatttgatcactgactcaaatatacatgccagtatataattatagaataaaatgatattaacatcaggactaaaaggactgaataaaaactgctttggaggtggacaggaatgtattagtattacattcctgtcaataattggattccctaggatgttttttcaaagaacatatttttgaaaaatttatggtaaaaaattattgcaacagttattcttaattttttaccataaattttacaaaaatatattttgatcatcatgtggctaggtactctaataggaacaaaaagtccagctgggcacactggctcacacctgtaatcccagcactttgggaggctgaggcgggcagatcacctgagctcaggagttccagaccagcctggccaacatggcaaaaccccgtctctactaaaaatacaaaaattagctgggcttgttggcaggtgcctgtaattcgagctactcaggaggatgaagcaggagaatcacttgaacctgggaggcagaggttgcaatgagtcaagatcgtgccattgtactccagcctgggtgacagaaggagactccatcaaaaaaaaaagaaaaaaaaaggaaggaaggaaggaaagaaggaaggaaggaaggactgactcagggttgacccaaataacaaataaatgtggagtattgcaaaaaaaatcccatttttcaggtaaaagaaaatgctgaagttttatgttttatagaagtagaaaaacttaagggaggcaggcatttgcttttaaccctgaattgttaaaacactccagtttgttcactaattctttgaataacctgaatttacattctataaatgtgagcctatttgtggagcttcaaggtctcatactaaaaatatgaaccttttatttacttctctattaatcgaacatctttcaaatgcctgtaagtgccagccactacactagaaaaatgcggacatataggcaaacaagagctgtgccctgccctctccatgagcccctggggcctggcaaaatcaacacattataggtccaagatccagacttgcttgaggaggttttcaaagcctaaactgttccagatacaaaagacttctaggaaggtatggcaggtttaagaagctaaaatttctgctcttttgtgtgatttttgaagcctttttcagaacaagcaagtttgagtcaagcttggaccaaataagataccactagacacttgaaataatcttagcactcctggaaccagtgtgagcttctacataagaagcatcctgaaagttggcactctccgtaaatagaatgtacaccagaacaaatagcacatcaaaccttccagaaatttttgtatatctctttctccctaaaagggtgccagaattacatatcaccaacaagccaattccagacaacataaaaggatttctttactgctctgaatctcaagatatcactgtgttgcaccagctaagctttgcaatatgttaacaactggaatcctaccagaagctttatcatgtttgaggatatgatctcagtcaaaaatctatgaacatctcatgtgatcttttggtcaaaagaaaacaagacactgtaaaaaaaaacaggtcattgcatgaatattaatgacttttttattcagtaattattgaactaccttgtcttggtagcccagtgtgataatggcttatgaattgaagggggtggcaatggaggctgagaatccctagaagctatatttttacagtcactctaaaaaatcccttttcctctaaaggatgttccttagtgcttcagatatatttcttatcatatgctgaattagttacatttgacaacttttattcaggtggaacattaaataaaattctacatttcagtgcttgaacctatagatatccctgtgttcattctgctggtaatttgaattctctctacccatgaggatatagaacatgaccttgggaaatttgttagagttttatatttggaatgtacatagtttttaaacttctcttacaattattctaaagaggaacataagtggctctatatgagaaaaattaagcaaataagcaatatttataccagatatactctgcatctttcacactatgtgattaaacgtaacaccggcacaatacatttgtagaaaagaaattatttcacttgcaataaagtaaaaaatattttctctaaatccttttaaaatgtctgaactgaacatatcgtctgttttaatacgattttctttttgagtacttgaatttttctctgtacagtgtttctacattgagacacatttgatatagttaggtcgatcactgttgcagtttgatcactctgtgtctacatttttgttattgcttatattttttcctgatattaagcaaaacataaagaaaatgtacttagaaaaacatcttccaaacacattattagtgttctagatatttttctcttcctaactatggaggacaaatgctgtaaagaaaaagccttttatttaggaaacacatgaatttgtgggacacttttaacatctttggtcaccagaatgagtataaaccagaatcttattttgagaaaaatattccttttctaggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccaggtaaggaaaatgcaaataaaatccaacagggagaagtggagtatggacaatggagcattgtttttagcaatacccactagctcaggttttcacaaaagagatttgctagttgtttgatatctacagaaaaatggacaagtttttcttgatttctattgagaaatttcctccactaagtttttgttcttattttattaacttaatcaattaatttaataaaatgtattaatgcaataaaagaaactaaaatataacaaaatattatgtacttttttatatctatgcttctatatatctgcattttaaggtaataatttaaaatcattattttttcatctaatacttgtgtactctataaagagtcagattgcaacaagttcagacattgaggtttatacagtctccattgcaactctaccattgtatttcgaaagcagccatagacaatatgtaaatgcataagcattcctgtgttccaataaaactttactgaataggcagtaggccatagattgctgaccctggctctaaaacagcttaaatagctacttgtactaaagaaacagcttagtggcaaaactaatatatataagaatctttaggctgggcgtggtggctcatgcctgtaatccaagcattttggaaggtgggaagattgtttgagcccagttcaggtgggaagactgtttgagcccaggagttcaagaccagcctgggcaacatagggagactctgtctctacaaataaagaaaattagccaggcatggtggcacacatatgtggtcccagctacttggaaggctaaagtgggaggattgcctgagcctgggaggttggggctgcagtgagctgtgattgcagcatgtactgtgcagagggagactctgtcaaaagaagagagagagagagagagagagagaaagagaaaagaaagaaagaaagaaagaaagaaagaaagaaagaaagaaagaaagaaagaaagaaagaaagaaagaaaaagaaagaagaaaaaaagaaagaaaattctacatccctgagagcctaacatgtctaaatgtttcttgtatactcattgccattgttttctgatgttggttagaaccttgcacaaaaacgatcactttgaaataatttaacaaactctagtaataatatatatgtcaaatacacttttaataaatcattgcaaataggaaacaatcttttaaaacttgtttcggtgataatttaaccaccagttggaagggtttaatatgaagcagtcaaaattaacataagaacatagtaaaattaatagagtcaatgtctttagtctctaggacccttagttctcatttctcagttttgtaacttaaaaaatgctttcctactgttcatgtgtttatccgttcatcaagtaattttaatgactaccatgtgcaaagttttgttctaagtgtgatttgaaaaataaatttgatgctatacttgaaattgctttcagcctaattggagaaatatgtataaacaagcatataaattagaaagtaataagcgactgacatacagactccttcggaatgacaaagcccacctgacaaagaccacctgggaaaggctgtcgcagagaagcccaaataccagaaccatggggcactttcttaaataagggaaagatacgtaaggggatacatttaggcaaaattaaaatgaagaagtgttttcataggtgcaaagcagagctgtgtaaaggagttatcatcaggtcagtgctgaaaagcagactgagggtcctattttcttggaaacaaaaatgttaagacaaacgtggaatgttctatgtacaaaaacctctaatctgaagtctgcaaataggctggatatatgactgcttccctgtgttaaagtgacccacatagcttagatcctccctacaagagtgggatgttccattcttattgatttgatttaaaacagctaagttcttgacaatcataatattagagaataaagttgctcattactgagtccttttgctacttaacaaaagcagtttttgaagttcacaagaggaagaacagattgttggaaaaggttttgtggcaggaacatagtagggaaaggtcataaaagcagatgaaatcttagggattttgataataatctgaaaaatagcgagtggagacatcctggaaagctaagatccataaaaatccaccattctatactaatcattcacgccaaacctgaagccatcttttaaatcaaaacatacagcaaattgcaaattgcctgatttgattttgcaacttctaccttttccaccaagtatctggagaaaagagaaataagccttaattgactccaagaaaaagaagaaaattggagcttggcaaccacttagtccctgaaaaatagagaatttacagaaaaagaaggctttaaggctgcaagctaacaaaatgtcctaaatattacaaataaatcacagtggcaaaatgcaggccttaacaaagtctagtagagtttgtagtccagtgatttgaatctcaattgcagaaaatttgctattcaactagatgaggtaaacatccacaaactcaccactaagcctgaatatttattggccaatttaaagaaaaggtgatttcctcaaacccatgggcctaagcctgagcaatcctgttggattgctgctttctgcattttctgcacaataaatgattctgattcaccgcaaaggttaccattagataaaataatcttggcttttagatatcagggaatgtatgataaaagctgtggatttcagataatgtacatgtcagactttctagtactttcttcatttaaaagagctgataggccttttctaatctaaaactgcattactagatggagcaaaactatttggcagaggtagtagggtgcttctctattatagatattcactggacactataaatggtttgcttatgagctggaaagagggcattaacacagctttcaaaagtttactttcacaataaaatacatacactaaggaaacaactcagtaatgctggtgaaggaatcctatcgataggaattcaacttctaccagataaattctcaaaaatttactcccataagtatcataactttaaatcctgatgctccaagcaaacattttcttcctttactaatttcaaaatagataactctccagcagtgaggcacttctttctttagctttgagacttgtcacaaagattggtttttaattatttatgcctacggttcagattagtttaattatccaccttttcatcatagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcaggtatggagtaataaggatttacatcatgttagaatctcattaagttgatgactttgccttaaggttaagaaaattttcaattgttaaactattactagtttttcctctttagttgtaaataatgaggctatggcaaagagaaataggcagaagtagaaaaactttaattttctaagagtatttcagaataattctccctgctctatttgctgtgcgtacctttcctgattgtaaaaagctttgaaagctttagatacgattcttatcctgagaataaagtttgaaagagaacctcttaaccaaacaagacaaataatgttttgcttaattaagtgccattatttcctttttgaaccaccttgctgaatttttgataagtcctatgtttttctcagccccttgaatttcttctgcctggcatcaacctagattgcaaaatcagcccctcatgggatcatgtaagcaatccagacacatcagacatggtatatacctgtgagtctagagccatgctttccagtatgacagccactaccacatatggctattttaatttatattaaaatcaaataaaatgaaaagttcagttcctttagccacattttaagtgttcaatagctaaatgttagacccagcagctatagaacatgttcatcatcacagaaagttctattgaacagtgctggtctaggctaaacagaaatatcagagaagaggtatggatagacaagacctgctttgcaggctttgtggcctttaatcctggtctcctctcatcttgctgggtccaccctccttggcataacaagcaacttcttctccttagtttcttgaggaactttgtccatgttcaagtttcctgagaatctaaccttattctccatatggattatcgaaatatttcttcaaacctgacagtgctattcctgaaaggaatcgtgaggaatgacatgttctctgtcagattacatctgagtttattataacctttcttcttttctattgtactttccagcttgaatgacaggatcactgctttgtctgttttgaaagttggtttccatttgtgattttctagtcacttttctaagctctcttggtctttcaactgccttttttgttttcatagtgtgacttctcagactgcaaacctgagtgtacttaattggtgtgatttatttcttattccaggtcattaatgaggatgacctggattctatctaacaccaatgcatgcaattctgctcaggacagtgtctctcactgaatgagtttagaatgcagaaatttttcattatacagtttacatgtcttttttcaatgtgcatttttttatttgataatttagttgctaattattgatgggcaacaactaagaactgatcctgctacagtgatggatgaagtacagaagtttctaggagtcttgcctcattataattactcagaagctttaacgtaagtttatattctaattagtttattgacatttcagcagagaattgatttcaaagaaattgcagtttggtcatacaactgtcaggttacttgttccttatatactggttatttttcaatttgacattaaccacggaaaaaaaaaacatttcaacagtgtgacacagaaatgtcctaaatcctgtgttaattcctaattgtacaaagatttccctgaaaggaaagtagagaaataaaacagtggtaaatcttaaaacaaaccacaaaccttaaaagaagttatctgaaataaattcgtaaagcctgagcctatttaacaggcaatatggggcttcttggaagtatgaacaggtgagtaactaggtagtttaggaactgactcttctctcatttgtgtaattttcagaaacaatgtcatacagcaagaaatagtccataggtgattgaataagcagagagagatgtactattatcgctcccaaacaaacgtccttttttattttttcatctttgtctttatccactatttgaccctgtcatctctgcttcagagtcctcagcagttaaagcactggtttgatttttctgtttgtttgtatggttttttgctggtttcctccgattttcttaggtaactgactctgtaaggtccatgaccagggaccagtaaggaactagggctgaagaaggcagtcactctcggaggtgtgcccatgcctgagactgagtgctgtgtcctaggtgcctctcttacctcaccctagtgctgactctgggcttcacttagcatttttgaagaagacctctatcttactgcgtccatttagaatagttggcaatcagatttaggagaattatatttgttcctaccacatgtgtagagcaactggaagatactgagttggattgggtcatggacctgactcacaccgtaagttggtttttttttaattacatggactgagccttaaaaaaaaactgaaaaagactatcatggaatttttccattgtgtttttcagtataaaactcagttccacagatcgagtagttttccctttttttgtactctttaatatcaatttagaaagtgagaggcaggtttcctttacctttcaacaaactttgcaggaaaaaaagattagcaggaaaacatcaaatactgcttatatctcctacaaatcaaatatagagacacgtaagggaggcattttgctgtagaggacaaaggagtaggtggaactctgcagttttgagcttccttcctaagagtcatttatactttgctgttattattaaccttctgacctctgtgttttctatactatgagtactgtcagagttttgtatagcttagttcaagtactaacacagacactggccttaggtatttaacattcaacttgaccttaaagaaagctgagtgatttcagtttgcacttaaaaattcaagaccattttctgttctgtatctttttaagcatctcttggaaaagaaagcttttattttctaaacagttttctatttcaagttaggttatctgtgggtcttttttatagagtatgtagcaaagcattgtatttcagaaaaaaagaagtacagtattctataaagacagagttgctttttcttatgggatggtccttgacctgcatgctgtgtatttgtcccctctgcagccagctcagcagcaagctttttattcatctccactgctgagaaaaggcagtgtaaacttaagagaatatcaaagcaacatactatatacaaagaaccgtagtccgtttgcacctgagctgtatctagctaaaattactgattatatgattctctaacctggttgggggctcagtgggtgaaatagcaagataagatatgtgtagtccctgaaaccacagtttctattccagcagtgccacccaggctctcaccctgcaggtggagatactgtgtttccattccatttctttttatattttcttgtcaatcatcaattggcctgacataccttgtaaaacctggcagtgcactagttgtagaatatttggaagtttcatgtcattgtcttgggtctaaattgatcatccttcaccctatgccctttgtagttgtttatctgaaacctgtcttcacaatttagttactcctattagagtaactatactgatagctgtttctgtagtgctttggaaatactgaggatgactagaggtacaaaatatatatcgtcagaaatgccatttataccagtttgtatactttgtacactttggtattgcttcttattttttcttcttattttcctgctggtgataatgacgactatctcattggtgcttaaaattttttttttctcattggaagtcctctaaggatatagtaaactgtaaaccaatatgaattctcaactaactacataaatctagtgctttgcatgtagtagaataaatgaatgaagcaaggtctatacaaatgttttgctatgcaatcttggcgtgaaagagtactccaatttaagatatctctaaacttattatcttccatatagcaaatttcagcatcaaaactattttcaagaagaatcacaataagcccccaatgtcaagattgttgtttattcttttccacaagtgctaaagaaagcgttcaagacttttaaagatatacaaagtcactgaagaatctgtgatgtcttaaaatgacttattactgttatcatgggtgttaaatgacatatttaatgttaaataatctgattttctcagtgattgtgtgaatgaaataagcaaaataagctttaaaaatataaataagaactttctcattcaatcaagtaaattataatttacaactcttgttccacatacccttaatccctaaatgggattaatatattaacattactttagtttttgtgttacatgttatatagtgttttgaagcaatcatttgaaataagacaggaaaaacaatgcttagcatggaattgtactaatttgtatacactaaaatgaaaaatatgaacttttagttttgccatgaatacatctgttcacaataatacctagccatcaatgccaatgacagatgtcttcatgtttagaaatactagttagctaaatacctgaacctggcatctttatgtctcagtcagttaacctatttgtcaagatgaatgaaaccagactatgttatatgaatttttagtattaatttactttgaaaatgtcaataaatgggcaatgagaagttgaaagccgagagttgagtatagttgtttgtttgttttgtggacagaggttagctaagtcacgaaggactgaagctgcttcaaaattcagaaggacttcaatagcttttaatataacttccttggcaacgaaatttatattgcccgggaattgttttcctacccactgtagataaattttagtacaaatgtactacactaaaactttcttattagcaaattatagtagccacagtaactaaaatctgctggttctctggatggcatgaaagaacacctagaaatgctgagtagggaaaagaaaaaaatagtctattctaatttcttattataaatttttaagtggttgtaacagttcaaaataaatatacatttatatgtcctatatatctctctctcttcataaaaacacaatgtgatacgtacaattagctccattttttcagattaaaaaaaactggggcacaggaaagttaagccaaaggtcactcagcaagtaagttgaggaggcaggattgaaactcaatcagttatctctggaacctacattgccaacctgttaagctcttcatattggcacaggatgttagaaccacagaaaaacaatactgtgaatttttaatagtgaatagcatattaacaggaagtgcttccttaaaaagaactagagccttaaaatgagctatggaagttgtttcagattttattatgaataaaatccatttccaggtgcactggatgtcacttttcttcataaatatgtaatcataaagatatgcaaattaaaataacattgaaataccactacatacccattaaaatggctataatccaaaagacaataccaatttactgtattagtccattctcacgctgctatgaagaaatgccccagactgggtaatttataaagaagcaagatttaggctgggtggggtgtctcacacctgtaatcccagcactttgcaaggccgtggcagatgggtcacctgaggtcaggagttcgagaccagcctggccaacatggagaaacttgtctctactaaaaactcaaaaaattagttgggcatggtggcaggcacctgtagtcccagctacttgggaggctgaggcaggagaatcacttgaacctgggaggcggaggttgcagtgagccaagattgcgccattgcactccaacctggggaacaagagcgaaactccatcaaaaaaaagagagaaagaaagaaaaagaaaagaggtttaattgactcacagttttacatggctgggaaggcctcaggaaacttacagttatggcagaaaccaactcttcacaaggaggcagaagagagaatgaataccagcagcggaaatgccagatgcttataaaaccatcagatcttatgagaacttactatcacaagagaaactgccccaatgattcaattacctccagctggtcccgcccttgacacgtggggattattaaaatccaaggtgagatttggtgcggacacagagccaaaccatatcacaaatgttggcaaatatgtggagaaactagaatcctcatatactgctaatgataatgcataatatatggccactttggaaagcagttttgcagtttcttaaaaactaaacagaatctcactcaacaatccaatttcacttctaggaatctaccccagaataaatgaaaacctaagtccataaaagctagtaagggaatgatagcattattcataatagctaaaaactagaaacaatacaaatgttcttcaactggtgcatggctttgttatatccacacaccaggggggtttaaaaaaaaaaaaaaaaggaatgtccagaaaagagacaaatgtagagttagaaaaggtttatctgggccgggcatggtgactcattgctgtaatcccagcactttgggaggccgaggcaggcagatcacccgaggtcaggagttcgagaccagcttggccaacgtggtgaaaccccagttctactaaaaatacaaaaattagctgggcgtggtggcgcaggcttttaatcccagctactccagaggctgaggcaggagaattgcttgaacccaggaggtggaggttgcagtgagccaagatcgcgccactgcaatccagcctgggcgacaagagtgaaactctgtctaaaaaaaaagaaagaaagaaagaaagaaagactttatctggaactagggatgacagcagggattgactgcaatgggctgcaaaaatatgggttttggaaggatagtggaaatgttctaaaattggattgtggtgataattgtacaactatataaacttgctaaatagtgctgaattgtatatttaacaatatgtaaataatacctaaaaaaagttgttaaaataaaatgcatatcagtaaaatgattccttaaatcataaacgtgtttgccaaaagagaactgattttaaaaaactgcaatgcctatcctatattagtaatatctaaatgatggtattttgattttgaaatttactgaattgctattttcaattcagtattcacccatagaaatggtttttcgatgtaaaggcatttcagacatactttagtcttctaagtgtaatctgaatgttttgtacgattaacccgcacgagggtagaaataaagtcatgttttcattaatataaaaatgtcagccaggcactgtggctcacgcctgtaatcctaacactttaagaggccgaggcgggtggatcacctgaggtcaggagttcgagaccagcctaaccaatatggtggaaccccatctctactaaaaatacaaaaattagccaggcgtggtggcgcacacctgtaaccccagcaactcgggaggctgaggcaggagaattgcttgaatccagcaggttgaggttgcagtgagccaagatcacaccacttcactccagcctgggcgaaagagcaaaactccatctcaaaaaaaagaaaaaaaaaagtcactgtttagaggttgaatcattggagaatcttggtgcccctgcccacaagtcttttacagttatttctaaatatcccagatgatattccacacaagctttagaaccattcttacccattcttgttttactctttaaatcaacaaaatgttattgaataattatgtgcatgactctggagacacaatgatgaacaaagtatccccacctccaggttagggtagccctagaagcggacactaaacaatatatgaacacttcctccaaaatgttcactgcctgaaggccttgaaaggagggccccagccatgacaatggttgccagtgcttacataaaaagatagtttccttgctgttccaccagacttcagagaaacactgctgctttctgaatagatgtggggagattttctccatcttctattacacttcttcatttgggctctgaaatagtattacttgtgtcccaaactcataagaccttcaatgaacagcagtcccttcatctatgatggttctccatgaaggaccagacccagtccctcaggccattgggtaaataaacatgctttcccttctagcttctccttctcattttcatcctgacacacttataccattgcctatgagggtatgcacacagatgcctaggctaggtgccagctacacacacagtttttctcagtgaagcccagcatgacacctgctgcataagatctaattaattagccgacataaaagaaaaacctatttttcttttgattcttaattttagcatgtgtggagttcagtgcttcttagaaaaactttctctcagaagactactcattttaatacacagcatatgtatgttccagttacgttatctacagcaaggtatattagcaaaaagtaatagctgctctggattctgaattttgatcacttgaatacttaaaatgagtcagaattcaattttggaaaattgctgatagcaaaatgttaatgaaaaatattacatcaatcacagacttccagaaatgttgtattaaagtttcccaaaggctttcatgtacagattatttaaataatacagtctttattaatgatctctttgtaattctgaatatagcactaatttattcagttgccttaccgattcaaacaagaccataaacagcatgaaaacataaaatgttgtgtcctgatctgacacaattgctttaataatgatgagaaacaggctttacataaatggaaagtgattattctctctaatacacaaagtcatacagaggcagaaatctaggtttgtattcttttcatagggctagagttataaattctacaagattaactacatatagactacagccccacatacacacacacacacacacacacacacacacattagatcacactatcattttaagtgctttgttaatgtataatttacatataatcacccattgtaattgtgcagttcaatgaatacaaatatatacagttgtacgtaccaccagaatcaagatatagaacaaaaaggtataatccaaaaaatttaatcatgctccgctgtagtcaacactttctactcaccttgacccctaggaatcatcaagctactttctttcacttagcataatgattttgagtttcctctatgttgctacatctatcaggagtcaattcttttttattgttatatattactccattttatggatgtaccacaatttgtttatcctttcaccagttgatggacatgagtaatttgtattttttggctatcacgaacaaagctactgtgaacagttgtgtggacatacatttgcattgcattcgagtaaaaacctagaaatggggttggtgggtcatatagtagttatgtattttaatttctaagaaactttacaaagaggctgtaatatttttaatttctaccaacaattctatttgttccatgtctttgccaacatgggatatttttaaaatcagtcattctactgagtgtacagtgctatttcatttgtaattttaatttgtatttccttaatgatgaatgatgttcagcaaattttcatttgttcattgaccattcatatgtgttctttggtgaagtgtctgttccaatcttttttttttttttgagatggagttttgctcttgttgcccaggctggagtgcaatggcacaaactcggctcaccgcaacctctgcccgccaggttcaagtgattctcctgcctcagcctcctgagtagctgggattacaggcatgcagcaccatgcccggctaattttgtatctttagtagagacagggtttctccatgttggtcaggctggtcttgaactcccgacctcagctgatccgcccacctcagcctcccaaagtgctgagattataggcgtcagccattgcacccagcctgttccaatcttttatgcagtttttattgatatttttatcttttatagtgagttatatattccaaatacaagttctatattagatatattttttacaaatgttttctcccagtctgtggtttcccttttcattttcttgtgtctttatgagagcaaaattttaaattttgataaattcaaaattatcattatttttcccttatggttcatcctaagaaatctttgcctaacccaaggttgcaaaattttctggtttttttccctatgttttctttcagaatttttataattttagctataaattttttatttatttatttatttatttatttattatttttattttttttttttttttttttgagacggagtcttgctctgtcacccaggctggagtgcagtggcacaatctcggctcactgcaagctccgcctcccgggttcacgccattctcctgcctcagcctcccaagtagctgggactacaggcgcctgccaccacgcccggctaattttttgtatttttagtagagatggggtttcactgtgttagccaggatggtcttgatctcctgacctcgtgatccgcctgcctcggccttataattttagctataaatttttaagttttcagcttaaatttttatagtttaggtttagctcaataatacatttcaagttaatttttacatacaacatgaggtaagggtcaatgttcagctttttcatatagatatccaatttttcttgtgaaatttaaaggactaatcctttcccactgacttaccttggcagccattttttgaaaatcagttgactgtagatgtgtagatttatttctgaactcttcattttgttccattgatccattggtccactgatgccaacaccatacaatcttcattactgtagaattagagtaaatcttgaaattaaatagtatgagatctccaaatttgctctttgttttcaaattgttttagcttgtctacttcctttacatttttatatgtactttagaataattttctgtttctacttaaaatatagtccactggagttttgataggaatcatactgaatctatagacaaatttggagagacttggtattttaaaagtatctagtcttctgatttatgagcatggtatagctccctttttttctaaaacttaacaaagttttgtagttttaagtgtgcagccattgcacatattttttgtaaactgtcaccctagatatttcaggttttcacattataattttaagcaaagtgttggaagtagcattcctagaagtagaacagattaaaggcaaaagaaaaacgttatctgaaataattctaattgagaagaaaaatggcaatataattattgaataacaaaagctatgtaaaggaattatcattgctattacattcacttttatatctgagcatacaaattagtgctttatttacagtgaataataatataaaacctacttggagaccagtaaaaaagaaaaggccctaaaccgaaaatcagcaggcctagacttgagtcatgacttgaatattgaagaagtgtatagtacaaggtaaataaaccttgacaaacattttctcccttctcattttgtgttcaactaatacttggcaaatgtttacaagagccaaacagtatgctaaatgctataaaatgggaagaatccttcacagcatatccttaagtgtcagaatgaaacctcaaatgagaaagagttatatgaaatattttggtaagataaaatgtgtattttaatgtgctattattatttattataattatggcataaaaagttcatttaggctgggcacagtggctcacgcctgtaatcccagcactttgggaggctgagacaggcggatcacctgaggtcaggagtttgagaccagcctgaccaacatggagaaactccgtctctactaaaaatacaaaaattagctgcgcatgatggcacatgcctgtaattctagctactcgggaagctgagggaggagaatcacttgaacccgagaggtggaggttgcggcgagccgagattgcgccattgcactccagcctgggcaacaagaccaagactccttctcaaaaaagagaaagaaaaaagaaaaaaattcatttgtaggtgctattactttaatacagagctcataccaaaagaagaaagtagctctgaaaaaaattaaatggattatagctagagaatcctaaaagtaatcactccatgatacactgaaaccttttctcttctattaccttctagttgtatgatacaagtagcatctaaatccatagacatggaagaaggctgacttgtttttaaaccctacaaagaaaaagaatgacttgtttttaaacccaaaaaaaaatttgaatatttatgcattttttccttccagatgaaggaagtagccttattaatttctattaataggagatgtgctgacaatttttctgttaggaacctggcaaactcacaaatatgacagatgaactcagaatttagaagtatgccaaaagactttatgcaaaggaatatagtaaaaaagaattcagtttctctggttatagattgttatccaaataaaatatttatgtattggtcactatatcatatgtattggtcaccatatcatataaattggttgaaaaatgattttctggtttttctgtgtgtattcttttttttttaggtttgattctcataaaggtttctggtgtcagttactggaagaaggtaaaacaaaatgccttggaaagagcaaaggaagaaaataccctccaatggattctgatgtaagcatagaccttaaaaatacaaactaaatcagcaaaatggtaaccaataatatcatctactttcttaaaaaactagttaaagtcaaaattcagcctttctaaaaattaaaagtgccatttcaatttcagtacaggtaggttgcttattttgatttacccacaatatattattacctgtcatgcaagaataaaggaaaacaatagaattcaacattctgaataagaacaaagagataatatcttattccaaaaagaatgatacctgcacaaaaattttagtataaatgttaactgaaaccaagacaggaagtatatccattggaaagtgaaaataggaccaagatttctatttttggccgagtgtggcggctcatgcctgtaatctcagcactttggaaggccgacgtgggtggatcacttgaggtcaggagttcgagaccagcctggccaacatgataaaaccccatctctactaaaaatacaaaaaaagattagctgggcatggtggcaggcacctgtaatcccaactactcaggaggctgaggcaggaggatcgcttgaacctgggaggtggaggtcacagtgagcccagattgcaccattgcgctccagcctgggcagcaagagtgaaactccaactcaaaaaaaaaaaaaaaaattctatttttttcactgcctgagtcattctgttgtagtaagtgtgccctgggcagtaatgtaagttactgatataatatactaagttttgagctgttaatatgctaataaaatgaaagaagcaatgtatttcccaacatctaacatactagcagataatttaggctttggggaatgtagacacacactttgcagtatgtattcagcacttcctgtttattctgttcagaatggagacatggtgatcacttaatgttacagttttctccatttctataccccacatttttactttaatgcttacttgacatatattaagatttactaataatatttttatttattattagtctagttagtagtttcaatataaccatgcaagtagattttgatttgtaaattttttttagatctcagaaattaaaatatgatttgggatttttcccccacaattaatacattacattaactgagaaccctaagatagtctgaggatcctaaggtgggctaaacttattagaatactttaacaaaaccttgaggactactttttgtgccttgcctgatagatgcagggtctgtcctcaataaactcataattaaatcatatacggaagagagagagagtttctgttattttgataaacaaactgcattttcagaactccaattttctgtggctgattaaaatataccttcagagcactttgaaaacaacccttcttttcccaaaagaaattgacatacaatttctatagtatttcaagaaagtaatataaaatatatcatatgcatttatgtcaaagctatttccccgtaaatttattaaagctaaaatgtttaagagacactgcagaatatctttcttagcattttgttttactctggtctaacacagaccttattaaatttggaggtagagaaagataagaaaaacacaacttttcaggatatccttccttctcaacaaggttactgagtaatccatattgggtttatttaagggagtggctgattttgtgaaaataatgtccacaaagcaggtaagagtaaagaggtcttcacagaggtaatgaaaatacaaatgtgtaggagggattagagtgggcagtactgtcaccacaccttttgcctcttcctagtaagaaaaatgccagtacccaagactgtcagtaaaatatcatagcatgtgctaaataaatagtccatatgcttaatacaaattttaatccagatctggtatacttggtacttatttcaacgtagtcaaagtgtatgaaatgtaataaacaaaataaaatgtacttttctctcctcctctccacttagagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaagaaaaagtatgtgttacaagccttgaggcctgtggcctttctcttaacccatatctgagcctgtgggattattgtagactactgtgcactcatgtggaagtcaattgcaaccaacataaatatcaaacacaaatgcagaactgttccatttcatagtaatatttacacttttatatatcaactaagattgtgtctctgtaggtttttagaccactgtttgcctgtacgatgttttcttattattttattctataaagtgtcctatgaaacaagaagcaaaataaacatcacaatgtagcataaaatgtcaaaagcataacacccatgaaaaatgcttgccaaaatttaaatccacttaagtatttagaaataattgtaaattataatttgtgctagatcagagtggaaaagttatatatgagtgttatctgcaccaaaaaaaaataagtgctatagcaaaagtgattttttcatatacatagtctagtgaatatatgtaaaaattactaactcttccatcacaacgtaattgttatactgaaatatatactgtaaagctgttggatggtaaatagaaacacatcaagtacaccaaaacagtaaataacaatgtaaagtgtactgactgaatcctctaaaagggagaaattgtaggggtctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaagcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaaaaagaaaagaatacatcatacttattttcctgttaatatttacttaatttttttttttgagagggggacagagtctcactatgtcacccaggctggagtgcaatggtgtgatctcagctcactgcaacctccgcctcctgggttcaagtgattctcctgcctcagcctcctgaggagctgggattacagccatgcaccaccacgcccgggtaatttttgtatttttagtagtgacagggtttcaccatgttgactaggctgatcttgaactcctgacctcatgatccacccaccttggcctctcaaagtgctgagattacaagcgtgagccaccatgccctgactacttaatttttaaatgtactgtacatatacataaaatttaagtagtaaattaattccctgctatgattataagcctttataaaatattatcaaaggtatgattagaaacaaatgggaggaaaacccatagtaaaaatattttcattgtcattttaatgggtaaaactatcaattactaattagaaaatgaattgtgagatccacttactataaatttttaactgtacattataattacttttttaaagtttcatgtacctaaagcatatgctaatttttaaatatactattagcagaaaaaattggaaaaatcaccaatttttaagactcttgactctaaaagcaaaatcaaagtgatttggacaaatatgggaaacacagtcttcatgcttactgctgtctcttttatagcagcagatgccagacatgctaggaaa

SEQ ID NO: 16481 - DNA, 4328 bp, Human
ttatcttttaaaatgagatgcacatataatcataatatgtgttcaataaataaatattagctgaattaacttgagatgtaaagtcactgaagaaatgtctctacaaaagtacagaacagatgactatggttttgtttgtttgtctgttttagacagggtcttactctgaggcccaggcaggagtgcagtggctgaatcatggctcactgcagccttggccttctgggctcaagcaatcctcccacctcagcctcccaagtagctgggaccacaggcatgtgccactgggcccagctaatttttgttggggtttttttttttttttttttttttttttttgtagagattgggtttcgccatgttgcccaggcttagtctgactgcttgaactcctgagctcaagcaatccacccgcctcgacctccaaagtgctgggattacaggcatgagccatcatgcctggcccagaggactttgtttttaattgttttcaaaaacttactgaaaaggatggagctgtgactgaagcaatccagctatttagcctaagcatgtgccaacacgcccagctaattttttgtatctttagtagaggtggggtttcaccatgttggccaagatggtcttgatctcctgatctcgtcatccgcccgcctcagcctcccaaagtgctgggattacaggcatgagccaccgtgcctggccttaaaaaactttttttaaaaaacatttttgaggttaattttaattaatttaatatgtatttaataatacatatataatttaccatcttcaccatttttatgtgtacagttcaacggtaataaataaatctatattccatccttgcctttcctctttcccttctggcctctggttaaaatcacaaaaatgtaattgtgaattttcctttaaaaagtaagttttacttatatccaatatccagactaggtaaagaaataagagtgttctttaaatataagtatgtctggaaaccagctagaaggtatttagtattttagtccttagatacaattaacatacactgaaattaattccagatggggtctctatgtggactcctattgattaccatcttagtaaaccaagattagaaggatgtattaaagggttagaaataaaattatttttagaaatctaagattaaaggtaaaatgttaataatacataagaaactgccgggcgcagtggctcatggctgtaatcccaacactttgggaggccgaggcaggtggatcacgaggtcaggagttcaagaccagcctggccgagatgctgaaaccccgtctctactaaaaatacaaacaaattggccaggcgcagtggctcatgcctataatcccagcactttgggaggctgaggctggtggataacctgaggtcaggagttcgaaaccagcctggccaacatgataaaaccctgtctctactgaaaatacaaaaattagccgggcgtggtggtgcatgcctgtggtcccagctactcaggaagctaaggcaggagaaatcacttgattctcacttgaacctgggaggcagagtttgcagtgaaccaaggttgcgccactgtactccagcctgggtgacagagcgagactctgtctcaaaataaataaataaataaataaataaataaataaataaatatttttttaaaaaaattacccgggcgtggtggtgggcacctctaatcccagctactcgagaggctgaggcagagaactgcttgagcccaggaggtggaggctgcagtacactgagatcacaccactgcactccagcctgggcaacagagaaagacttcgtctcaaaaaaaaaaaaagaaagaaagaaagaaaatattctagtaataaaaatatattgactctgtgtatttccatacaaagatatggaaaaacttcatgaaaaaatatcactggtagctttctaaccaaatataagcagatatgatttaattaaatgtccctttctggcagtgacgacctacccacaggagaacatgcctctcgcaaaagatctccttcatccctccccagaagaagagaagaagaaacacaagaagaaacgcctggtgcagagccccaattcctacttcatgggtgtgaaatgcccaggataatataaatcaccacggtctttagccatgcacaaatggtagttttgtgtgttggctgctccactgtcctctgccagcctacaggaggaaaagcaaggcttacagaaggatgttccttcaggaagaagcagcactaaaagcactctgaatcaagatgagtgggaaaccatctcaataagcacatttttgataaaaataaaaaataaaataaaataaaataaaaattaaatgttcatctgcaatgcggttacttaaacacacattatgaaggaaaaaaaacacaacaggccaagaattactataaatataaggttaagagaactagggcacagtcattataaaccttatagttatgacaaaagtgcttaataaaggctccattaatctgcaattccatctcacacaataaaaactgctctctttaatcttccaagtattacagagtgcctaacatggaacaatagtgctttacaacagaacttcacaaacaaaaatgcagacaagaagatgaagtgtcatgaagcttttcaataaaataccaaactgcaacacaggactactgcatcttttcctttaaaaaaaaaaaaaaaaaggagaaaaaaactgctagctgtttttaataacatggcattcaaaaaactttacgttgctgccaggtcatttaattttaaatgtccagacctgcaggaatatatatgtgatgttgcaagtcactaacctctatgggcctcaatttcttcattcataaagtaaggggattcgtttgtctaatttctatgatttcccttcaagttttataatttgctttaacttacatttcaatatcagaaagtacatattcttgggaaacatcaagaatatatagaaaatataaagtccgggataatcagaagcctgtaattaataaagtctgtttaataagaagaaacaaaatagatttgcattagatcacttaagcaaacaaacaaaagaaaagctcttctaaccaaagctctgtcatgtctgctaatcacctaacatttgtaacatgggtgcagcacgtgcccctgcttactgttgacagcagttctcaatttatcaattactttaatttaccttctggaactgtgaatgatttttggccagaagaaataaattatgtttaaagcaggtgcaactttatataactataaaaagaaactaatataaactgtatgttgtatacatgcataaaatatctctggaaaaaaatataagaaattggtgatactggttgtatcctagaaggaaaactagataagaatagaaatggaatctgtacaacaaagcagccctgtaacatgagtttacctatataacaaacctgtacatgtacccctgaacctaaaatgaataggaatgggaagatcactatatacccttttgaattttgtaccatggacaaatattacctattcaaaaaattaaaaataataaaacataaataacaaatttacatttgcaaactactagaaggaattagtaaactaatgcatataatgaagtaataatatttcaaaggaatttgtatttcttccccataacccaagacctcttctcagatctgatttgaatatcatttcaatctttctttctttcttttttttttttttttttaagacagggtcttgctctcaacaccaggctgaagtgcagtggcacgatcttagctcactgcagccttgaccacctgagctgaagagatcctcccgcctcagccttcccagtaattgggactacaggcatgcaccaccatacctggctaatttttgtgttttttgtagagacaggatttcaccatgttgctcaggctggtctcccactcctaggctacagatatctgccagcctcagcctcctaaagtgctgagaacgcaggcataagcaactgcacctggcctcaatctttctttatgagactaaggactaaggtatgtgtgttctttccatattcaaacccagaaatttttaaacaagtatgtttaaaattactgaagtactaacaattcacatgataaaaacgattttctggccaggcgcagtggctcatgcctgtaatcccagcactttgggaggcggaggcgggtggatctcgaggtcagatcgagaccatcctggctaacacggtgaaaccccgtctctactaaaaatacagaagattagccaggcgtggt

SEQ ID NO: 16482 - DNA, 28585 bp, Human
  misc_feature (1)...(28585): n = A,T,C or G
ctgcctcagccttccgagtagctgggatcacaggcacccaacatcacgcccagctaatttttgtatttttagtagagacagggtttcaccatcttggccaggctggtcttgaactcctgacctcgtgatccacccacctcggcctcccaaagtactgggattacaggcgtgagcccctgtgcctggccataaaagaacttctaaagagcagctgtagtgaatttacgaccaagacttttccatagaaaataactgataaggtgaaaaaaaaaaaaagcttgtcagaaagctgacaagaaagctaaaaattaccattcttttctcagaaatctaacagatcccagaggattgctacttggagttcttcctcagttttattagtgctaaacatctgattggccagggatgaccaaactaaactcctactgaatccatgaaggaagtcagaaaataaagggtggggaaaactaatcttggttaatactcaaaaggcttatttttacatttcctgcacctttgaaatgccttggtgacttacaaacctaatctaggaccaagaatgaactttactggagagatacaggccttgagaggttaaggacttgactagtggtatcacattaacaactggaaatgagatgctggcatttccctttccagcatatactgcctgataaatgatttctttcccccgactccagctttaaggtgtaagtgacaaatagaaattgttcatgtttatggtatacaacgtgacgttttgatatacatatatatacacacacacactgcaaataattaaatgaagctaatcaacataatccatcatctcacatactttcctgtggtgagaacatttaaggtgtaccctcttcacaatttcaagtacacaatatatgattattaactatagaactcatccaccttctctgactgaaactttgtatcatttgaccaacatttccctatattccccacccccgtgccaagacttcttacttgcctttcttgaacaaatacttgaattacagtgttattacgaagctgcaaagttgctcctcaagcaacttattgaagggaagcaagaagcgtcgaaaaagaaagcgctttttttttttttttttttttcggatagggtttggctgttgcccaggctggagtgcaatagcacgatctgggctcaaagaaaacacttatttttcacaaacaacagaaaaagcagtgaatattttgaagtctggatcctgaactccaggttatttaggtctgaaacctgtactagggggaggggtgcaagaaagagttgataaaattaccttaaccatgtggaaactttaagactttcttacatactaacccctcgccccccacttttctcaataaacgagccaaactggctgaaacgaagggactcgtccgcggcgccggctcagacccactgtagccgactcattaccgcccaaagtcctggagccctcgaccgggcatggagaacaccgtggaggaaccctaagagagggaatcctgcgaagagaagtcaggtggtggccttgccggaaacgggaccaaagtcctctagctgggattacgggagccggcgagggacctattatgtcagggttcagacaacccagctctgcatgcaagcctttccaattgccagtcttggggcgggctcacatcttctctacaaggcgaactcactacacgccttgggtgcctatcgtccctagcaaccacccgcgatttaaggcggaagtacctccctggtcctcctcctcctccggaccaaccaagccctcgtgaggaagcgcgttggcccaatcacctaggcgggaactactaccagccaataggaagcaggcacaggagggcgggctaaagaggtcgcggtcgcacgcgcagttggtccttagtactgcggccgtgtgggtgagttggctgccggtgagttgggtgccggtggagtcgtgttggtcctcagaatccccgcgtagccgctgcctcctcctaccctcgccatgtttcttacccggtctgagtacgacaggtccgtgcagctgggggacgtcgggtgggaattatgggtgggcaggcccgggacctggccgcgcggcctgggttctgccgtgtcatggggctccccaggaacccgagactggccggacctggggatgttatgccctcctcaggcgcccgccgtccttccccaagctagaccacatcggcggcacttgtcctaccgctgagtcacccctgggtcctaactcggtgcggaagcgagaagctccggctggtgcttggtaaagaaggcgtgaggagccggaactcctaccttgaacccggagaaggccaagggtcactctttgctccgttcatcttttcgtgcctagtatgactgccttgaacaaacaaacaaaaagttaaacgtgcttcctggaagaaaaagcaactggtttgtagtagggcatgctgcggtgtatagtttcttcagaagcgcgaaggcagtcgtagctttggctggatatattgtctggagtctgattttataggaactggaatttagaatggttttcaagagatttctcatcatgccgattccaattgaccaaaattttttctgactttttaaaagtttaaagcaagttttaaaaaacttttgtggtatgaaaatgttcacaatattaagttgtacatatatatgctgtagacatttttactttcagtttctgttttcgtcagttaagtttttacatagctactcttttttaaagtcagggaaggcagacattttctttgtactgagtggtatgagatgctgcatttcctgtcaagtatatgctgatcctgtcgaagttttaccacctgcagttaccactttttcatcttttttactgactcgtagaagatgtgtgtgaagttttgacatatttccccactgtcctataaagtgactttgttggtcgatatttaacttccagaacattgaagagaatcatcttcgggtgacataattttgagttagggtgtgtatgatagaaattgttatgcttatcagaaggcatttattaaattttgtggccatttacttaacatatgtattgactgctttgttacttatttttctgtcttcccaagacggcctaaaatacatccctttttattctcttagttaatgtgcttgagtgcttgctgtgaacaaggcactgttctaggtgctggtgctacagcaatggacaaaatcaagctccttgctcgcatataggagactcttttgagacagtctcgctctgtggcccaggctggagtgcagtgacgtgatcttggctcactgcaacctccccctcctgggttttgtttgtttttgagacggagtctcgctctgtcgccaggctgcagtgcagtggcatgatctcggctcactgcaacctccgcctcctgggttcaagcgattctcctgcctcagcctcccgagtagctgggactacaggcgcgcgccaccactcccagctaatttttgtatttttagtagagacagggtttcaccatgttggccaggatggtctcgatcttttgacctcgtgatccacctgccttggcctcccaaagtgctgggattacaggagtgagccaccgcgcctggcctgccgcctgggtttaagcaattctctgactcagcgtcctgagtagctgggattacaggcggtgccaccacgcccggctaatttttgtgtttttagtagagacagggtttcctcatcttggccaggctggtcttgaactcctgacctcgtggtccacctgccttggcctcccaaagtgctgggattacaggcgagagccacctcgctcggcctgagactcttaaagaattgtttacaggtacagtggctcatgcctgtaattccagcactttggaaggccgaggcaggattgcctgagctcaggagttggagaccagcctgggcaacatagtgagacctcatctctactaaacattaaaaaatatcagccgggtgtggtggcgctgaccttgtctccaaaaaaaaaaaagaattgtttacagaagtaactatagtgtgagtcagaaatatattaatgccattagagaaattcaaatcaataccatggaagttttgatgagggattgcattcaatatgagacgatcatggaaaacttcacaaaggagctgacatttaaactaggtttcttgaaagagtaggaatttaataaagacagtgagatcaatagttgggggttggagaatatgggataaatgaaggaggggcaatggaaaagcacaatacattttgggaaaagtccagtctgactggcacatatgatacgtgtatgggaacagcaggagataatgggaaaaacaggatgctgctagatattgaatggtttttaatacgaggctaaggagtttgggtcctatttctgtaggcaactgtgtgctgttaaataataattgtgttttacagagattaattgtctgaattaggggaaagtgagtcaatacctgttagtgttaggctattaacaatagttaggtgaaaggtaatgagggcattgagaaggaagagtgatgtgttactgtggaggaggaattgatatgaattggtatgacttagcatatagttggatatgggaaaagatggggaggaatgagtcagatcatttagaacttcgtatgttgggaacactggaagatttgagatgttttaaattaaaactgaaattggaatggcaggagatgaagtcaattttgcaaggtggctggatttaaagagataatatttcaaactggaaaacgttaagtgttaagtgctaataggatatgcaagtggaaatgttcagcaaacatttaaattagttaggaaagaggtgaaactggtagtagagatttggaagtaacttgtgcttagcactctcccaggctggagtgtagtggcaccatctcggctcactgcaacctccgcctcccgggttcaagtgattctcatgccttagcctctcaagtagctgggattacaggcacctgccaccacgcccagctaatttatgtgtttttagtagagacggggtttcaccttgttggccagcctggtctcgaactcctgacctcaggtgatccgcctgcctcatcctcccaacgtgctgggattacaggcgtgagccaccacgccaggccaaaagcactactatatgacatgttacctgttgtaaagtctggactccataaaccacggattgcaaccatctcattcatttgttcacatattttttgtgtccattgtgtgctcaaagcttttatagctgagaccatgattggtgcctcttctccgtagggatttccagcacacttgagcaaggaaaggtggaaagtgttaagtgttaaggggaagtgtttagagaggaaagcagtctgacatgtaagttatataaatattgagtgaatgaactaggttagaattaggaactacatggatctcagtctgttaagataacaatagtaattcatacaaataagtagagaaatgtacctgtgactaacttttagtaaaaagtaataattaggcccaggcacagtggttcatgcctgtaatcccagcattttgggaggccgaggcgggtggatcacgaggtcaggagttcaagaccagcctggccaatatggtgaaaccccatctctactaaaaatacaaaaattagccgggcgtggtggcatgcacctgtagtcttagctgctggggaggctgaggcaggataactgcttgaacccaggaggcggaggttacagtgagctgagatcgcacccgcctgagcgacagagcgagactctgtctcaaaaaaaaaaaaaaaaaagtaataactgtgttttatagagattgtctgaattagggggaaaactcttcctacttgctccacgagtcaatacctgttaggagactattacaaacgttaggtgaaaggtaatgagggcattgagaatggaaagaagagtgataaccccaagtattaacgtcatatgcatgttatgggaagaggataaggaaaaatgcacattttcttggaaattggctgatagttttgaggcatgaacttaccaaaggaactggtaagtctattcagaatggatccaagttgattcaggattgaggcagaaaagtcatttgctctcatttcatcaatttgggaagactttctgggagtgaggcagaagtgttctatatataggttccattgccttgagaaactgttaatgtacaaaaaaatgctacagattgttgtgggcgaagtagagaataatgacaatgtgcgtattctgtagctatctgagctagttgtcaaggaacttgaattcagtgtctacatggctagtttttatgagtataattaataatttttttttaaattataggggcgtgaatactttttctcccgaaggaagattatttcaagtggaatatgccattgaggctatcaaggtatagtagcaagtagcataggtcctgaaatttcatggctacctaacattttgctggcagaacacttggagtaaatgtggtttaaccattcctttagaaaatgttcttatatccctttaagcaaccactgttaaccatttttataacagtttcaatcctattcctaatatctattttaaaactttttgagcagttaactgcttcataattatctaaatagctttttctcagtgggggtggagggacatatttgtgcttttgatcctcttagctataaagagaggtacagaagtccagaattagcacctgtattactttttctgttttgttttctttagcaaatcatgtatctgaccacctttgtattctttctttttctttctttttttttttttttgagatggagtctctctcagttgcccaggctggagttcagtggcgtgatctcagcttactgcaacctccgcccctcgggttcaagtgattttcctgcctcagcctcccagtaccaccaggctggtctcgaacccctgacctcaaatgattcgcccatctcagcctcccaaagtgctgggattacaggcgtgagccaccacgcacagcccacctttgtgttcttgttggtaaagtcaccttagggactaaataagagatttgttttagtggttttttagagacagggtctcactctgtcacccatgctggagtacagtgacaccatcttagctcactgcagcttctaactcctgggctcaagctttcctcccaccttaacctccctagcagctagggtacagatgtgtgcaccatgcctggctaatttttttttttttttttttttggtagagatgtggtcttgctatgttgcccaagttggtctcaaactcctgggctcaagtgatcctcctgcctcagcctctcaaagtgttgggatttacaggtgtgagccaccacacctggcgtggactggataattctttgttgtggagggccatcttgtacattttagcatgtttatcaattcctgggtactacccattaggtgccagtagcactctttcagttgtgaccatcaaaaatgtctccagactttgccaaatgtctggtggggacaaaagggcccccaattgagaatcactcttctagataaaaagtatatatgagttctgtcctactctgttcagttagggattcaagatcagtatactatacataaaacaattagagaacaactaagtgctaaattaagttttctggcaatggtttctgattatatatttgtttgatttttaaggtatacatgcatgtagtttcagagttagaaggcaaagtagttctataaaccttgtaacaaaaatagcaattcttgaggcctgcatcatctaggttcagcttttcagaggcaacactttaaattgtttcagctggtaatgttctaggactgtacctccatatctctataacacagatgtatggtttttttttattaggcattatccatggacttttcattatgaaagatgaagatttctgccctaaccccacacccctactccccaccacacacaattgtcttctgaggtggggatagggtgaccctctccatatatatcatgaatatcataattttgtaagatcattagtcaatagttacattagtataactaaatgcttttcacagctgagccattttgcattttataattatttttctgtttctgcacaacattgtttttcttggagttaataattctctttttaaaaatatttgcttaatttaggatgatcaataatgcattccaaagtctctccaggttacatgtatcctctcaaaacattgaggcaaattaagtgtcctattaaggattcctttttttttttttttttgagacagagtcttgctctgtcacccaggctagaatgcagtggcgcatctcaggtcactgcagcctcaacctaccaggctcaagtgatcctcccgcctcagcccccaaagtagccgggactacagctatgcacaaccatgcgcggcttgtttttttttttttttttttttttttgagacggagtctcactctctcacccaggctggagtgcagtggcgctatctcagcccactgcaacctctgcctcccaggttcaagcaattctcctgcctcagcctcctgaatagctgggattacaggcgcgtgccaccacacctaatttttgtatttttagtagagatggtgtttcaccatatcggtcaggctggtctcgaactcctgaccctgtgatccacctgcctctgcctcccagagtgctgggattacagatgtgagccaccgcgcctggcctaagtttttgtattttttgtagagacggggtttcgctgtgttgcacaggctggtctcgagctcctgagctcaagtgatccgcccacctaggcctcccaaagtgttggaattacaggtatgagccacagtgccctattaaggattcttaatgaaatcttggagccttctaatctgctccagtctggactggttgttctctgggcctcctgcgtacctgtggacttcattttctgtgagatcattctaggcattccctttaactccctcttgtgtaaggccccatgtcatcttttttgatttatttgctcaatttggtagaacccattttccagtagtattgtagaaactatttatttatttatttattttgaggtggagttttgctcttgttgcccaggctggagtgcaatggcgtgatctcggctcactgcaacctccgcctcccgtgttcaagcgattctcctgcctcagcctcctgagtagctgggattacaggcatgcgccaccacgctggctaattttgcatttttagtagagacggggtttgtccatgttggtcaggctagtcttgagctcctgacctcaggtgatctgcccgcctcaccctcccaaattgctgggattataggcatgagccaccgtgtttggccagaaataatttttaattttcaacttcttttgtttcttttcttcttattagcatcccgttcttgttttatggatgaaatgtcttgtttttcttcaacaattttctaatttttcttgaaaatttttttccttgtggacattgttgctcatccctataatctcagtactttgggaggctgagggaggagaatcacttgagcctaggagttcaagactagcctgggcaacatagcccgtgtctagaaaaaatttaaaaaattaggctgggcaaggctcacacctgtaatcctagcactttgggacgctgaggcaggaggactgcttgagtctagaagttcaagaccagcctgagcaacatagtgagactttgtcttcacaaaaaatttaaaaaattagttgagtgtagtagtgtacacctgtagtcttagctattttgcaggcttaggtgggaagatctcgtgagcctgggaggttggggctccatgagacnnnnnnnnnnnnnnnnnnnngcactgctgttccagtgggaagattcgtgagcctgcgaggttggggctccatgagacgtgattgtgccactgcactccatcgtgggcaacagagtgagaccctgtctaaaatatttttttttccttttgaactggtcagattgtttagagctatgtttttcaaactgcaggtctagacctattaggagataataaaataaatttagtggtcatgaggagcatttcttttgagacagaatgtcactctgtcacctagactggagtgcagtggtacgatcacagctcactgcagcctcaacctcccaggctcaagtgatcctcccacctcagcccccagctacaggcacatgccaccacacccagttatttttttttattttttgtggaggtaaagttttgccatgttgcccaggctggtctcaaactcctgggctcaagtgatcttcctgcctcagcctcccaaagtgttgtgattataggcatgagccaccactcctggcccacatttcttttttaagtgaaacagagcagtagatatcaaaatgccttgcccatagtagtgatgagtggtttttttcctgaaattttgtttctgttatgtatttatatttatttgtgggttttagttatgaaatcaaatgtattccttactgtggcttttggtcaaaaagtttgaaaaacattgctcaggagaaaactgcctcttctcatttcattccgggagggtatttctggctgctggcttctgagagctgagtagggaaagaaggctgaggttcttaacatttggtttggaaatttttacatatttatcccgttttcagtacattattcctgccttagactgtgcttggtgtccccaatccaaagacgctctattttacggtctccagagaataagcctggagtcttccacgggagtgggggaggtgcagtcgtctagctttacagcataggggaggggatccgggaatctgtttcttaaacattgaaccaccttgcaatttttagctccttgttcatttccatttccagaggtccttgttgccaccatttccttttttgaggtcctgtgataaaaatcaggttgtttctttactttctttacggctggtttaggatttggattacccaggtatcactaacctatcttctttttagcttcaaagttttgttgctgtgtcttctcccactctctgttatagtggatttatgcctttttagaagtcctttaatcttacatcaatagacttaaggaaggcgtggaactaatgttatgtctttagtctgcacctttaactagaaatatgagcattcatttttatttatttattttttgagatggggtctcactctgttgtccaggctggaatgcaatggcgtgatcttggctcactacaacctctgcctcccgggctcaagcagtcctaccgtttcagccttccgcgtagctgggagtacaggcatacgccaccaagcctggctaattattgtattttttatagaaacagggtttcaccatgttgcccaggctggtcttgaactcctggactcatgcaatctgcccacctcagcctcccaaagtgctgggattacaggcatgagccaccatgcccaacctgagtactcatttttttacataaaattttttgacagttcatctcctgtagttatgcaggtatccactgattaagaaaatacatgacaaaaagctggtgtacatttaataacacttctaaataaagtcacaactcaacacatttgaaaaataatatatatgcgtgtgaaatgatcattcagtctgcagacatgttaagcaagttatacataaagattcgtgggattctttggaactctttgcagtgctcacacttggcagtgattactttgtagaaataactaaatataatggaattcaaagcagaaagcatagtcatggaaggctttgatgagtggaatttggattgggggaaggaagaatgtattccaggggagacagcatgagcagaggggtgcaagggtaggagataacgtggcttgagccagtgggctgggctatacctgagggattttgttggagaataacgagtagtgaagttggaagggaaaagtggcatcaggatatgaaggctctggaagtttatttggatatattataggcagtatagggtgatgttaattcttgagagaagaaatataatgataatagcattttattagatcagtcaggttataacattagagatacattgagagagattaaagatgagagaggctattgaagtatctaggcatggaatatgaataacatttgttcatatttggcaggcaccattttaagcattttataatatataatgtgtttacccttcttattattattgtcatcctcattttgcaggaaatgggcatagaggagtagatgactgggagttacgtagagatagagatgaattccaggtatattgtggacttctagcgaccttaaataattaatagttttacgttgttggtggtgatgatggtggtggttcttttcgtccctccctaccttcctttattacttttttggaggtcaggtaggttggggaatatcatcacctcttgggacagaccaaggtagatggcagaggtgaaaagaggccaggtccagagaagacattaagagttttattactttcttgcccactatgtttagaacttttgaatcctccgtcctccaaatattggcattagagagtggatttttccagtgtttgaaagactttgttgaacttactcttttggggttctgggaattacatgggtaaattataaagaaaacattaaaaattttaaaaaaatttaagggagaaaaaagaactttttagaatcacaaaattctgtaaatcaatgttcttgctattgacaggaatagtatattaattacttacagtatgttagggtgctccttctctctgcctataagatgtggccagttgaagtttctatcatgtgaagatttacagagagctatctggtgagtatgtgagacagttatttgacctatatatggtaatcataacatgtttctctttagcttggttctacagccattgggatccagacatcagagggtgtgtgcctagctgtggagaagagaattacttccccactgatggagcccagcagcattgagaaaattgtagagattgatgctcacataggtaaggagtggaggaaagctgttctgtaggatctggtctgggttaattagtcctctatgatgttccaaggaaggtttatgaaatgaacacgttatccccttgttagctattattttccaggcagtaggccagaatgcgtaaatgtaggagtaggaggctgttgcaggactcatttatgtttaacctactcccataagttcctttcccctcaaatttagacttggtaaatgtgatggttgttgaaatatgcaaaggttgagatctttgaagtgactacaagttataagaataatatagacttgcctagatcagtcttcctcctttgttttcagattatctttgtattccttgttgcctctgcccacttttttggtctttaattcccctgccttggcttctgacatcattgtataatagtattacagggtgagtaattctacttatttatagaatggcattttatttggctatccaaattttcttaacctgtctagtcatctaattaatgaagcattggcaaaataattaattgcttgaaggcatcagaaccaaatgccatggtgactctgggagcttgatattatgtctttcatagatatagaaactgaaattttatcttttaagattggaacattgtgtcttctttaactcaagtcacttggtcttttgaaggtagctcagtgtcactgtgttcaacaaattgagagcctacaatgtgccagaccttatgctagataccaggatatagaaaggaataagacatagtccttgttttacaggagcatacagtctaattgtggtggtggacatgtaagtaagtcaatgcaattaagtgacaaaagtattaagaaagactagtgtgttcttagtaggagtacaagggaagaaataattagttttgcctggagtcagcggtagtggggctttcagaaaaggattccatgaaagtgattttgagctgagtttaattctgaaagataaggaagtgtacacaaggcaaacaagtgtctgggtatagcaagggagagcattctagtcagggggaatagaaatgactgaagccatcgtggtgtaaaatataaaataccatgtcacaagcagttttgtaggcctgggccatgaactgcagcagcagagtcggtcagagagcggaattccttttttaccacactgaagggcttcaatgtaatccttttgcaaggatgggaaaggttttaagcaatgaggtaataggatcccattataattttagaaaggccattctgataatgatattaaagatagactaaagagggctgaaactggaggcacggaggccagttgaaaaatttgtaatagtccaaacaaagagatggtgaaggttttaaccaacacagtagccagagaatggagaggaagatagaaattgacagaacttgtgatctgattgattgtgagggccaaggaagaagacggggtctggaagggaaatgagtgtgtgatatgtccaagtagatatattaaggaagttatttggctttatatgtctgaaacttgggagagaaacttaggctggagatttagatttgagccatggcatgtacaataacagttatagccataatcgtgacagcttgggccatcaggcaaactctctctgatataactagttgctttgtgtttgggacagagaggcaaaaggcttttgatttattcgagagtcctccactgtagtccatagtgaggtgattttcttttccttgtttcccaggttggggcattagtatttgcttcgtttgaaaatgtatcatcgtctacaaagagtgctaaagggatgcttagggatgtaatatgtggaaattcatgtttggttagctgcttttctctgggcttatttttatcgtctggacttctgtgtcattgtggatggttttttgtttctaatatcattaatacttgggttcagtgcagatcatttcctatctaatcttttgggtataaaatgccatgggatagctgaatggctgccgtggttccaatccagaatttcaggatttcctgagtggatgaaagagttttacaaggatttggccactgggtcactgtcgcttttacattgcaggttgtgccatgagtgggctaattgctgatgctaagactttaattgataaagccagagtggagacacaggtaaaattggcattatctcctttttaccaggatgcttgagttccttgtttagtgattatctagctgcctgggctatactgcaggtacctgtgtcaatattagatgtggctcttgggagtaattttgggtagaattcccagttagaacttcctggggcttggagtttagctgtccaatcattgcagttttaaagaggctctggtcagtagtgctgacagtgtcttccttttttttttggctttgcctatatataaagcatgcattgtttcctaattgactttgtgtgggagcatcatggcaggaggtggacgtagttaaaggatattctcccctcagctgcctttgctgccaggcttgtaaataacagcccgcctttggtgagtaataacttgtaccaactgacaaatactggtcagggatactgtttttttttttttttaaactttgtagctgctgcttgaagataggctagtaagaaaaatacatcacatggtaaaattttttgtacttatttgcaagtttgctgtctgtacttatgtaagaataagtcatttgaacatcaacagaataagctagagtctttgagggaaagaggcacttttagtttttgaaagagtaaacttggtgctttgaggcataaccctctttttcaaggcagtaattctcttgtccgtcgttgcgtagagtccttgtgatatgtttatttccagagctatttctcttcctctcatgtactcccaagtactcagggttaatgttaattaagaaaaccacatttgagccttcagttttcaatcccagtttaaagggatgtgcgtagtgagatggtgggctgctttaatgtccttattagaaggttgtaccatgctttgctcttcttctagaaccactggttcacctacaatgagacaatgacagtggagagtgtgacccaagctgtgtccaatctggctttgcagtttggagaagaagatgcagatccaggtgccatggtgagtgtgatacttctgtcgagttttcttattgttctatgggacttaggacatttgtcctgtgaacataacattcccagcccctctcacctccttactttatagccatttatcttaatatctcttattttttggttctagtctcgtccctttggagtagcattattatttggaggagttgatgagaaaggaccccagctgtaagtaccattttgtaattttcccccatgcttttgcagggaattattttaatttggggtggagactgagaagattattgtagactgttagccaggtattagcacacacctgtagtcccagctacttgaaggctaaggcaggacgatctcttgagcctgggagttgttatccaggctgtagtgagctatgatcatgccactgcactccagcctggataacagagccagaccccatctctttaaaaaatacattaaaaaaagattattgtaaaaagggctattgtagagtgtgtgtgtgtgtatgtatatacatatatatatggcttctaatactaaagtttagtgattctataccgtttgcacaaatttggggattccatgaagaattcccctattggaaccagtgctaattctggaaggaattagaagtaacttgttactatagtcagggtatgttttagaactttgctctggaatgttgatctgatcctcatcctcaaatatttctaagataggcataaacaagtaccatatttatacatactatacttctaaatccctaaggaaggtactaattttcttaaacagtttttaaaatgtctggtttctccagacatagaacatcttttagatctgtgcctcaatatttcagtggtgtttcctggctgcagggccaagcatttatactttgttttagtgagacgtttgttacataaagtgccaccactcctgagcattttagtcctcattttgggggttttgcaggtttcatatggacccatctgggacctttgtacagtgtgatgctcgagcaattggctctgcttcagagggtgcccagagctccttgcaagaagtttaccacaaggtaattaagtattctcacaactcttactatttttttatcatggtataatttacatataataaaatgtgcaaaccttaagagttcagttctgttttgacaattgcaaaacaagataaataacactttcatcaccaccagaaaaatgctcatccacattccagtcaatctctttccctcccttgcaaccatgtttaccaccatgtttaccactctccattagttttgtctgttgtgctttgttataaatggaattaaacagttagtcagtttgtatctgttttgtttaacacactgtttttgagatccattcatgttgttccagtatttccgtttgatggctgagtaatataccatggtatggatgtaccacaatatgtttatcctctatattcacagctttacttagcactttacaattggctcttgaagcaagtgggcatttggtattttctttgtgagatgggaagatttggttttgggtaactcattggtgtgattgaaggctgctctacttattcaggtggttcatacagggatgcctgctcacattagctcctaatggtattgcttttacatgtggaagaaattaggtacaaaacagggtaaatttgaattttctaaaccattgggctacctcttagatcatttgggcattattgttcattggatattaccaataatattatcttctaaattaaaagaggaattcaaatgtacacaagactagtctatccctttccccttcttcaaagattactttggttggtgactttattgtggctcacaataaggtttgggggttttttttcctgaaaaaatgtattctacttatttgccatttacttgagttctggagatacttgtaatgcaccatactaagtaagatgtttgacatacttgctaaatacttttttcagtgagataaagggaaaatctttgaaggaaggacggattgtgcataattaataggcatcttcttgccttctttgtttcaagtctatgactttgaaagaagccatcaagtcttcactcatcatcctcaaacaagtaatggaggagaagctgaatgcaacaaacattgaggtactttctgttttattgttggatttttttcggttttttttttaagagatgaggtctggctatattgcctagactggtcttgaactcatgagttcaagtagtcctcccaccccagcctctcgagtagctgggactacaggtgcacacaccatgcctggttaatgttttttaatttttttagagatggggtcttgctgtgttgcccagactggtcttaaactcctggcctcaggcaattctcctgcctcagcctactgagtacctgggactataggtgagagccactgcacctggctgttttattgttttttattcagatatcatagctggcattgctgaagactacatagatcatggaaatgacatttttgtatgtttagttcctaagaaattattaacagcctttgaataataagcagctttagtaaagtggtgctggcagaagccagaattcagtgagttaaagaatgaggcctggcgaggtggctcacgcctgtaatcccagcactttgggaggccaaggcaggcagatcacttgaagccaggagttcgagaccagtctggccagcatggcaaaaccccgactctaccaaaaatacaaatactagccaggtgtggcggcacgcacctgtagttccagctactcgggaggctgaggcatcagaattgattgaacccaggatttggaagttgcagtgagctgagattgtgatactgcgctccaacctgggcgatagagcgagactctgtctcaaaaataaaataaaaagaatgaaagggagatgatgagtggagaaaacaatagtatgctgctttctcaagaagtttgattagtgtcggcagaagatagcattaaagaaaaggattgtgtcttttttaggatgtggaaaagtcttgaaaatataaacggagatgaaactagtgtatagaaaaatgttgaaagagttgggcgcagtggcctgtaatcccagcactttgggaggctgagacaggtggatcgcttgagggcaggagttcaagaccagcctgcccaacatggtgaaaccccatctctactaaaaatacaaaaattagccaggcgtggtggtggacgcctgtaatcccagctacttgggaagctgaggcatgagaatcacttgaacccgggaggtggaggttacagtgagccgagattgcaccactgcactccagcctgggcgacagaacgagactccgtcccgaaaaaaaaaaaagctgaaagaaataaaaggagaggttaggatagtgatggaaaagttatagaagaggtaaggcatggtacacatgaaggagttggttttgaaaagtaaaattcattcagcatcatattgagtacccattatatagcaggtattatgctagatgcccagggttacagacacagaaaatccaattcctattcaagtagtatactgtgtagtgcagggaacatatagataataagaacctggggtgatacttctataatagcagtaaaaacagattcctgtgagtatgtataacttagactaaagcattagggaagcttcttggaagaggtgatgtctggaaaagggagcagaaaggtattccaggaagacgggacaacatgtgcaaagggttcaagatgtaaaaataatattgtgggtaaaggaaactttgaggttttgtctgactgctgaggtgtgggatgtgtataagatggtgggggacggtaagggatgagactggagaggtatggaccagcttgggaatgtccttttttagtatgctaagagtagacaggagcaaaggaagtaatgacgagtaaagataggtgggtttggcggtaaacctggagagatgtcccacatttccccagatttttcctagtgattgtaaagtcatctgccgagggtaggtgaatgcaacagtaaaattgagaatgggaaatatttggaaaagtcgttatgagaagacagggaagagtaaaaggattgctgggccatattaaaatcgtagttgaggccagtaatcccagcactttgggaggccaaggcaggaagatcacgtgaggccagaagttcgagactagcctggccaacatagtgaaaccccgtctctactaaaaaaatacaaaaaattagctgggtgtggtggtgcgtgcctgtaatctcagctattcgggaggctgaggcatgagaattgcttgaacctgggcagtagaggttgcagtgagctgagattgcactccagctgcactccatcctgggcaacagcacgaaactctgtctcaaaaaataaataaataaaatttaaaggccaaccaaggctgtaattatatatcagtaattaaaccaatcagtacttaccaggatatttgttgaccacactcatgagaaaatggatggttggattaatccatggtaggggattgactagttaagaacagaagattagagaggactggagagtattgttggtgaatgtctcacccatagaaccagctttcataggctgctgtgaaaggtcagtctaagaaggactgacatttgggagccactgcgctagagcccatctgctttaagttcttagtccattagttgttccttggagctccagcctccctacatgaactgcttcccctaagaaaaggaaaatatccggccaggcgtggtggctcatgcctgtaatctcagcactttgggaggccgaggctggcggatcacgaggtcaggagattgagaccatcctggctaacagggtgaaaccccttctctactaaaaatacaaaaaaaattagccgggtatggtggcgggcgcctatagtcccagctactccagaggctgaggcaggagaagtgtgaacccgtgaggcggagcttgcagtgagccgagatcatgccgcgccactgcactccagcctgggcgacagagcgagactgtctcaaaatatatatatatatccaagttacatcttacatctttctttttaagaaaatctttatatgtacctccttctgtcgagtgtccttactttcaatgaacttttttgagatataatttatatacagtaaaatgtacctattttaagtttacaattcagcggatgttgacaaatgtacaacccccagtatctgtcaccccagtcattatattgatcctcccaaaaagttctctcatgtccctttgtagtctcttcccccacattgatctactttttgtcactatagatttgttttgtgttctagaatttcatataaatgtttttgtttgtttttttaagagatgaggtctggctgtattgcctagactggtcttgaactcatgagctcaagtagtcctcccaccccagcctctcgagtagctgggactacaggtgcacacaccatgcctggctaatgttttttaatttttttagagatggggtcttgctgtgttgcccagactggtcttaaactcctggcctcaggcagttctcctgcctcagcctcctgagtaattgggactataggtgattatagggactatacttctttcacttggcatgattttgagattcacccgtgttgcatcaattctgttacatttcattgctgagtgctatctcatccatcctattttttcacctttattgccaagtctcctccaaacagaacctgtattatctccactgcttcacctctcatttactcctcaatcactactatttgtttcagcttttattatttccatgagactgctccttgctaagataactcttatttgtcagatttcatggtcactctttggaactatcatttgacttttttgaaggattcacctcagatttgacagttctaaaattaaaatcattatctttcctaaaaaccatttcatcttcccatatttctaatcttggttgatgacacccccagggtacttgtcattcacacgagaaacctggaagactttgactttccttcccttttactcagtcatttctttgctcccttataaataactcccaaatccatgtcccttctccatccctacttccagtgccgccttttgttcaggttcccatttttcccctaccttgtatattttcagaggcttcctaattaatcttgccctcctccatttcagtccattttttcctcattgtgctactatagtggattttctaagctatatctaatcttaatggttctccacttaaaaaatattttctggctggacatgtggctcacacctgtaatcccagcactttggtaagccaagatgggtggatcacttgaggccaggagttcaagaccagccaggccaatatggtgaaacccctgtctctaataaaaatacaagaaattagctaagcacggtgacatgtgcctgtaatcccaggtacttgggaggctgaggcatgagaattgcttgaacccaggaggcggaggttgcagtgagctggaatcacgccactgcactccagagcgagactctgtctcaaaaaaaaaaaaaaaaaaaaccttttctgacttctattgtctgtgagataaattccaaaattcttttcatggcataattcactacttcttaagtcatttgtttaatctattagagactttgctaagcattttacatgcaattacatctcttaatcttcacaacacttctatgagatagatattcctattccgaaaatcttattttacagaagaggaaactggctttgagacggtagggccaacaggtaaatggtagagtcaggatttgaatccaggtctggtcttaggtcttatacttttaaccactttaacgtactgtctcccatgagctctgaccccctactccctctccttttcacgtcatattccatgtgcaagctgtggtctagccatacagaattactttcagttttgcaaatatgtcgtgttcttttgtggttctgtgcatttgcacattgtttgcccttcctgtctttgactgtctgacccattcttgccatgctttaatacacaactcaaaagttgcttctccctgaagccttcctgggctcctccagatcactcttaaacatattcttagttctattacaacacttacctgacattgaacacatttggcatctagcacttagtaaataaagactttcttcatctttggatccttagtcacaagtacatgtaactaatacacaggtgcttagtaattaattattggtgaaataaattgaaagaaaatatctgttctacctgcctcatagagatgttttttgaaagtgagataataaatagaaaagtatctttcatattatgcaaatacatttattattatgcaaatgtaagggattatttttacttatctagtgatgagcaacttcctgaaggcagtccttggctcagacgctattattaatagtattgatttgcgttccagttcttctgtaggactgttccactcagagttttcccagtttctgctttttagcccctgtaatgttttgagaaggctagcctgagtcatgagtgaaattctttaggccctcactctttagattattgctcttatatttctctgtcctcatgtcattgatcatcaagtaaagatatatcttaagagaagcagtagtaacatttttatttatttatttatttatttatttgagacaggatctcactttgttgcctgggctaagtgcagtggtgcgatctcggctcactgcaacctccacatcccatgttcgagcaattcttgtgcctcagctgggcctacaggcgtgtgccaccatgcccgactaattattgtatttttagtagagacagggttttgccatgttcaccaggctggtctcgaactcctgacctcaagtgatctgcctgccccagcctcccaaagtgccataattgaaggaattacaggctaccacgcctggccaagagaagcagtaataatatttgtatgtttaaatatccttggaatggaactcatggtctacatggtaaactaattgtttacctatattttgcagatatatttgggacttttctgacatttcatgtaattagagatatatcttttaggagaatctagaggagactacaagctttgagaggagaactttttttttaagtctgttcccagatatcagatgtcttaagacttgcagcagtctttctgaattttacttatagatgaggcagaggatactaaacatcatataactggattatgctgattctctctagcaactttcaagttacattaaatattagtactgaaaattactttaaaatgccctactatatttaattttaaaaaattattattaattaatttattgttttagacagagcctctttctgtcacccaggctggagtgcagtgggatgatcacaactcactgcagccacaacctcccagggttaagcaattctcccacctcagcctcctgagtacgtgggacacaggcgtttgctacaccccctgctagtttttgggggtttttttttttggtagacacggggtctccctgtgttgtccaggctggtttttgactctcgggctcaagtgatcctcccgcctcagtctcccaaagtgctggggttacaagcatgagctactgtttccagccatgtgtttaattttaaaaattgaagaaaaaagacactatgaggaaatgacatgtaaaacacaaatcttttgaggcaaatgtgaagtggcacctattgctcagtattgcccaaaactgtgggacatgatcaacagagagaatggaaaacctagtcatgatagttaaatttgaaattaaccatcttctgaccctagttttttattgttgttgttgcttttaaatgtaaatataatctggatttccagttattactgatatcttcagcagtcacaactggtttcctatgccagtgttaatgaaatcttttcttggccagttcttttaaaaaaacgtaacaggccaggtgcagtagctcacatctgtaatcctagcactttgggaagctgaggtgggcagatcacctgaggttgggagttcgagaccagcctgaccaacatggagaatcgccgtctctactaaaaatacaaaattagccgggtgtggtggcgcatgtctgtaatcccagctactcgagaggctgaggcaggagaatcgcttgaacccgggaggcggaggttgcggtgagcctagatcacgccattgcactccagcctgaacaacaagagcgaaactccatctcaaaacaaaaccaaaaacaaacaaaaaaaacttttttgttaagttttgccacataaacaattttagagaaaatacctgacaatagttaatgattatttgttgtaggcaataatggtctaagcactttatatatattaacatttaatcctcacaactactctatgaattagctattcttattgtcctcattgtacagatgaagaaatagaggcacagagtggccaagtaacctcaagtcacacacacaagctcaacttttaagtatttaaatatacttcaaatatatttctaaaggagtctttaacagaaaaaagtactgactccatgtactttgctgctgcttttgtgatccctgttgaagtgacttcaagaagtgacaatgatgccaggcatttggttaagtatgatgtggtgagttaaccttaaaatagaaaatttggtcaataagcatttttattttggagccagagagctattttagggacctgctgcctggaaaggatatccttgggacagcagatcccttagttcctaatgaatagctgcatcaccaacacagcttctcctgaccatggtagggccatcagcagggtaactcagcccagcttattaacccttctgttttctttccagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatttgttaatagactgttctcttctaatagtcttttttttttttttttttttaagagatgaggtctcactatattgcccaggctggtttcaaactcctgggttcaagtgatcttcccgcctctgcctcctgaagtgctaggattataggcgagagccactgtgcccagccattgtaatacagtcttttgtttgaaatgcaaatgttagtgggccaaaaggacagtgttattaatatccctattctatgaagatgtctgttctaaaactgttttagtgatgctctataacagaatcaactatatccattaatcccatggtgttgataaatgaactagtccagctcttcccagtggttaatagatgttaacagcactgtaaatccatttcggccctataatttctggagcaaacgtgtatttttgctgcttttcttataaggagatgctactaattgactatcagaagaacatgttttgaggtcctcctcaaaacattgatgggttggaatcagccatcaacagtgttgtaccagttcttgggtcttgatagacaatttggaaagagatttccttgtttacgaagtgaaggactaagaattaaattaatgaccttggcctcactggcaatcaattacaaatctctatatcagtaagagaattgtaaaattcagaagcagtttacattagactttggaatgaatgatgaactttccccattagagctgccatcatatgattggtggagattgtttaaagaatcattctatctcagcctcaaaaattaccacgggaagatggtatcagtatcactacttaacagatgaagaatctaatgctgtgtgcccatggacacacaaaattaagctgttgggacttgaacagctcaaattttcttgtttcagatcaccagctcttgagtaatagggaaatctggagatttgaaaagtacttgcactgtccacaacatggctaatccatatgtggatgatgcagaattgatttaattcactaacagggaccccataattatttgctgggctctgggtatattgatgtgtaggaagttgtactatatgttaataaattatgactatttggataggctgaattcatactaaatccatactgtagttcaacaaaaaacaacatgtttatatacatttggaaactgcaatgataggaaacatttggaagaaagggattttgccctagaataacacataaggaaagcagagaattagagtatattgttactgaatgttccagagacttctagtgattttaacacttattaagtatagcatgttgatggggagatttgtttctctaaagatcactttgttttattaaatcctaatagaaaatacccttgaaaatcctatctcatttattcctgtaacaaatttattgagcacctacctactatatgccaagaaatgtattagccatcaggcagagagctgttcaaatggtagatatgatctgtgctcctgtgaaacttctagtggggagagccaaacaataaacaatattcctttttaactctaggttaatgcagaaatggataaagcccatgttgcttttgggagaggtgagttgtgtctctgaatcacatgcatttcatagggggaaaaatgcccaaatactaaggagtagctcttagcctatgtccgttcgcctcagcttaagttgttttccctcccactggctgggcagcatatttgtgttttacctggtaaaacagtaaatttcgtaccttctataattggcattcttcaaagaggtagaactttgatttttttgtagaatattaaaacaagctttcttaggttaaagaagtgatcttactacgaacagcaatggtttcatgatgtgtaattgctttatgttatctttctgctatagaatgtttcctggagaaaggtacggtttttagtaataagataaatttactttagtcctgcaaataaggtgaaatcttatgtccagtatctcacaaaggaga

SEQ ID NO: 16483 - DNA, 29628 bp, Human
agctgggctcaaatgatcttcccgcctcagcctcccaaagcactgggaatataggcccgcaaattgatttttttaaagggtaaaatgggctgggcatggtggcttatgcttgtaatcccagaactttgggagggcaaggcgagaggatcatttaagcccaggagtttgagaccagcctgggcaacatagggagattctgtccctacgaaaattacaaaaaaaaaaaaaattagctgggtgtcgtgacacacacctgtggtcccagctacttgggaggctgaggcggcaggatcactggagcccaggagtttgaggatgcagtgagccttgatcgggccgcggccactccagcctggatgacagaacgagaccttctttctttttttttttttgagacagagtctcgttctgtcgcccaggctggagtgcagtggcgcgatctctgctcactgcaagctccgcctcccaggttcacgccattctgtctcagcttccagagtagctgggactacaggtgcctgccaccacgcccggctaattttttttttttttgtatttttagtagagacaggggtttcaccgtgttagccaagatggtcttgatctcctgacctcgtgatccgcccgccttcgcctcgcaaagtgctgggattaccggcgtgagccaccgcgcccggccgagaccctttcttaaaataaataaaataataaaataacaatttaaaaatagataacttctatataacacccagtgaatgacaaaatggtttcaaaaaaaattcccgaggggttggtaagatagtatactactatgaaaggataaaaaccaaaaaacgccgaaaatgttcatgtaatgtttaagaacattgggctttggagtaaaatctggtttatagtctagactctctccttggaagagtgatagaacttctctgagcttccattttttcttttttttcttttctggttttgttttgtttttttttttttttttttgacggagtctcgctctgtcgcccaggctggagtgcaatggcacgatctcggctcattgcaacctccgcctcccaggttcaagcgattctcctgcctcagcctgccgagtagctgggactacagacacgtgccaccacgcccggctaatttttgtgtatttttagtagagacggggtttcaccgtgttggccaggatggtctcgatctcctgacctcgtgatccgcccgcctcggcctcccacagtgttggattacaggcttgagccaccgcgcctggccgagcttccgtttttctttctataaaattgggatgatacgaatatcatagtgctgtttttaggattaaaccagattatagttgtaaaagagcagaacctgttgtaggataaaccctcaataaatgtgaaatgttaacaattattgttaaataaatgttacagaacaatgctctcacccccacctccccgggctacccggggtaagaaagggtagacaaagaggaaaaatcctccacatggggcgatacatcctcctattttaaggaagaatccagaggctaccatgcatctttcctagcatatacatcactttgtcattatctggtacagagtcggccctgaaactacaccctttctatttttcatccaatcacatcacccgtgaaaggcactctcccttctccaccctttcttgcccctactcccacccctagcttcccagtttacttttcccagtcactcattcccctcttccccgccccgcccagaggtcgtggcttctccctcgccccgcctattttctaattttcccgcctcagtagctcttggccatttggggatgtagttgtttcttttcccccgcctcttcgtgacgtttcagaaataagacctatgattggtttttccggagcaagagccggccaatgacaggcagatatttttggtgcagatgggcagccagtattatcgccgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtgagatgttggagtgggaagggacggggcttggatccttggccttggggggcttgtcgagctgatctagtttgtgtgggtgttccaggtcggcggagttggctttctctctccctgcattgcctctggccgagctgcaaccgcctccgcctattacagaggtaaggacatgtttacagtgagcgctccccatcaacccaggggtgtgcctcaagagccactgagtgccctgtcactggaggagagcaaactgcttagcagaaatgtttgtagagggaattcaggcattcaaagagctgagtgttttaaatgattttatccatttagttttcttgagctttgaaagacttggtgtgctcttatttaaagctggggagaattagtaaacaattactgcttatgatttcagccttttagggcttatagccaaacctagacataagagtgcctcataatagtaaatattattataaggaattattataaggatatctcataataaatacccaaaaggatgagaagaatcaaaagttttggtctggcgcggtggttcacgcctgtaatcccaacactttaggaggccgaggtgggcggatcacgaggttattcgagaccagcttggccaacacggtgaaaccccgtctctagtaaaaatacaaaattagccggacatggtggcgcgcgcctgtaatcccagttactcgggaggctgagacaggagaatcgcttaaacccgggaggcgaaggttgcagtgagctgagatcgcgccattgcactccagcccgagggcagagcgggacactgtctcaaaataaataataaataaataaagtttttacaatacctacactgttgtctgatcagcatagcaaataatggttaagtttgggtgctggattgagacgactctgggttcaaatgacctttggcaacttaaccttctgagccagtttcctcatctgtgcagtgacgatagtaatagtatctactcaatggggatattgagagaagtcaatgagataataatatagaccgcttagaagtgtgcctggtgcttgcatctatatttcggtcaagttctttattagcagcaccaatgtgggcaaatgatttctaagtgacagccttctcatctatagataatgttaataattgctgcgttttcaagaagattaaataaagcaataagggtaaagcatacggtatactcttaggtaaattttttgagtcaatgcagtttatatttgtctcattagcttttactcttgtgcccactttcataatgcctaggcccatcgttggtcctgaataggataaataattgtttttgttgtttaaattttagattcaggggttacttgtgcagatttgctacatggatatattgtgtgattctgaggttgggcttcagttgaacccatcatccaaatagtgaacataatacctgatagacagttttattttattttacttttttttttttttgagacggagtcttgctcttgttgcccaggctggagtgcaatggcatgatggctcactgcaacctctgcctcccgggttcaagcaattctcctgcctcaacctcccgagtagctcggattacaggcacccgtcaccacgcctgggtaactttttgtatttttagtagggacagggtttcaccctgtttaccaggctggtctggaactcctgacttcaggtgatccacctaccttggcctctcaaagtgctgggacctggccagatagttttcaccctttgctttcctccttccccactcttggagtccctggtgtctgttgttcccatctttaagtccgtgtgtacccagtgatcagcttccacttgtaagtgagaacatgctgtatttgggtttctatttctgtgttaattcactttggataatggcctctagctgcatccatgttactgcaaaggacatgattttgttcttttttatggctgtgtcgtattccatggtgtatatgtaccacattttctttagtgcaccattgatgggcacctagattgattccatgtctttgccattgtgaatagtgctgtggtaaacatgcgagtgcagatgtttttttggtagaataatttattttcctttgggtatatacccagtaatgggattgctgagtcaaatggtaattctgtttttagttctttgaaaaatctgtgaactctgttagttcagaggctgaactaacttaacagttccatcaacagtgtataagtgttccctaaataggataaataactattgaatgagtaaataaagcatatttattgagaagtagagcctcagtaaatatcaccctctcctgagggtttgtattatatacagggattttacagacattgcagaaacctgaccattattgaattattgtaaagtattagctattggtttgttgaatagctttcagtttgctgtgagaatgattgattcagcagcctctttaccaatttgttgtgtacttagtgttttcaggtcttctctagggactatctctgaaaaaccccagagtaatgttttgatctaaagtgtaaactagagtaaaccttaaaactgtgatttatttactttattttgtttatttatttttttgagatggaatgttgctctgtcacccaggctggaatgcagtagtttgatctcggctcactgcagcctctgcctcccaggttcaagggattctccttcctcagcctcctgagtagctgggactacaggcgtgtgccaccacacccagctaattttttgtatttttagtagagatggggtttcaccgtgttggccaggctggtttgaattcctgaactcagctgatccacccaccgaggcatcccagggtgctggggttacaggtgtgagccaccgtgcctggccaaaactgtgaatttttttttttttttttgagacggagtcttgcactgttacccaggctggagtgcagtggctcaatctcggctcaccgcaacctccacctcccaggttcaagcaattctcctgtcccagcctcctgagtagctgggattacaggtgcatgccacaacacctggctaatttttttgtatttttagtagagaggaggtttcaccatgttggccaggctggtctcgaactcctgacctcaagtgatccacccctctcagcctcccaaagtgctgtgctgggattacatgcatgattcactgctctcagccataactgtgatatttaaagttattaaaatgcaagagtattatgcttgctcaatctacgtagtagatgtttgttatagcttactctcaatttttttttttttttgagacggagttttgctgtattacccaggctagggtgcaatggcccaatatcggctcactgcaacctctggctcctgggtttcagtgattctcctgcctcagcctcccgaatagccgggattaccgaatgtgccaccacgcctggctaatttttgtatttttaacagagacgaggtttcaccatgttggccaggctggcctcaaactgctgaccttaggtgatccacccacctcagcctcccaaagtgctaggattacaggtgtgagccaccacacccggcttgcttactctcagtgttttataaacattaccaaagaagcatgtcatataaggccttaaactcgttatcctttgtcttggacttaaagcttttcttttcttttcttttctttttttttttttgagtctcactctgttgcccaggctggagtgcaatggcatgatctccacttactgcaacctccacctcccaggttcaagtgattctccttcctcagcctcccaagtagctgggattacaggtgctcaccaccacacctggctaattttttgtatttttagtagagatggggtttcaccatgttggctaggctggtcttgaactcttgacctcaggtgatccacctgtcttagcctcccaaagtgctgggattacaggcatgagccaccacacctggccctgaagcttagcttttctgaatataagatgtgactaggaccaattgtggcttcttggtttaaaaactcaacctggctgagcatggtggcccatgcctgtaatcccagcactttgggaggactgcttgaggccgggagttccagaccagcctaagcaacatagtgaaactatatctgtactagaaatacatggtggtgcggtggcacgcacctgtggacccagtgacttcagaggctgaggtgggaggaggatcacttgagcccaggaggctgaggttggagtgatttgagattgcgccactacactgcagcccaggagacagagtgagatcctgtctcaaaacgaaacaaaactcagccaaatgctaaatgcctctaaattacatgtaattttcagtagaacattccagattcttcccataagcaagaatgaaacaaaaaaatttaagattatataatccaaatagtaaaactttctgaattataaggatatatcgactgttacgaatatattttatgctgggcctatagtatgcatgtatacatagtcttgtataatctgaatgcttttcattataatccattttgttttcctgatgatgcctttcttgatttttttgtcccattcagcaataacaagtatttcttactcaaaaaggcataatgcaggtgaaagagttagggggaaagaaataaacaagtggtgagttgatatgagaagggcctccagaatcctaaatcaaatggtcgtatttaggacatgttgatctaatgaagaaagcactgaatatgttttggttccagttttgttctggtgatatttggggcaagaaagatgaggaaaatacagttattcaaattttaattaactcatccttagaatttggaggattgggccggtggtggctcgtgcctgtaatcccagcactctgctgtgagttcaaggcgggtggatcgcttgaggtcaggagttcaagaccagcctggtgaaactccgtctctactaaaatacaaaaattagccaggcatggtggcgggcacctgtaatcccagctgctagggaggccgaggcaggagaattgcttgaacctagaaggtggaggttacagtcagccaatatcgcaccactgcattccatcctaggcgacagagcgaggctctgtctcaaaaaaaaaaaagaatttgggggattgaatttttgttttttgttttttttttgagacagagtcttgctacgtcaccagattgaagtgatgtggcgcgatcttggctcactgcagcaaggctcagcctcccgagtagctgggacccccggcacatagtaccatgcccaactatttttttgtatttttagtagaggcagggtcttgccacgttgcccaggccggtcctgaactcctgagttcaagccatcctcttgccctggtctcccacagtgctgggattacagccactgcgctcagccaaggattgtatgtttttaacttaaatgtgacattatctaatttttttttaacatagagaattacagctgtgttctgtgccttcagcaatactaaattatgacaaaactttattgaagtacaaaaaatataagtaattgcacgtacattgcatttatgtaggactgtaaaagacaggagaaggaatagaatgccagtattaatgctggatattttatgtgactcacattttcctcaagtcaaatctgtaaggtcagtattattggcttcattttacagatgaagaaatggatgctaagagaagctaagtaacctccctaccaatgtcctgaaaccaggaaatcaaaaagtcagaatttgaatctaggtccttaacactaaagcctattcaactttctactacatttatagaaacaatacacatttatgagtgttcgtttagttttttaaagttttcttttttctccatttttttattttgaaaaaattagaaagaaaaacttggccgggtgcggtcgctcatacctgtaattccagcactttgggaagccgaggcaggcagatcacttgaggccctgagtttgagaccagcctggccaacatggcgaaaccccatcactactaaaaatacaaaaattagctggaagtggtggcgcacacctgtaatcccagctactctggcagctgaggcacaataatcgcttgaacctgggaggcagaggttgcagtgagctgagattgcgccactgcactccagcctgggtgacagagtgaggctctgtctcaaaaaaaaaaaaaaaaaaagagttctatgggcttacttggtaataaaataaatatataaaattatatatatatgcatctacatattctaggtttttaggaggaagaaaacaatcctttttcttttacatcttgaaattaacgaatatactttttagatttgaagttttgttgtcctattcccaaccacttacataagcttgtttcttttttaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattaatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgtacttctcatttcctagtacaggttgagtatcccttatttgaagtgcttgggaccaaaagtgtttcagatttcagatttttttcagattttggtatatttgcattatacttactggttgaaataaaaaatgctgcagtgagtgtcattggtgctttgagtgtcattggtgctgaaaaagttttgggttttggagcaatgcagatttcagatcttatgatttaggttgatcaactattagcatagcttgtatttgtcaagcgtggtaaattcttgcagttatggactatgtttaagtcatctttgtttttttttttttttccaatttaccattttaacatttttaaagtgtacagttcagtggtattaaatgcattcataatgtgcaaccatcaccaccacccatctctagaacattttttatcttgtaaaactaaaattctatacccattaaacaataactctccatttttccctttccccaaggtggaccccttggcaaccactattctattttctgtttctatgatctggactactctaagtaccttacataagtggaatcatgcagtattagtctctttgtgactggcttatttcacttaccataatgctgtcaagtttcatccatgttgtagcatatataagaatttccttttttaaagtttaataatattccattgtatttatataccacagtttgcttatctccatgagtttaagaaagatattttgaaattatgggatttaaaaagttaatctttcacatacaatctatacctgtgtagaagcactaatttggatgagttatggtagaatagaaccagcatttgctgaagtttgggataaaataaagttccttaaggcaaatatataaaatataaaaggaagcccgggcggcatggtgaaaccccgtctctacaaaaaatacaataattagccaggtgtggtggtgtgtgcctgtggccccagctacttgggaggctgagataggaggatcgcttgagcccaggtggtggaggttacagtgagccaagattgtaccactatactccagcctgggcaacagagcaagaccctgtcaccaaaaaaaaaaagaaagaaagaaaaagtccgggcgcggtagctcacgcctgtaatcccagcactttgggaggcagaggcgggcggatcacgaggtcaggagatcaagaccacggtgaaaccccgtctctactaaaaatacaaaaaattagctgggcgcagtggcgagcgcctgtagtcccagctactcgggaggctgaggcaggagaatggcgtgaacccggaaggtggagcttgcagtgagccgagatcataccactatactccagcctgggcggcagagtgagactccgtctccaaaaaaaaaaaaaagaaaaaagagagtctgaatgtttactttgctttttaaccttttatttgaaaatgattccaaattgacaagttgcgagaataagaatagtacaaagaatacttatgtacttttttttttttttttgaaatggagtctttctctgtcacccaggctggagtgcagtggtgcgatctcaactcactgcaacctctgcctcccgggttcaagcctttctcttacctcagcctcccaagtagctgggactacaggtgcatgccagcatgtccagttaatttttgtaattttagtagagatggggtttcatcatattggtcaggctggtctcgaactcctgacctcaggtgatccacctgccttggcctcccaaagtgctgggattacaggcgtgagccactgtgcctggcacttctgtactctttatagttttgcctattgtgaacattaatcctatttgctttatcatttctctctactttatctctacacaacgtgtgcatacacatggaattgttttactctgaaccatttgagaataagttgcagatatcatcattctttaccccaaatgctttaatttgttctctttagaataaggacattttcttaaataaccacaacatagttatcaactttagtaaatttcacaccatattgttaaatatggcatttgatactatattcaatctattattgaattccaattttttttttatttgagatggagtctagctctgtcacccaggctggagtgcagtgttgtgatctcagctcactgcaacctccgcctcccaggttcaagcgattctctagcctcagcctcctgggtagctgggattacaggtgctcactatcatgcccggctaatttttgtattttttagtagggacggggtttcgccacgttgaccaggctgctctggaactcctgacctcaggtgattggcgtgcctcggcctcccaaagtgctaggattacaggtgtgagccactgcacccggccgaattccaatcttgtcaattgagccagcagtgtcttctatagcatttccccctcagtacaatctagaatcagttgtcatgtctctttaatctccgctaatctgaaacagccttatttgtcttttatgacattgactttttttgaaatttataaatcttccctccctgtttctttttctttctttcttttttttaatcaatagagtattttttagagcagttttagattcacagcaaaattgagcagaaagtacaggagttcccatatacctccttctcccctctcacagaggttctgtcaccatcagtatcctgcaccagtgtgatatatttgttgtaatcaatgaaccagtattgacacatatcaacaaaagtccacagtttacattagggttcaccctgtgttgtacattctgtgggtttgacttcttttccctttccatttccccttcctttcctttccctctctcctccttttttcacatattcttggtatgtgaatctttcccttttgttaatagaacattcttcattttggatatgtctgatgttttttcacagggcatcgcatctagtgttacacaatgcctttaagcccctcactgctaatgttaattttgatcatttgatgaagatgttatccattttctccactgtgtagttactgttatttcccttgcaactcatcaacagtctgtgcggataacattttaagaccatgcagatatcttgctcctcatacaaatttttctctaaatttagtattcattgttaatttttatctgaagcaatctttactataatgtttcaaaatgatgattatctactctagcattttgtctacatttactactcaacgcttggcattctactttaagaaagagccttccctccctttccccatttatttatctatttagtatcagtatgaactcatggattcctatatttttaattgtacataattcattacttaattattttggtgctcagataactccagatttggccagggaggccctgaagagttatttgaaattagtgaccagctgggcacagtggctcacgcctgtaatcccaacactttgggaggccaaggtgggcaaatcacttgaggtctggagttcgagaccagcctgaccagcatgatgaaacctcgtcgcaactaaaaatacaaaaattagccaggcgtggtggcgggtgcctgtaatcctagctactcgggaggctgaggctggagaatcacttgaacctgggaggcagaggttgcagtgagctgagaccacgctactgcactccagcctgggcaacaaagcaaagtgagactgtctcaaataaataaataaataaataatgaccaaaagtcgatgccattttggttgaacttggccctttaggtaggatcaggatgctagttttaaagtatgttttagaataaactgaaaaaagacctatttgttgattttctcttacagtctggagaaaaaaagaaggacgatgaaacagttgatagcttaggtacgaatttttttcttttaccttttgacctaaaaagcagggttgcaaacttaaatgcctccaacagccaggcaggtaatatgaatggtctgaggataaccattacaaattggaaagcacctggcttatctcagctaccttgtacccagctatagctgagggctgtcttgggggaatctggggttggtattgtgatggctttcttcccttggccctaccctgttccctgcaacctgaagctagaaatttagagttttatttgaggtttttgatttttaaacattcataacgaattcaaataaaaactgtgtgggtctaacagaatgactgtaaacccattagtagttgcaatttctggaatacagtaaatgggttgtgtaagatatcattggtaccttgtgtttgctagaggtttcaggtgtaactttcgttgatgctaaagagaatatctatgcatatgaaaatgagctgggtacagtggctcacacctataatcccagcactttgggagtctgaggcggaaggatcacttgagcccaggagtttgagaccagcctagggaacatagcgagaccctgtctctagaaaaataaataaataaataaaataagaaaatgaaaaccagcatcctaaccttagaacagagactctgtttctttcctaggccccctggaaaaaggacaagtgaaaaatgaggcgcttagagaattgagagtggagctcagcaaaaaacaccaagctcgagaacttgatggatttggactttatctgtaagtgttacagtaatttggaactttctgtaacatattctcctgagtagaaagcagctattaaatagcattaacttctgtgattgtttcttttttttcccaggtatggtgtggtgcttcgaaaactggacttggttaaagaggccattgatgtgtttgtggaagctactcatgttttgcccttgcattggggagcctggttagaactctgtaacctgatcacagacaaagagatggtaaattgtgatgagctatgtgaaaaaccctctgcttcaagccttttgtaattctgtagtaatataggggtggggaaagttttggcagggctttggttatagttctccctttgctgcgcctctggtgtcttttcgctgttttggaagtaagtctttgtttgaaagactgatgactagctctttttcagtagttgctgttggatttgtatccagttatactagaatatttttttcatattcatgttttcacatttcagttctattgtgacttgtttttgtttttgtttgagacggagtcttgctctttcatctaggctggagtgcagtggtgcgatcttggctcacggcaacctctgcctcccaggttcaagcaattcttctgcctcagcctcccaagtagctgggactacaggcacgcacaaccatccccagctaatttttgtatttttagtagagatggggtttcaccatgtcggccaggctggcttcgaactcctgacctcaggtgatcctcctgcctcaatctcccaaagtgctgggattacaggcatgaaccaccacgcccagcctatgttacttattttatagactgaatattgttgtagtttgtcccctaatcccaaagatgctataggaaaggtttctctgctgtcaagaattgtattaaaacattatggccaggcacggtggctcatgcctgtaatcctagcactttgggaagccaaggtgggtggatcacctgaggtcaggagttcaagaccagcctggtcaacgtggtgaaaccatgtctctactgaaaatataaaaattaaccaggtgtggttgtggatgcctgtaatcccagctactcgggaggctgaggcaagagaatcacttgaacttgaggggcagaggttgcagtgagccctgatggtgctatttcactctagcctgggcgaaagagcgaaactctgtctcaaacaaacaaacaaacaaacaaacaaaaaattgttcaggcctcttctgagctgtcatggattctgtaaagattcagaaatttgcttattaaagaaataatgtatactaagttgttcttaaactccagtcattttattagccattagtagaggatattgtctatagtgtttattttgctgttcttcagtagttaatggaagcaacaatacacttcctttttttggccttaaagtcttgttgatttcccccagtagtgatttatgtcactaaatctgtatctgaaatcttatcttggtttacttttattcacctatgtgtaactgcctactagactttcattgaaggtttgttaaacaatctctggattcaaaatagcaaaaccaaattccttgtcttgcctactaaattatttctcccaacttgatagacttttactagcatcgctattaacgacatccagtcttgacacattagagtcatacttgtgtcttccttttctcttatctgcctttatctagtctgtcatgagacataaccatagttactttcttgtatacatctctttctcttggtttcctttatcatctcagttgtcatctcaaatttggattacttataagtaatgggtactttctatctagggttcccatttttatacttccatttccaagtcatctctatactgtttccaaactatttctttcttttttttgtttgtggagatgaggtttcactctcttgtcagggctggtgtcaaactcctggcctcaagggatcctttcccatagcctcccaaagtgctggggttgcaggcttgagccattccacctggcctgtttccaaacttattcttaaagctcccatgtcatcatgtcattctcttactgaatatttgcagtggttccctattgtatcccattatctgttgtaccctaggatgcgctctaccagttcagtttgatttttctgctacttcccagtacatagcctccccgcaaaccaagctagtttctttgtcctactcactcacaatcatcatgactgttttgcctctccttatgctattacccgtgtctagactattgtcttctttctcttcctctccccttttgtattcaaatcctacccattctctaagactcacctcaaatcctgtcttttctttggagcctttcccaactaggctgttcctccctattatgcttgtaagtcatattcagttaattggactgtcctgttttcattactaggtgttctaataaaattttagtgataaattcctttagataataaagatagttcctggatgtttgtttgagagagaggtcaagttatattaagtgtgtccctctctctcctgctgccagctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagaggtgagtgaataaagacaatgaaatactatcagaccctgacaggtgcattgtgctgttttctgaactatcttctttctgcagatattgacaaagccctctccatttttaatgagctaaggaaacaagacccttacaggattgaaaatatggacacattctccaaccttctttatgtcagggtgagctgcttcccttgcttggatttgattaagctcttttgtgcactaatctgggttggattgtcacccacttgtattagctacaggaaaaataatttagggagttcttttttcatgcttatattgtctttttcttttatcccagagcatgaaatcggagttgagttatctggctcataacctctgtgagattgataaatatcgtgtagaaacgtgctgtgtaattggtaagaattaactacattttttcttttaagatttatatttattataagtaacacatgtgaaaataaccacaattagctagggatggtggtgcgtgcctttagtttcctctactcaggagactgaggcgggaggatcgcttgagagcccagatgtcagggcagcagtcagctgtgatcatgtcactgcactccagggctgggcaacagagtgagagcccatctcttaaacaaacaaacaaacaaaccaacaagcaaacaaaaactcaataatacaaaagtgccaaaggtaacaaatacataccatagaatgtgaaagctcactgattaatcctactctgaagattgtttggtgaacatgattccaggatatttttctgtgcaaatagtaaaaatgtatgtgtaggggctgggcgcggtggctcatgcctgtaatcccagcactttgggatgccagggcaggcagatcatgaggtgaggtattcgagaccagcctggccaatatggtggaatcccatctctactaaaaatccaaaaattagccgggtgtggtggcatgtgcctgtagtcccagctgcttgggaagttgaggcagaagaatcacatgaacctgggaggtggaggttgcagtgagccaagatcgtgccactacactccagcctgggcgatagagtgagactccgtctcaaaaaaaaaaaaaaataaataaatatgtattacatgttacgtctgtattgtttgcttgccaaaactgtatcattatacatagtgctatctaacttccttttttttaacttaatgatatatctttgccatcttttcatgttagtacatttaaacttgtattatttttgatgactagcattttatagatgtactttttttttttttttttttggtgacagagtctcgctctgtcgtccaggctggagtgcagtggcgccattggctcactgaaagctctgcctcccgggtttacaccattctcctgcctcagcctcccgagtagctgggactacaggtgcctgccaccacgcccggctaattttttgtatttttagtagagactgggtttctactactacaacgattctttttttttaaacatatttttaacagttctttttaaaacagagacagttaaaatcaaaggaagccaggcataattactagcttcagtagtcttagtgacttgggaggttgaggcaggagatggcctcagcccagggttcgagtccagcctgggcaaccccatctggctttagacagtgagaccctgtctctatttaaaaaaaaaaaaaaaaaaaaaaaggaaaaaaaaaggccaggcgcggtggctcacacctgtaatcccagcactttgggaggccaaggcaggtggatcacgaggtcaggagatcgagaccatcctggctaacatggtgaaaccccatctctacaaaaaatacaaaaaattagctgggcgtggtggcgggcgcctgtagtccaagctactcgggaggctgaggcaggagaatggtgtgaaccctggaggcggaggttgcagtgagccgagatcgtgccactgcactccagcctaggcgacggagtgagactccatctcaaaaaaaaaggccgggcacgggggctcacagcgcctgtaatcccagcactttgggaggccaaggcgggtggatcataaggtcaggagttcgagaccagcctggccaacatggaaaccctgtttctactaaaaatacaaaaattagctaggcgtggtggcaggcacctgtaatcccagctacttgggaggctgaggcaggagaattgcttgaacccaggaggccgaggttgcagtgagccaagatcatgccactgtgctccagcctgggcaacagtgagactccatctcaaaaaaaaaaaaaaatcaatatatatgagaagaataattattaagaagcttcttttttctttcttttaataatcattcgaggtgaactccttaatgaattgtgttttttttccttaatatatccataatgcccagtaaaatttctgcatacagtcaataaatgtttgttgaattcagcccacctaccttaaaaatcagagcggggaacattagatatgacaaaaaataatacgctagctttcatattatagccagttcagaggaagtgaaaaggagaaagaaggatggagagaagaaaaggaaactgaggacctgagagaatgagacaatcttaagagtagagtgatggcaagaatctcctacttgtttagtcctggcttcttttgcttttatgtcttgatgtgacttgctcccttctgtacctgtcagtcacagtctctacttgagcggcagcattttattttatatatatatgtatataatatatattatatatatgtatatatatacacatatataaaatatatgtatatatatacatatataatatatgtatatatatacatatatattatatgtatatatgcatatatattatatgtatatatgcatatataaaatatatgtatataatatatattatatatgtatatatatttatatttatatataaatatatcatatattatatatatataatatatataaatatattatatataattatattatatataaatatatataatttatatatatttatatatatatattttttacatatatgtatactgcagtatagcatagttaagctttggactctgagccagattgcccaattttaaattctggtttagatactaactagctgtgtaatcttggacaagttacctaaccttctgtgctttagttccttcatctgtaaaaggagaataataaaatgtgagccactgcgcctggcccataaaggagattttttaaagtgcagggtttcttttgcttgctgtacctttccccctttaagttacttgtgttaacatgttctcatgccacattaaaaggaatatgtatatatacatatgcaaggtttaatgggctgcttgctttacaaaaataggatattatatacatactctgcattttggttttctcattcaacagtatttcatgaaaatccttcttagtcttggtgtagctcttcattctttttaaaaaaaatatagcttaggccagtgcaggggctcagcactttgggaggctgaggcaggaggattacttgagcccaggagttcaagaccagcctgggcgggtggatcacctgagctcaggagttcgagaccagcctggccaacatggtgaaaccctgtcactactaaaaatatgaaaattagccgggcatggtggcggatacctgtaatcccagctactcaggagactgaggcaggagaatcgctagaatccgggaggcggagggtgcagtgagccaaggtcgtaccattgcactccagcctgggcgacaagagcgaaactctgtctcaaaaaaaaaaaaaaaaaaaagacaccaaaaaaacacatagttttattgaggtataatttgcataccataaaatgttaagtctacatttcaatgagtttttgtaaatttatgcagttgtaaccattaccataatccagtttagaatactccatcaccccaaaaagttccctcgtgtgtatttgcagtcagtcccattcccatcccccagcaaccactgctttgcttctttatagttttgcctgttccaggaatttcatataaatagattcttgcaatatttagtcttattgtctggcttctttcagttagcttttttttgagacacggtctctctctgtcaccaggctggagtgcagtggcgtgaattcctgggctcaagctttctcctgcctcagcctctggagtagctgggactacaggcatatatcaccacacctggatactttttatttttagagacagggtctcactatgttgcccatgctggtctcgaactcctgaccttaagtgatcctcccacctcagcctcccatccattagcatgcttttgaggttcatccatattgtagcatgtatcagtagttccttttattgctgagtagtattccatgtttggatatgccacattttgtttattcaccagttgatataagacagatggctcttatactttcttcagctgaaatctttcacttccactttttaagaccaatgagaatagaactgctttgattcttgtgtgagagggaaacttagagcgctaccttttttttttttttggagacggagttttgcttttgttgcccaggctggagtgcaatggcgcgatcttggctcaccgcaacctccgcctcctgggttcaagcgattctcctgccttagcctcctgaggagctgggattacaggcatgtgccaccatgcccagctaattttgtatttttagtagagaccgagtttcttcctattggtcagactggtctcgaactcctgacctcaggtgatccgcccgccttagcctcccaaagtggtgggattacaggcgtgatccaccactcctggtcagaatgctacctttttaacccttgaggtacctgttttttttttttgagacagaatcatacctctttttttcctttttttttaagatgttgttttgctctattacccaagctggagtgcagtggcacgatctcagctcattgcaacctctgcctcccaggttcaagcgattctcctgcctcagcttcctgagtagctgggactacagatgtgcgccactatgcccggctaatttttgtatttttagtagagacagggttttgccatgttggccaggctggtctgaaacttctgacctcaggtgatctgtccaccttggcctcccaaagtgctgggattacaggcgtgagtcaccatgcccagcctgggtacctctttagaaacctaggctccaaggaatatagtttgaaaaccaccgatgtaaagcataatctaagaaaatgtatatataggccagatgtggtggctcatgcctttgattccagcactttgggaggctgaggcaggaagatcgcttgagctcaggagtttgagaccaccctggcaacatagggagactgtctccacaaaaaaatttaaaaattaccccggcttggtggcatgtgcctgtgctcccagctacttgaaagccttatgtgggaggattgcttgagctcaggaggttgaggctgcagtgagctgtgattacactactgctttccagcctgtgtgacaaagcaagactttgtctcagaaaaaaagaaagaaagagactgtgtatataaatgctgtatccaggtgatattaaaaggaataaaaacttgcagtgtttaagaatacttttttttttaaccggaatgtgtgacagatgaaatatatttcccaagggaatatttcccttttgtacaatttgggtgttttgccaggactttagagggaatgggttatggtttcacgcccatttggtggaatgctatctattttaatggacttttatttttacctttctgattattcatttttttgtttgatttttaatcaggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttataggtgattatctataggtggtgaggtagagcagattgctgtggttaggagcctctaagcctgcaagttgccaaccttgattctgccttcttaacaacctgtcttttccatttcttagacatgccattgaggtcaacaaacgggactacagagcttggtatggcctcgggcagacctatgaaatccttaagatgccattttactgcctttattattatagacgggcccaccagcttcggtaagcctggtcacttgacaatgcgtctgatatgggaagggctaataacttttttttcctcttttgatagctattgacaaatcacagtggatggttttggctcttggggatctgaggttaaagttgctgaaggctgtttggttattttcatttagtatatttcactaatgggttaatagtataattatgaacacaaagtaatctattatatggagcatcaggttaaagaccagttgttgcatagatttgaaatagtggtgtactggttcctcaaaagagaacttcagtttctgtaaagtctttgctcagactgcctgttcttctttctcagacccaatgattctcgcatgctggttgctttaggagaatgttacgagaaactcaatcaactagtggaagccaaaaaggtaccttaaattgggtcctgaagaatttgagtggaaatctgctgtttagatgaaggttgggctatctgtgctctaatttttcccttattctgatctaggtgcataggaaagtctgaatatttatagatacatagtctgaaagcaaagctgggccaaggtcatcagtgggaatgtcagtgtgtagcctagacctatcagaactagtaaaaatgtcttgcattctataaatctgaacttctgggaggcttgcagggtcttaaccttcatatgatttagttgtgacacatgggacaatggtcaaaatgaccagtttatttttttgacagtgttattggagagcttacgccgtgggagatgtggagaaaatggctctggtgaaactggcaaagtgagtgaaaggagtgaaatgctattgatatttctgttggcttctctgggatggtgggtcctgcatggtctagagcctcccatacacccatcattctacataggtgtagggatgtagcagggtgtgtgaatgctggtttgtgaatgtagccatcttgttcctagagaatgccacttctggccaggtgcagtggctcatgcctgtaattctagcactttgggcggctgagggaggtggatgacctgaggtcaggagttcaagacctgggaggtggaggttgcagtgagccgagatcgcgccattgcactccagcctgggcaacaagagcaaaactccatctcaaaataaaaaaaataaaaagagaatgctacttctcttgaaggagggccgttgctttcctattaaagcaagagatcaagattgatttgaagaaaggataacatttttgtgtcaaactactttcagtattaatttcctgctaagggccagaaaaattaggaataactcaaatagtaggcaaagaggttcttaaatgtaaagaggttcctgtctggattcttaggaaaaaaattgagttgcttggtatcttttttttttttttgtaatttatagataggatcttgctgtgatgaccaggttggtcttgaagtcattggtctcagccagattagagagtagctaggattatggccctatgccaccatgcctggccacttgttatcttttttttttgagacggagtcttgctctgtcacggaggctagagtgcaacctctgcctcctgggttcaaatgattctcctgcctcagtctcccgagtagctgggattacaggcgcttgccaccacacctggctaatttttgtattttttagtagagacagagttttgccatgttggccaggctggtcttgaactcctgatctctgatgacccacccgccttggcctcccaaagtgctgggattacaggtgtgagccacagtgcccagcttttttttttttttttctttttttggagtcagagtctcattctgtggcccaggctggagtgtagtggtatgatcttggctcactgcaacctccaccttccaagttaaagcaattctcctgctccagcttcctgagtaggtgggattacaggcatgtgtcacaacgcccggctaatttttctacttttagtagagatgaggtttcaccttgttggccatgctggtctcaaactcctgacctcaagtgatctgccctccttggcctcccaaagtgctgggattacaggcatgagccactttactctgggtattactagataatttttgcaaggatggtttatctagcttagatattaatatttactgactctccttccatcattagcagagtaatgattctaagctttgataacagtaactatcacatctaatactattctagttccaagagtgtcatttatgtcaaaattgatacttacctatgtattgttttttttggtcttatgtacttttactttttttatcactaagttgctttgggatatcattggtatttaaagatcagtttcttttgtaggcttcatgaacagttgactgagtcagaacaggctgcccagtgttacatcaaatatatccaagatatctattcctgtggggtatgtatcataccatgagaattgtactgctgatattattactgtcacctcagtaattttgctttccctttctaggaaatagtagaacacttggaggaaagcactgcctttcgctatctggcccagtactattttaagtgcaaactgtgggatgaagcttcaacttgtgcacaaaagtgttgtgcatttaatgatgtgagtatcagttctttaataaaaggtttgaattttaggctagaacataagatatttaagtggaaagcctaccttggccaggcaagcggctcacacctataatcccaacactttgggaggctgaggcaggaggatcgcttgtgtccaggagttcaagaccagcctggacaaaaaagggagagcttgtctctacaaaaattaaattttgccaggtttggtggtgcatgcctgtggtcccagctactcaggaggctgaggtgagaggatcacttgatcctctgcagtgaggtcgaggctgcagtgagccttgatcacaccactgcactgtagcctgggtgacacagtgagactccatctcaaaaaaaaaaaacaagcaagcctcccgcctccttgatctgtggaacttgtttaacagcatcttaataacttgttttcgagactagctttggacatgttttgaaacatttccctgactttgttgcagacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttggcccccaagaaagtcccttttatagcactttagcacaggcaatgctacaggaacaaagtttcaatgctgctgagagtgaaagaaaggaggaaagtctgccactctaccctgagctggcagtagggcactgagtaccctaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagagtgatgtttgattcttaatttttctgtcccttttataatttgttttaatgattttgctacatttggaattcaataaaaaatgtgaacaataatatctttaatataactgtttttgtgtgcatagaaatcatataagtaaataaaaaaaaacaacaacatgagattacataggtggttataatacaaaagtgagaaaaaagctagtgtctgagtattgcatcctggatataattcctgatatatggtaaagcataaaagagacctatttcttcaggagagtagctgacccacctcagggccatgactgctcttctctttccccacagccttagtactttttgccaaaaggcccagatttgagtaaaggggaacgccgtgagcgtaggatccgggcataagggctgcagtctgttgagctttggcaggttggtgttcggggaagtaaatttcgaaggaatggtttcttccctggtggttgttggtttggttgctgattttcctggttggtaccaaggcgctttttggcagaaacctggccttggagtttcaacacagtatgatactgctcagcaatacatgctgccttcttccgaaggtccagtttcactagcaccatgttgttctgcagttcagccagagtctggtcctaaggaagatcaataaagttatagaaaacacttttgtctggtatattagagaaacgagagggctaagggtaatacataccatccattactagttactaacaactgtttcttcaaagattaaaactctttaaggtcggagcttataactgaataaggggacattttctgagaacaaaacataagcagtgctgaataggacatcttctaacacataaggtagtatgagcttgagtaaatttaatttctaagtgcctcagtctctaaatgtcaaattaaatgttgagtttagtttaagatacacaattttaacattttaatctctttggaatcaggatgcatcttactgatgagaaattgttacttttttcttagtagtacataaaataatggtttcttataatcagtagcatcttagatgaaatatgacagtaactacctccctaaggtggttgtgacagaaaatgcctataaattacttagcacagtgcctggtacttagtaaatgcttaacaaagaatagttatttttattttgcaaatatactgctctcactataaattcagcctaaaaatctttacctttttcttctggtcctctttcctttctcacatatacactggagtgggctggtaggacagaagtgggtatatagtttgccctaacctgtttgattaagatgtcatcacaagtggtcaaggcttgacgaagttttcctgccccagtgctgtggcaacaagctctctctgctgattggagagactcaccaagtttctgaagctctgtccgcaacagccttatattctgaaaaaggggaagtaggaatcatattgtggccaagagcaaccaggataatgatctggaggggtcaggtagccatttgaagagaagtaaaattagaaaggctagtcagctgagtgaaatagccactctccagaactgtgcacaaaaaacatcttgtcttcacatgaaccagtgatagagtgttggatgtgggaaattgccttaggtaagagtttggtaaacagagaatggtggtaattaccttctggccctcttctaacttcttgtccacatcaatggtgaagggcttggctgagggtggtggttctaacattttctgatacttatgcaactctgagggaaggaaacaggaaacttaaaatatgtggggtttttttagccttggactaacctctttaactgaggtaacagtagcttgcagcaaatataaaaagtgaggctatgtgtatcctagattgaaatgtcagggggatgtagcttgcagtttaggaaattatgttagagcaggagttagaaggcctgggtttaagtaacagctcttccctgaaccactgttatgtttcctgcctgtctctttcctcaccttcagtggtagagtttagctctgctttgcactgctgtaatttagctttaacctcctgaagctg

SEQ ID NO: 16484 - DNA, 26611 bp, Human
tgttccaaaatgctgtaatgtacaatgactctgatcatcatgtataccatatggctgtggagatgcggcgagaagtcctggagcagattcaggtactgtatgcagatacctgtagcctctggaatcttgatttcagaacgcctatgagaataaaggtgatttcgaggtgactgtgttctcagagtttatttttaaaggtgattaaggccctgaaggattgataatgtgcctgctggtttggaaaaccctgagcctcagtaagtccagctctgatagtgaagtagtctaggaatgcaggcagcagtgaagagctctcaagagagctgaggatagacaagtaatgggaattcccgcttccagagcctcaagtcaagggctaaactccaaagaggctggagtcactgtgtattttttggttgcttcatctgttgttattaatgtacgttcacactttcccatctttaggggataagatatagtagctagaagacatttgtgggtttcttttctgggtagcatcatactttaaagaaaaaagtatagttgagtctatttgccaaaaaaataaacttgcaatactttagtgtttaaggttcataatagcttgctatgtgttccttaaccctttaggtactgaatatctggttagacaaaagaaaaggctcaagtagtctggaaggagaaccagctaacccagtagatgatggaaaacctgttttctaacctggagctgctatcctgactttttctagagtttgaatctctcccggaactctgacctagagaggatcctggtacttctttgccatgtcctcattttcttttccaacaagaataataccttaactcacaaccaacgagtcaaagatgcatgtggacataatataaagaaaaaaaggggaagctgaggtttggatttatgccataaatgttgcccacatctttgttccatcggcttgatttaaagacaattccattagatcttttctaagccttttactctataaataaatgtatttacacaataggaatattgctttttaatgactagataagctgggcatagagggcacagcatcatctggtgaaacgaaggtatctgacacgggtcatttacatataccgcctggaaaggaatggttgggggaggggttcttatcatttatagagtagggataattgaagcatccttcaaacgggaagaaggatgaaataagataaattatgagtaaaatgtcagaaaacatctagtgctctaagattcacaaggagaataaaagtgactggctggctccctttggttaaaacgaactggccagaagctgcaaggttccttgctgggattggctctctgcagccaccgtccccacgctggggcttcaggtctcctagcaacaagttgtaccatatgaggacggccgctgaggtgagtacttagagagggtcaaattcagaatttgcaggtgcaacccggaaagtccccgcggacctagaggccctgcttttcaattagcctgaccctatgcacagagaggtccctgcgggacagggtcgcttcacagaggcagctggccgaggccgctcacccgccgctgtaatggtgtgtggttgcccaccagccaccgtcccctcgagcccccaccacccgctctaccgccccctcgagcccccaccacccgccccaccgccctctgctgcctggggctgttgctggttccaggccttcgggtcgccccttggcctctggttatgtgagcccatagtccttcctgccttggtgacatcgtatacgaaaagccggggctcgatttggacatagtaggaatcctattattgagaccctgtatatagaaaaacatggcagtttctaccttcatcagttaataaaatcaagtacctactattgctattcttaatcataattacattgaatttgcgatgggggtggggggaaatgcatgtcattgcagttgatacctgttaagaaactcttaatttgtgccctgaaaagccataatggagatatcaatgcctccacctcagatatatgtagaaaaaactctggccattatcaaaccagatattgttgacaaagaggaggagatacaagatattattcttagatccggattcaccattgttcaggtaacttctgggtatgatgattcatgcttttttcctctctgcccttaaaaaaaaaatgcttatgtaaatgtgcctacccatttaaacccttagtgttcagcattaaatttaagtttattcttctaagtataaaagttatatgtgatagtttttaaaaggatgtaaaatgagaaataaaatggacttttccttcacctgtcctcttttaccccaagtcccaggctccagagagaggcaaccacttaacactttctgttcttccaggagttttctatgcatttataaacattttccccccataaaacagaacagtccctttcccttgacccctttacagagtccctcagataggattccagatcattgcatctgaattgatctcactcttcctaatttctgtgtaatatttccctgtgtattagaactacaatttatttacttgatcttctattgatggaattttaggctattggtacttttttcagttatggcataacatttaatgttttaagccttatgttctgcaattagtaaacattgtcattctaggggtttgaaagtgaatataaatagcattgttaaggataaatcaaatagaattgaatatttttaatcttcctcttttatagtttttttttcttttttttgagacagagtctccctctgtagcccagactggagtgcagtggtacgatctcggctcactgcaacctctgccttccaggtcccggttcaagcaattctcctgcctcagcctcctgagtagctgggattacaggcatgcaccaccatgtccagctaatgtttgtatttttagtagagacggggttttaccatgttggccagggtggtcttgaactcctgacctcgtgatccacccgcctcggcctcccaaagtgctgggattacaggtgtgagccactgcaccccgcctcttttacagtattcttattcgaacttccaattttttattttctcccatttatacagtgtcatattgcttattcagtcagtatttttaaaaataaagagaaaatggcgggtacggtggctcacgcctgtaatcccagcactttgggaggccgagatgggtggatcataaggtcaggagtttgagaccagcctggccaatgtggtgaaaccccatctctatgaaaaatacaaaaattagctgggcgtggtggcgtgcacctgtagtcccagctacttgggaagctgaggcaggagaatcgcttgaactcaggaggcagaggttgcagtaagccaagactacgccattgtactccagcctgggcaatagagggagatctgtctcaaaaaataaataaataaataaataaagagaaaatatcaatcttcagaaaagatacggaatttcagttgagcttcaaaggacaggtggagtccgagagtagggatggcacaagaaagtgttaggaagtatttaatatgattaaagactcaggtaaataactttttagtaaatgttaggaaaactggtagccactgaaaaatttggatcaagtattatataccaggataaactccaaataaacctgagatctacatattaaaaaaattaaaccatgtaagttcaggaagaaaagataatggatttattttgttgttggagtaggacagccttttttttttttgttatgacttaaggtctaggagccatggaagaaaagattgataagattatatcaacaaggccaggcacggtggctcatgcctgtaatcccaaaactttgggaggccaaggtgagttgatcacctgaggtcaggagtttgagaccagcctgaccaacatggagaaaccccatctctactaaaaaatacaaaattagccaggcgtgggggcgcatgcctgtaatcccagctactcagcaggctgaggcaggagaatcgcttgaacatgggaggcggaggttgccgtgagccgagatcgtgccattgtgctccagcctgggcaacaagagcgaaactctcgaaaaaaaaaatttttttaatttaaaaaaagattatataaacaaaaaatttctgcacaatgaaataaacaccataagcaaagtcaaaacacaacaaacttgggaaaaagatttgcaactcatagacaaagggcttgtcttcttaatacataaagagctcctagaaaaagataaaaataaattagtagaaaaatgggcagaacagatggatggtcacagaaaaggaaaaacattttttaaatatatgaaaagatgctcaatctttaggtgggaaaaaaagcaagttaaaactacactgagattccatttggcaaaaatataaaagtaaatggcacaacccctatcaaagggaatctggcagttatctaccaatacaacagatggacttaccatttgatccagcagttctgctcttggaaatctgtcctatagaattccttgtgctcttactacctgtcatgcgcagagccctgtttagtcccatcagtaggtgcctgtattaatatgaagtgatatatatgcaggttattttttgcagcattgtttacttatcaacaaaagattgaaaataacccaggttgggagattgggagacaggactaaataaactctggaaaacccatcaaattgcataatatgcaactaattgtaaatagaagaatgaggaacctgtctgtactgttaacggaagaaagcaaagtgtgtagcaaaaagaacaaaatagcaaaaaaaacacaaaatcatgtgtaccaaccttttgtgatagagacaaagtaatatattcatgtttgccaatatttgaaaaatggaattctggggaaataaacatttaaaaagggttgcctattgagggcaaggaagaactgagtagattaggaaatggataggaataagatttttcagtatatacctttttgtcttgctttgaatttttgaatcctgtaattatattacccattaactttagaaaaaataaatgaagtatacagataaaggcgtcccatttaagttttttaaaagtccgtattttgcccgggtgcagtggctcatgcctgtaaacccagcactttgggaggccgaggcgggcagatcacaaggtcaggagattgagaccacagcgaaaccccgtctctactaaaactacaaaaaattagccgggcgcagtggcgggcacctgtagtcccagctactcgggaggctgaggcaggagaatggcgtgaacccgggaggtggagcttccagtgagctgagatcgcgccactgcactccagcctgggtgacagagcgagactccgtctcaaaaaaaaaaaaaagtgacaaacttaataattaagtggctagtgttaattataaattaaaaattagccggccgtggtggctcaatcctgtaatcacagcactttgggaggatgaggcgggtggatcacctgaggtcaaaagttcaagaccaccctggccaatgtggtgaaaccttatctctactaaaaatccaaaattagggctgggtgcggtggctcatgcctgtaatcccagcactttcagaggccgaggtgggtggattacctgaggtcaggagttcgagaccagcctggccaacatggtgaagccccatttctactaaaaacacaaaaattagccgggcgtggtggtgggagcctgtaatcccagctactcaggaggctgaggcaggagaatcgcttgaatctgggaggcggaggttgcagtgagctgagatttcaccactgcactccagcctgggcaacaaagcaagactccatctcaaaaaacaaacaaacaaaaatcagctgggcgtggtggcgcatgcctgtaatcccagctactcaggaggcaaggctggagaatcacttgaacccgggaggcggaggttgcagtgaactgagattgtctgggcaatgtactgagaccagaaaaaacaaacaaacaaaaaaatttaatgtaaatatatatgacactttccctagttagtaactttcagagcaaaggcagccatggtacatccttcattttttgctttaattgcggtaaaatatacacaacataaaatttaccattttaaccgtttttaagtgtacatttcagttgcattaagtacattcacattgttgtacaaccatcactactgtccatttctagaaccttttcatcttaaactgaaacactctacctaatgctaactcgttgcttccctcttccccatccccgataaccactattctacttgctgtctgtaggaatttgactattcaagctatctaatttaagtgaaattatgcaagttttgtcctttgcactgtatgcttttaaaataggcttgggagtccaatgaacttgaggctttcctgtcccacttaagggaaaagctgaaaaatgatatgtcatttcagtagatggcagtgttgcctttgttacaaactaagagttctgttctgatagtacttggtatcactgcttctctgtgaaaatattcaacctaatttcagatgagatcgggtgtgttcagggtggtatggctgtagactattcaacctaatttcaaaaaatttcacctgatccagttttaaagcaaccaatggaataattgatttagtatcaattttatttaaagatgaacccttaaggccgggcgcggtggctcacgcctgtaatcccagcactttgagaggccgaggcggcagatcatgaggtcaggagatcaagaccatcctggctaacacggtgaaaccccgtctctactaaaaatacaaaaaaaaaaaattagccgggcgtggtagcaggctcctgtagtctcagctactccggaggctgaagcaggagaatggcgtgaacccagtaggcggagctcgcagtgagccgagatcgcgccactgcactcaagcctggaggacagagtgagatgagactccgtctcaaaaaaaaaaaaaaagatgaacccttaattttaaaaattgtgctacattggctggcatacctgcagaaggtaggttcccctgctttttaaggggcaagtggcagataagggcttacattacaacagatgagattttatttttaaactcagcaagaaaaaacaaaaaaaaaaaacgctaatacgcataatcatagtttcatgtcttaattttagataatagaatggaggattatgctaaatcaggtgctcttgtaatttctcacatcttttatttaatcgctgtatgaatttcaatttgagaacaaatgtcagcacctttttcatagtaactggcccttcactggtgagaatccagtgggtcctattcatagcagagctatgccacctaggtaagcgtgttcctaaacttcttgctctgggcggtttggtcccttgctacaaaccaagcaattttaccaagtttctgaagcctgcggagacacggaattttggaaagggctttaagaggtgagttacttggtaaaattcacacttactctcaggaaaatctaagacattttagaaagacagatttctgccataatcatggagatttttagccttcacttagtgacatatctccatttttcatcatccttactgcaggcagaggttctttgatttctactttgaatccctctgttatattttgagcattttctctcctcacccacctttagtggaattgaaaaaacagcagtaataaataattttttttttcttttgagaccaagtctcactctgttgcccaggctggagtgcaatggcatgatttcggctcactgcaacctctgcctcctgggttcaagcaattctcgtgcctcagcctcccgattaactgagactacaggtgtgcaccaccaatttttgtattttttgtagagacggggtttctgcgtgtggcccaggctggtgttgaactcctggactcaagcagtccgcctgcctcggtctcccagagtgctgggattagaggcatgagccaccgagcctggccagcagtaataaataattttttaaaagctctcaaggccgggcgcggtggctcacacctgtaatcccagcactttgggaggccaaggtgggcagatcatctgaggtcaggagttcaagagcagcctggccaacaaagcgaaaaacctgtctctactaaaaatacaaaaattagccaggcacggtggcaggcacctataatcccagctactcaggaggctgcggcaggagaatcacttgaatccaggaagtggaggttgcagtgagccaagatcacaccactgcactctatctagcctgggtgacagagcaaaactccgtttcaaaaaaataaaaataaaaaaaagcactcaaaatagctgcttctagagaaagcatgagtttcaaattagactgagctaccatgattttttaaacctgattaatttttatagtctcatttgtgaaggaaataacatctatttgtccagagtgtttcatactctttcagattgagaaacatactagcatctaattttttttttttttagacagagtctcatcctgttacccaggctggagtgcaatggtgctatctcaatcttggctcaccacaacttctgcctcctgggttcaagcaattctcatgcttcagcctcctgagtagctgggattacagacatgcaccaccacgccttactaatttttgtattttttttttttgacggagtttcactcttgttgcccaggctggagtgcagtgacacgatcttggctcactgcaacctctgcctcccgggttcaagtgattctcctgcctcagcctcccaagcacctgggattataggtgcccgccaccacggctggctaatttttttttttttttttttttttagcagagacggggtttcatcatgttggccaggctggtcttgaactcccgacctcaggtgatccacccacctcggcctcccaaagtgctgggattacaggcgtgagtcactgcgcctggcctaatttttgtatttttagtaaagatggggtttcaccatgttggctaggctggtctcaaactcctgacctcaggtgatccacctgccttgtcctctcaaagtgctgggattacaggaatgagccaccacacccgacctaatttttcttttttcttttttttagacggagtctcgctctgtcacccaggctggagtggagaggtgcaatcttggctccctgcaacctctgcctcccgggttcaagctgttggcctgcctcagccttccgagtagctgggactacaggcgcgtgccaccacacctggctaattttttgtattttcggtagagacgagatttcaccatgttcaccaggctagtctcgaactcctgacctcaggtgatccacccacctcggcctcccaaagtgctgggattacaggcgtgagctaccgcgcctggcctgatttttgtatttttagtagagatggggtttcactatgttggccagactgttctcgaacccctgacctcaagtgatctgcctgtcttggcctcccagagtgttgggattacaagcctgagccaccatgcctggcctaatttttcttaatgttacagtgaatcaagatatttatgacagaaccagaataaagaacacacgttcaaatgaaaaactttttactgcatcattatactacatgttactttttttgttagtttgtttgatacagggtctgctttatcgcccaggctggagtgcagtcgtgttatcatggctcaccacctctaatgtagtggggactacaggcgcacaccaccacacccgactgattttaaaatttttcatagaaacaaagtcttcctgcgttgcttaggctggtctctaactcctggctgggatgaagcgatccttccgccttggcctcccaaaatgctgggattataggcatgggccactgtgcctagctgttatttctaagtactaaaatgagaccagctcccaaaatagtaacacaaatagagaaacatgaatttggaatatttttaagtccagttttgttaattgaagtgttatttactttaagaaggagatgcgataaatttgttactgacaaaacatatgctgagggaggcttcctaactggaataatttttctttttctctgtcgcccgggctggagtgcagtggtgcagtcttggctccctgcaacctccgcctcccgggttcaagcaaatcttctgcctcagcctcccgagtagctgggactacaggcgcatgccgcccgcccggctaattttttgaattttagtagagacggggtttcactgtgttgcctaggctggtctcgaactcctgagctcaggcaatccaccgacctcggccttccaaagtgctaggactacaggcatgagccaccgcacccggccataatttttcttaagtaggctaagtaattcctcttactatcttatttacagcatacatttaattatatccttttctttcttcataatacaaagataaaccttgaagttataatcagattggtactagtttcaagttactaatgattttaatgagctatcattgaactgtcattttaaatgcttttgttgactttgtgtcttttatagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacaggtaattttcagggtttgggggatggcagggaatggaatccatctgtgaaaatgaaaaaaaaaaatctgatttcattgtaatgggaattttttttttatttggaagttttccaaaatcaactttttgggggggcagagggtggcagggcctggggggtccattttacattttaaagtgttaaatgtctattttaatactacctaccagaaaaagcaacagagaatgtctgatttatagttgattacccttattctctcaacctttaaactgccactgaagtaggatttttagatggaaaaattggaatggtattttaaaagaataatggtaatacaggaacagaaattcaaattttcagcattattgctaatgtatggaaacaagaagatattgagttcttgcacttttgaatgtgcattgcttttttacttctcacaaaacaacaccacgtttttatccagagaactcctattttctcagtgtattcctcctgcagacgtaaatatatttgatccttatctagatagataagcttaaatttaagcttaaatttgacataaattgtgaagctttcatatgtaagaagtggcaatgcttttgtaaaattcttaagtggaatgcatgcatataaagtaaggaatagacgttagattggatggacgtcatctctaacttgtttttagtctgagggcaatttatggcacagatgacctaaggaatgcacttcatgggagtaatgactttgctgctgcggaaagagaaatacgttttatgtttcctgaaggtgagttacagatgactaacttgtcaactgcatctccttattgtttgctttttcttttattttgcggatatagctgggaaggaagataaaataattttttttccagtatattttgttatgttttcaagttgtagttacttaaaaacttgaagccacaaatggaaaacttgacatttccctaacaactaaattgtgccctttagggagtcttttgagaagtgtttaatttttatttatttatctatttttaacattaaaaaaatttaagacagtgtctcactgtcgccgacgctgaagtgcagtggcacaatcttgattcattgcagcctcaaactcctgggctccggtgatcctcccactttagcctcccgggtagctgagactataggtgcatgccaccatgcccagctaattttcttttatcttttggagagatggggtctctccgtattgcccagcatactctcagatgcctgtgctcaagtaatctgcctgccttggcctctcaaagtgctgggattgcaggtgtgagccaccacacccagcttaattcttttttctttcttttctcttgcattagacatattcttctgtgtaacagttctttctagttatcctgaaaggttcagtagagtttgtgacacatgagaaaaatagtctctctaggaaactacatttgatttaccgtcttctgtaacaatttactgtttgcctaacaaagtctcatgcaattgagaaattaataactagtccctttttttgtttccttactgttagagaagttgtaaacctttgagaagtggacatacgaggaagaacactgaagtttttggtttgtttttaatatttttagagcagaaataaaatttggtgatttttgttataaggaaaaaaatgcaaagcattgagcaaaattttggatttttttagtatgttatttttcctgttatgacttatttttccctaagtcatttagatctgttcctcagtattttccactggatattcattcaaataaaacagaaaactgtcttggagatttaaaagttcctgatatattttttttcttttttttggagatttcacatgttttgaataactgatgtgatacaacagtatcactgttgtttgaatttctgaattcaaaataaatacatttcacattttgaatacttgatctgttactttttagtgccaacagggtcggtaacggcctgatgctgacctgacaatgggctgacaacttttctccactggcctttcagtcatcctcccaggggaagacctgcttccctcctttctgtacagtctgaaaagtccctgattcttaaacaaacaaacaaaaaccacttttagaaatatatattttttctcaaagcagtcctcctgcctcagcctccccaaacactgggattacatgagtgagctaccgtgcccagcgagaggtctttttaatatggtagcactttatattagtcttacaagtgaattagacttttgctcgttagcttttattatttatttatctatttgagatggagtctcagtctgtcacccaggctggagtgcagtagcatgatcacgactcatggcagcctcgaccttctgggctcaagtgatcctcccacctcagcctttgagtagctggaaccacaggcgcatatcaccacgcccggctaatttttatattttctatagacatgaaatctcactacgttgcccaggctggtcttgaactcctgggctcaagcaatactgctgcctctacctcccaaaatgttgggattataggcatgaaccatcatgcctgacttctctttagcttttaaataaaacaggataaaatttcattttatcttaaatagaaggtatatttggaagctcttcttactcataggattatattcctaaactgtaattttctttcttttcgctttctttcttttttttttttttttttttttttttgagatagattctcactctgttgcccaggctagagtgcagtggcacaatcacagctcaccgcagccttgaccacgcagactcaagtaatcttcccacctcagcctttggagtaggtggaaccccaggtgtgcaccaccacacctggctagtttttcaagttttttgtagaagcggagttttgccatgtttcccaggccagtctcgaactcttgggctcaagcaatactcccacctgccttccaaagtgttgggattacaggcatgagccactgtgccactgtgcccagccaactgttattttcagttgcctttgattttactcattaaattaatccgctaggcatgagtttagagatatagttagacatttgagaagcagcaagttgtaggataaatataaaatcattaattacttagcacattgtagctcttttgctgtgaagttctttggagcaagtactcagagtttgtggtatgagcgtcctcttacttagcagttgatgaacaactatgtgcaaaactttatacgatgattcactcaagcaagttatcaagatatttaaaggcatgttcttaacccttgaaaaaagtaatgctggctggacgtggtggctcacaactgtgatcacagcactttgggaggctgaagcggatggatcacttgaagttgggagttcaagaccagcctggccagcatggtaaaaccctgtctctactaaaaatacaaaattagccaggcgtggtggcgcacgcttgtaatctcagctactcagaaggctgaggcaggagaattacttgaacctgggaggcagaggttacagtgagccgagattgtaccactgtactccagcctgggtgacagagtgagactgtctgaaagaaaagaaaagaaaaaagtaatgctctcttctttcccttttttctggggggtggtcacagggtctctccatgtcactccagatggaatgcaatggtgcaatcatagctcactacaaccttaaactcttgtcctcaagcaatcctcctacctcagccccttgagtagctgggactacaggtgtgtaccaccatgctcggctaattttttaatttttttgtagagatggggtctcactacattacccaggctggtctcttttcccttttaatataaatggctaattcaaagttttgctatattccatttcttcaacaaatttattaagttgcctactatttgccataaatgcaaagctgaataagaagatatccctgctatcaaaatgattatatttgaaaataaatatacagtctgggtgtggtggctcacacccgtgattccaacactttgtgaggctgaggcgggagaatcacttgagtccaggagttggagaccagcctgggcaacatagcaagatctcatctctacaaaaaataaaaaattagctgggcatggtggcccatgtctgtagtcccagctactctggaggctaaagtgggaggatcactggagcctaggaggttaaggctgtttgagctgtgatggcaccagagtgctccagcctggacaacagagtgagaccctgtctcaaacaaacaaacaaataaataaataaaacaaggatgagagaaaacttaaaaaacttaaagttcatccatgtaagaaacatgaaaacactctttttattctctcattaatttattcagccctagcctggcatggtggctaacacttgtaatcccaacactttgggaggcagaggcaggaggattgcttgagcccagaagtttgagagcagcctgggcaatatggcaagaccctgtctctaccaaaaataaaaaaattagctgggggtggtggtgtacacctgtggtcccagctacttgggaggctgaggtgggagattcacttgagcccagcaggtcgaggccgcagtgagctgcatttgcgctgctgtacttcacttgggtgacagagtgagaccctctcaataaataaataaatgaataattcactaatgaaattaagaaaacaattccagggaagaaaatatttgcaaaccatgtatctgataaggggttaatgtctaaaatatataaggaactcttacaaatcaatatccaaaaaacccctaaataacccaattaaaaaatgggcaaaggacttgaatagatatttttctaaagaagacatacaaataaccaacaagtatatgaaaaggtgcttaaggccgggtgtggtggctcacgcctgtaatcccagctctttgggaggccgaggctggcagatcacctgaggtcaggaattcaagaccaacctggtcaacaaagtgaagccctgtctctactaaaaaaaaaatacaaaaaattagccaggtgtggtggcacgtgcctataatcccagctactcgggaggctgaggcaggataaccacttgaacccaggaggtggaggttgcagtgagccaagatcgcgccattgcaccccagcctgggcaacaagaacaagactccatctcaaaaaaaaaaaaaaaaaaaaaaaaaaaaagtgctcaaaatcactaatcatcagggaaatacagatcaaaaccacggtgagatatcacctcacacgttaggatggctattatcaaaagaaaaaaaggtaaatattggcaagcatatagggaaattggaatgcttgtacacatttggtggagattaaaaatggtgctgccactatggaagacagtatggaagttcctcaagaaactaaaaataaaactgttacatgatctaacaatcccactgctggatatatatatctgaaagaattgaatcaggatcttgaagagatacctgcaccaatgaaccacaataatgttcattgtggcattattcacaataaccaagatatggaatcaacctaagtgtccatcagtgggttaatggataaagaaaatgtggtgtatatacacaatgtaatactattcagccttaaaaaggaagagattctgtcatttttgacaacatggatgaacctggaggacattatattaagtgaaataagccaggcacagaaagacagatatcacatgatctcacttatatgtggaatctaaaaaaacttgaactcggagagtagaatggtggccaccaggagcttgcaagagagagtaggggatggaaatgttgatcaaaggatacttattcctgtgatagtaggaataagttcaacatggtgactatagttaataataatgtgttgttgaaaattgctaagacagtagattttaagtgttctcaccacaaaaaaagataagtatttgaggtaatgcatatattaattagcttgatttgtctttccatagtgtttacatatttcaaaacaacatgtacacaataaatgtatacaatatttcttatctattaaaaaatttgttgtgctcacttcagcacatatgctaaaattggaacgatacagagaagattagcttggcccctatgcaaggatgacatgcttttaaaataaaaagaaattttaagtacacttataagttaaaaaaaatttgggggaccaggggtggtggctcatgcctgtaatcccagcactttgggagcctgacatgggcagatcacttgaggtcaggagttcgagaccagactagccaacatagtgaaaccccatctctgctaaaaataaaaaaaaattagcctggcatagtggcatgcatctgtaatcccagctactcaggaggctgaggcaggagaattgcttgaacccaggaggcagaggttgcagtgaaccgagatcgcaccactgcactccagcctgggcaacagagcaagaccatgtctcaaaaaaaaaaaaaattaaaaaaatttttgtttaatgattagtacctgataaattggcataatgaactttatataatatatgaataaaacatttgcccatattgagaaaaaattgtatacattaattgtgtgcaattttgtgtacatgagtaatacttcaataaagctgtaaaaaggaaaattccattcacaatgacattaaaaataatataatatttaggcacaatttttttttttttttttttttttttttagagacagagtttcgctcttgtcacccaggctggagtgcagtggcccgatctcaactcactgcaacctctgcctcctgggttcaagcgattctcctgcttcagcctcccgagtagctgggattacaggcgcccaccaccacgcccagctaattttttgtatttttagtagagacagggtttcgccacgttgggcaggctggtctcaaactcctgacttcaggtgatccacccgccttggcctcccaaagtgctgggattacaggtgtgagccaccacgcccggccatatttaagcataaatttaatgaaagtgcaattcttgtacactgaaaaacaaagaacattgctgagataaattttaaaataaataatagatattccatattaatggattggaagactcaatattgttaagatggcaattctttctaaattaattaacagttttgggttgggtgcagtggctcattcctgtaatctcaacactttgggaggctgaggcagaaggattgcttcagtctaggagtaggagaccagcctgggcaacaaagtgagacctcatctctacaagaaaaaaaaaatttaaagaaaattttaatgtaatccttttaaaagtccatgcatacttttacgtagacattgacaagctgagtttaaaatttagcaaaattgcaaataattcaattttagaaaagaagaacaaagttggaagacttccactatctgattttgaaacttactgcaaagccacaattataagacggtatgacagtgatataaagatacacatatagattattggaacagaattgaggatctagaagtaaacttttacacttatggtcaattcactttcaacaaaggtgcctagacaattcagtgagaaaaggatggtcttgccaatacagtccccaacttaccatggttcaagttacagttttttgactttactatggtgctttcagctgtgtacattaatggcgagtatccatacaaccattctattttggtttcctttttttttgagacagggtgtctctctgtcacccaggctgaagtgcagtggtgcccactacagcctgacctcctgggctcaagcattctcccaccttagcctcctgagtagctgagactagaggcatagaccaccatgcctggctactttttgaatttttttgttgtagaaaggcagtctcgccatattgcccaggctggtattgaactcctggcctcaagagatcctcccccaaaaatgatatatatatatatcttttttttttaagagacagagtcttgctttgttgcccagatggtctcaaactcatggcttcaggtaatcctactgcctcagcctctcaaggagctaggactacaagtgtgaaccactgtgcccagctcataatatatgtatattatatagaaaatgttatttatataaaatttgctttgtgttagatgattttgcccaactgtaggctaatgtaagtgttctgagcacatttaaagtaggctatgctatgctatgatgttcaataggctaggtgtattaaatgtgtttttgacttactgatactttcaacttatgatgggtttattgggatgtaacccatgtaaattgaggaaagtctgtatatggtgctaggacagcatgatagtcacataaaaacaaaaagaacttagacccttgtttcatagcatacacaaaaattaactcaaaatggatcacagacttcaatgtaaaaacatctaaaagaaaacaagaaaatctttgtaactggagttggacaaagacttcttaaaatgacatcaaaagcaagatccataaaagaaaatattgataaattggactaaatcaaattaaaagcttttgtgcttcaaaggacatcattaagaatgtgaaaagaggctgggcgcggtggctcatgcctgtaatcccagcactttgggaggccgaggcaggcggctcacaaggtcaggatatcaagaccatcctggctaacatggtgaaaccccgtctctactaaaaaatacaaaaaaattagccggactaattagtggcgggcacctgtagtcccagctactcagaaggctgaggcaggagaatggcgtgaacccaggaggcggagcttgcagtgagccaagatcgcggcactgcactccagcctggcgacagagaaagactctgtctcaaaaaaaaaaaaaaaaaaaaaagagctgggagcagtggtttgcacctgtaaatccagctattcaggaggctgaggtgggaggattgcttgaggccaggagtttgagaccagcgtgagtgacaccctgtctctaaacacttaaagaaaaaaaaagctgggtgtggtggcacacacttgcaggcccagctacttggaaggctgaagccagaggatgcttcagcccaggagttcgaggctgcagtgagctgtgctcacaccaccacactccagactgggcaacggagcaagaccctgtgtcaaaaaaaaaaatagaagttaaatttttaaaaatatgaaaagataggtaggcaacagactgggaaaaaatatcaccaaataatataaagaacttgtaactagaatatataaagaactcctatgtctaaataataagagaaacatcccaactgaaaactgaggctggttctactcaggaggctgaggcaggagaattgcttcaacctgggagacggggttgcagtgaactgagattgtgctgctgcactccagcctgggtgacaagagtgaaactctgtctcaaaaaaaaaaaataaagaaaagaaaagaaaaagaaaacaggctggttgcagtggctcatgcctgtaatctcagcactttggcaggctgaggcaggcagattatttgacgttaggagttcaagaccagcctggccaacatggtgaaaccccatctctactaaaaatacagaaattagggccgagcatggtggctcatgcccgcaatcctagcactttgggaggccgagacaggaggattaccttagatcaggagtttgagaccagcctggccgacatggtgaaaccctgcctctactcaacgtacaaaaattagccaggcatggtggcacactcctgtctacttaggaggctgaggcaggagaatcacttgaactcaggagttggaggttgcagtgagctgagattgtgccactgcattccagcctgggcaacaaagcgagactctgtctcaaaaaataaaaataaataaaaatacaaaaattagcagggtgtggtgatgcggacctgtagtcccagctactcggaaggctgaggtgggagaatcacatgaacccaggaggaggttgcagtgatctgagattgcatcattgcactccagcccaggcaacagagtaagactccatctcaaaaaaacatataaaaaaatagagaaaagttctttaaaaagaacctttttaatgattgtatagtatttaatcattatgtttgcatcaatgagaatacatttgtatttgcagtgattgttgagcccattccaattggacaagctgctaaggactatttaaatttacatataatgccaactctgcttgaaggactcacagagctttgtaagcaaaaaccagcagatcctttggtaagaaatatttttattcacacttaagaatattgtcaccaggcgtggtggctcatgcctgtaatcccagcactttgggaggccaaggcgggcggatccgaggtcaggagtttgagaccagcctgactaacatggtgaaaccccgtctctactaaaaatacaaaaattagctgggcgtggtggcatgtgcctgtaatcccagctactcaggaggctgaggcaggagaatcacttgaacccagaggcagaggttgcagtgagccgagattgtgccactgcactccagcctgggtgacagagcaagactccatctcaaaaaaaaaatttttttttctataaattgtctgtagttttcacgtttaagacattgtgtctttgaaatactgcgaatatagctgggcgcagtggctcacgcctattatcccagcactttgggaggccgaggtgggtggatcactaggtcaggagatcaagaccatcctggctaacacggtgaaaccccatctctactaaaaatataaaaaattagccgggcgtggtggtgggtgcctgtagtcccagctacttgggaggctgaggcaggagaatggcgtgaacccaggaggcggagcttgcagtgagccgagattgtgccactgcactccagcctgggcaacagagcgagactccatctcaaaaaataaataagtaaataaatgaaatactgcaaatattgagaacctttttaaaataaacatttctagaaggtatttcatatacatgttagatatgtataattattgattacttattattttcttgctgtgttttatttatttattattattattttttgagacggagtctcactctgttgcccaggctggaatgcagaggcgcaatctgggctcactgcaacctccgccccccaggttcaagtgattctcctgcctcagcctcctgagtagctgggatttacaggcgaacaccaccacgcccgggtaatttttgtatttttagtagagacagggtttcttcatgttggccaggctggtctcgaactcctgacctcaggtgatccacctgccttggcctcccaaagtgctgggattgcaggtgtgagccaccgcgcccgacctatctttctttttttttgtagccatgctagtagataacacaaaatggtttctcacggtggttttgatctgcatttccctaatggctaatgttgaacatcttttcatgagcttgttggccatttgtataccttctttgaagaaatgtctattcaaattgaagtcctttgcccatttttaaactgggttgtctttttgttgagttaaagttctttgtatttctagatgttaaacccttattagatatatgatttgcaaatattgtcttccattttgtaggttgtcttttcactttcttgataatgtcctttaatgtataaacatttttcatttgatgaaatccaatttatttattttttcttttatttcttgtgcttttgatgtcatgtctaagaatccattgtgaaatccaaatccaaggtcatgaaaatttacccctgtgttttatgttttcttttaagattttttttctttccttttttttttttttttttttttgagacagggtctttgttccccatgctggagtctggtggcgccatctcggctcacttcaacctctgcctcctgagttcaagtgattcttgtgcaccaggctgccaagtagctgggaccacaggagcacactaccacacccagctaatttttaaaattttttgtagagatggggtctccctatgttgcccaggctggtcttgaactcctggtctcaagtgatcttcctacctcggcctccaaaagtattgggatcacaggtgtgagtcactggcctcttttaagatgtttattgtttaagctcttatatttaggtcattggtccattgtgagttcatttttgtatatggtgtggtataggggtccaactttattcatttgcatgtggaaatccaattgtcctagtaccatctgttgaagagactgttctttctccaagtccagtggtaccaatgggcttggtaccattgtcaaaaatttgttgaccatagatgcgtgggtttattcctggattctcattctttttttaaaatatgaaatgcttaataaattgtgcatcatccttgcacaggagccatgctaataatctctctgtatcattccagttttggtatatgtgctgccgaagagagcactggactctcaggtccattctattggtctgcatgtctggcataaggatgtcattaccacactgtgctgactactgtagctttgtagaaggttttgaaattgagagtacaagtcagtcctccaactttgttctttttcatgattgttttggctcctcagagccccttgcaatttcatatgaatttgaggattggctttccatttctgcaaaaaaacttgttggacatttggcaagagctgcactgaatctgtagattgctttgggaagtattgacatcttaacaatatcaaatctccgtatccatgaaaaataatgtcttctcatttatttaggtattctttaatttctttcagcaatgttctacagttcttaatgtataagcctttcgcttcttgggttaaatttatcccttggcattttatttgtctttatgctactgtaaatgaaagtgatttaaaatttttttttggactgtcattgctgatgtatagaaatacagttgatttttgtgtattgtaacctacatcttcgctgaatttattagctgtagtggcttccttgtaaattccttagggttttccacatgtaggtttatgccatctgtgaaaagagatagttttacttctttctttccagtttggatctattcttgacaatcttgcataatgtaaatccaaatgtttccatttttaatggtcattttcttaaagtgattttgaaaactgtttaagtttccaattgatatagtatatattgaaaggaaatatgtaactgtttcttaacttaggttgtttttttttttcccatagatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgtaagtatataagtaattttttggtacaatgaaaatggccagaaccaggggatgatcttaaactaatcacttggataactattaggctggtgcaaaagcaattatggtttttgtcattaaaaaacaatggcaaaaaccacaatcacggccggtcttggtggctcacgcctctaatcccagcactttgggaggccgaggcgggtggatcacgaggtcaggagatcgagaccatcctggctaacacggtgaaaccccgtctctactaaatatacaaacaattagccgggcgtagtggcggcgcctgtattcccagctactcgggaggctgaggcaggagaatggcgtgaacccagggggcggagcttgcagtgagccgagatcgcaccactgccctccagcctgggtgacagagcgagactctgtctcaaaaaaaaaaaaaaaaaaagagagaaaagaaagtataatgtaagaaaatgtgaaaacagaaagattgttagctgaaaaaaagtatgttacaaagcaatatgcacagtgtacgcccatttggttttggtttggttttggttttttttgtttgttttaataagatagggtcccgctatgttgcccaggctggtctcaaactcctgggctcaagcaatcctcctgcttcgccctcccaaagtgttaggtttataggcatgagccattgtgcccagccatgtgttctcatttagattaaaaaatgaataaataaatgtgtatagaataacatgtagaaggatacccactcaagtgtttttatctataatctctggatggtagaaatattttatttttcttcttttgcttagctgtattttaaatttttctacagcatttatgtaactacttttgtgattaaaagaaacattaagattacgaaaaataagccgggcgcggtggctcaagcctgtaatcccagcactttggaaggccaaggcgggcggatcacgaggtcaggagatcgagaccatcctggctaacacggtgaaacccggtctctactaaaaatacaaaaaaaattagctgggcgcggtggcagaggcgcctgtagtcccagctattcgggaggctgaggcaggagaatggcgtgaacccgggaggcagagcttgcagtgagccgagatcgcgccactgcactctagccagggcgacagagcgagactacgtctcaaaaaaaaaaaaaaaaaaagattacgaaaaataaatgttgtaacaaatgtcagctttaaagggctggcaacacttccttattaatagactgtgtttaagctgtcagtggctaagatgttttgcaagttctcactgttggtatttttctgaagttttggacatattccttctgagactgtgtgcccactgtatttcaaaacacctttagcatcagtgttgggagaacaaaccaaaatcttaaaaataaagataaataataaattgttatattttttagcaatgaccaaggacatataggaaaaagcaaatcatttttacagtaggattccagtgtgacagctttaggaggtcatttccacattcaaagcctctgtcatggaggaaagaaaaaaaagaaagaaaaaaaaaggcagcactgtgtat

SEQ ID NO: 16485 - DNA, 7611 bp, Human
taggaaataggacagttgcatctttcctgtaggaacatggaaaaaaatgtgaataaacacataatgtggtatctactattgttttctaaaaccacaaaccaagtatttgccattaacagcacaagatgagcaaagataacacctagtgcttatgaatgatttgggtaggatttgaactgggtattgctcttaaagatattatagttcatagaaattgccacatatctgtggccatgataggaagagctcattgagaatgacttctggcctcactattaacgttgacaaacctaagaaatagtgtatatatcaaagtatcatgttgtacacagtaaatacatagaataaatataaatttaaaacagaaacaatgttacaaatgggattttcctttttaaggcacggtcttgctctgttacccaggctggagtacagtgacatgaacatggctcactacagccctgactttcagggctcaaaagatcttcctgcctctgcctcccatttagctgggactacaggcatgtgccaccacatttggccaactttttaatttttttatcgagatgaggtctaactttgttgcccaggctggtctcaaactcctgggctcaagtgatcttcccaccttggtctcccaaagtgctgggattacaggcatgagtcattgtgcctagcacaaattcatgcccagattttaagtgactgctccaatgcattcagtgaataattaatatgatttaagaaacactataataataaatgtatttcctggatctcaaaaaaactgtgttcatgtatttacacatattaaccagccagggtcactgataagtcactgaatacttcatataaactacttaaatcaaacattgacaaatgctgccctttttatacaatgtgttttggtcagatcacaaaacaacttaaatttggatttttgtggtctccccatgtatgagtcctcttgaaaagctgcatgttctgactatcacaatcgtataccattccacactgtacagaattttcagtatttagttgagatgcatgctgttcttccaggacttcaaattatgaacttcccagggggttagtcagtcaaaatgctgctctagagaatatagttctaagtagatttgtatctgggattctatacattgaaattaaaatcacaatgcattttaattttttgtttaaacatctgcagtttaaaactctttgatagaagagattacattgttaacctctgtgtgtttatatgcctagtaagacactggtatcaaccatgtactatgtaattttttagtgaatgactatacagattaaatgcagtagaagggcttctttatatttgttatggtcctatgcattctgaatggctgcaatttaatctctaaggataatgtagagtggactgtagtttatataattgtgcagggaaatcttggaagatgtaaaaagcaacgtctccaatttataaaagaatcagtgagaatgaggaaataagaaagatgggtgaaaagaggtgaaattggaaagagaaaactttgaggacattcaaaagggggaaagaaagaatggagtgatgagaagaggggacactatggagagtggaggcaaagttaagtggagaaactggaagaactgtgatctattaaaacaagcaggaactgaaaaaatgacatggtttctcctttttatcttacaaatgacatgcaaaatccagagggacaaaatgacctttctttcaatgccatacaccactttgtctaaggcagttgaggaagggaagtagatataatggagcttagtggcagagcagctggaatcctgagagaagagaataactttagttcagagcaggtggggaaatgagagattgagtaggaggaccaaggttgagggaagcagatcttcttagttgctgtcagcggctgatggggaagattgttggtagaaggaagtcagaatataggtacagagggataagtttgctaagaacagagatcagcaaacagcttttctgagagaaagaaacatctgcaaatgacatgctgtttctgcagtttctgctgctagctcttcttctcccaggtggtgacaatgcagacggtaagaacatcgctgtcagctgcaaggttacatgtatctgggtagagtgtgctgggctttcccgagatggatcaatagagatgccagaatgcttgccatctgagcatacctgtctccaggtccagtttactcttttggaggatggtggcagagcatgggctctgtgtaaggaaaatgttatagctaaagtagtcattaatgtttctctgtggtaactggttcaatttccatttcctctccattttccgttaaaacaatcagggcccaggaaaatgatgtggtttctcctttttatgttacaaatgacacgcaaggtccagagggatgaagcaacctttcaatgccacgcaccactttgtctaaggcagttgaggaagggaagtagataagatggagcttagtgggagagcagctaaaatcctaagggaagagagtaactttagttcagagcagatggggaaatgagagattgagtaggaggcctaaggttaagggaagcagattgtcttagttgctgtcagtggctgatggggaagattgtctgttggtagaaggaagtcagaatatagatgtagagggataagtttgctaagaacagagatcagcaaatggcttttctgagagaaggaaacaactgcaaatgacatgctgtttctgtagtttccgctgctagttcttctcctccccggtggtgacaatgcagatagtatgaacatctctgtcagctgcaaggttacatgtatctgggttgagcatgatgggctttcccaagatggatcaatgaagaagccagaatggttgccatttgagcatacctctctccaggtccagtttactcttttagaggatggtggcagagcatggggctctgtgtaaggaaaatggtatagctaaagtagtcattaatgtttctctgtggtaactggttcaccttccattttctctccattttccttgcctctctttttttttttttccttacactacttgcccttcttccaccaaaagcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatgtaagttcaatcatctaaattatgggagttctttagaatgttctatttcagggaaatattctctactaatttttgggccatttcccattatcccatcccaccataaaattctgcatagatgaaccttttaagggatattcctgatgttgactccctcaaatttcctaggctcttgctatttttggaattttttttcttgtgctttgttatcttccacctgtggtctccctctgtatcctacaatccagagatacacagctgtcccactctgtgcttgactcccttaaaataaaatctattcccccattcaatttcttcaaagatctatgtccacagttcaatgaccattatgaccaatttcatgcgtcatggaatgctatcctcctacctccctcacaaaggctcccccttcaccctctatcctatattatgtggctcacctatcatttttccacatcttccttggccactttttcttgttaattcaaggcatttatctcttattgtccccttccctatccccagcaatttttctctcttgtttctgatcaaatatgtctttggctcactctcacatccatgtaaaactttcttgcttcacttcctgatacagccctaggtttttatactgttgttttcacttttttgtttgaactctttttctcattcctcccttcctccagatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaaggtcagtagtttcagccccttcctctaagatttttctattcaagtactgccccttctgttcccacccttcaaactcaggacaagaaagaggacaagaagcaggggggttgctgggtaatagtttcttagaggcaggaaaaagataactgtgcatattcatgtggatgtgtgtatgtggatgtaagttgtgtgtaagtttcttcatcagaacactttttctgctctctgcagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggtaagactggaggttggaagtgtaggtaggtggttcttgagcctagaggttaggggagaggaaattttgaggatagcagacctaggtgagggattgtaggaagaaatgtatagggtaatttaaagaatagtggagtaagacctaagggatacatggatactagagatttaaggggaaatgaggaatccttccttgagtaagttttggaatagagtgactgaaataggataactgatgcaactcatccaatgcatatgttaagtaaggaaatcaatagatggaatagaatcagcagtgagtttaaaatggcatccatgtatctttccaatatgtgcaggacaccacttttccatgaattggattgccttggtagtgatagtgcccttggtgattctaatagtccttgtgttatggtttaagaagcactggtgagttttttgtatttcctcctctcctcccagtttcttatttcacattccatttttcactctcttagcttttctctattgactactccaccttatcctcagttaccacctccaacttattcagggtttctcccattcctgttccttcacagctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaattctaatttggaatgtttttcttggaatctccactttttatatagcactcaaccttcaaagcccatttctgatgtcatttcctccaacgatcttccttgacccatactgaacccagagagcccctcaactgttatgtgcatgcaacacttcctaccctgtgttgcagctacttgagtctttcatttcacatttttaagcttttaggaggcaaggatcatgataaatgtgcctttcctgcatatgataggctcagtgaaacacaaaacaaaacatcatatctaagttggattaactgtcatgttgacaatttttctcattatattccttcccaatgttgttgtagcattggaaatattcatgcttctctttttgtttaaatgcttcatacctagcagataaattccactctcctttagctccctcattttctccttaaacatttaaggaaaagtgcagccttgtgccttgatacacttattttctaaacacagagaattacaaatgcaaatagacagagagtgtgcaagttacatgtgatgatcagtggtgcagatatgtcacagaatacttaagaaaaggaacaagagatttggtcctcagggttggagtgggatcaaggcaaccgttgtgctgtatatggaagacaaatttcctaaaggactgtgttatctgagatagccttggctaaactttagtccctttaggtttcattcactaattcaactaatattttttgggtactgagttgagacaggcacatacagcttctaaactggtggtggataaaacaaatgagattgtgtccactctcctgaagttgcaatgtttgcttcctcaatctgtccatgtttcttttctattgttttcatgtttttatttatttcaaaaaattttaaatagattttattgatgtataatttatagtaaaatttgaatctttaagtgtacagttctatttattttgataattatataagcccatgtaaacaaaatcacaatcaagatattaaatgtcataacccctcatacctgtttgtagtcaagcacaccaacaacctggcattcttgcaactactgatatactttatgtcacttaagcttaaacttgtattttctatgattttattaagatggaaataaacatatctacttggtattgccttttatttttcttcagtttagcatatggttgtaagtaatccatgctgctcagtgtattagtaaccattccttttcattgctgaatagaattccatgtatgaatataactttttttggaggaggaggtggcttcccagatctggcagggcctttgtctccttgtgcccactcacccagcttgggtcctgcttccattgctcatttccttggcaccaggaggccctaggtgactctcctgcacccttagtcaccctgtgacctgcagatacagagagatcaatagagaggattctaggacacccaggaaactgggaaataaagccaaaaatatataaaattaaacttatttttgggagaagagacaagatggctgactagatgcagccaggaagagcttctcccaccaagagacaagaccatcaagaagagcagtatactctgagaagatcattggaaagaaggcattgagagtggatggagggagaatgcagaccctgggctgaaggggggaagaagctgcgaaccctacacagggttgccaaacactaggacttattcttggtcctcagtggcttctagggaaggggttggttaaataggcatgaagtggcccactctatccatgaacctctggaatcctagctgcaggagacccccacgacccacacagacatttgagttggcagggaaagctacttgcagagttggcagggacaggactccagcttctatggaacccagagggtttggtgtgagaacagctacagtggagcatggttagggatgtccattacccgaggattggcatgctcctctaggtggctttgacccctttgttgactatc

SEQ ID NO: 16486 - DNA, 7567 bp, Human
gtctttggcaatactaatattcctttctggtaacataattttgactggattactgttctcatgttttaggcctaacttgtttaaaaatttgatgagtggccgggcgtggtggatcatgcctgtaatcctggcactttgggaggctgaggtgggcagatcacaaggtcaggagatcaagaccatcctggccaacatggtgaaacacagtctctactaaaaatacaaacattagctgggcatagtggcacatgcctacagttccagctacttaggaggctgaggcaggagaatcacttgaacccaagaggcagaggctgcagtgagccgagatcatgccactgcactccagcctgggcaacagagcaagactctgtctcaagaaaaaaaaaagtttgatgagtgtggggctagtgttgtgatagtctcctgtgccctgccaactcttttggattattttttaaaatgaggaacatttcagatttagtttgtagcaattcaactttgggagtcttgcaagaactcacttattttaatggaaaatagcccaggttgtctaccagcttttcctgagctctgttttgggtgttctacccaaaataaaaaacgtataaacacaaaaatagtaatgttcatgtctgtgacagccaatgttaagtctctgctgttgtctatggctgttatccaaaaagtagattcaattctgtcatgtattggagtctgggaatgttgttaagagatacatacattgaaatttggagagctgctctgtatttatcaattaggcagtaataatcttggatgaaggctagtcttattaatgttgtgaaccagtcttattaatgttgtgaaccagtagtgtccccaggaatagagaacactacactactcactttgcattttcttatccacataatagaattagttagtgataaccctctttactcggaatcgattgctgccacatttctgcatgatacatagatctctgcaaatatgtgatttttttcctaaatggagaaaatccaaaaattcttcttaaaatttttcatgggcatacaagaagataggaggtgacatcttaaaacaagtatctctgaactttttgtataaaaaaaagcaacctctttgctctattattaataccacatgtggtgatatgaatgcccaaatgtagacagcagttatgagatattacaagagaagaaaaaagctctgccgcttatggcaacttacccaaaaagttatctttgacttaggctggaggtgcacatagcatagctcctagagttctgtttatgtcatgaatatttgttactcaaaactccataggccaagagctcctgaagagaaggtcacatgctagcagcaattgtcattttttccctcaaatattgctatagtataattttgtttgaattataaacttcagtctttattatatttgattctggcattttggtttgtagtgctatagtacaggaaatgttttaaatgctttgcctttatgtaagtgaatatcggtacacacacatacacatacacacacagacacagacacacacacacacacactcacagccagtttagaatgtggggtaaggaacaccagacaaagagggcaatataagaaagagaagacattgaaaacattgggaagaggcagtaacagagtgccagagaagataaggcagctgggagggggagaaactaagtgaggtggataaactaaaagcatccttctgggttaaagcagactaaaagcttagcaattgcttaatatcaccatcttatcctatagatgtgggaataaaggctaaggaaggagaaatgaaaatgcagaatcatatgggggcttttccaaggaggtatgaaggaaggtgaggacagggagagcggctggaagtcagggggtaagagaaactctaaaaatcagggcttgagggaaataaaaggtgaggtaagaggctcagggctgtgggaggcacatttttctctgaaaagcagtttggatgaggaagagatttggcagttggaagagagaagaagtcactacagggtactgaggaaaagctttgctgaaattggagatcaaataccagctctgccagtaagaagttgcatctcccagtgaaatgctgctgctgccatttcaactgttagctgttctctttcctggtggtaacagtgaacatggtaagagtcactctggcagctcccagcactggtgcaggggtttggattttaaaaagcaagcagggctttcctaggtgcaattggacactaagggtctgggtctttctgtctcccgccctcttcaaccattctggtggttgggactagaacctgaagccttaaggcagtcaaatgtgtcagacttcctgtgttctttagactctaggttcttgttttctaaatcattttcattcccattcttcctaattgtctcctgcttctctctttatcttcaccatcttgcttttccactcttcacagccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatgtgagtctagtccaccgaactgggaagagtctcaaggactctcttttctctcttttttgcaaagtgttgctctctctgatgcttctcccttcctttctattttacccaaatgcacgcacatgcttttcttgagtagtctctcactccagcttcacaccatcacacctcatatttcagattcttgctgcctctgcactcttctcttactctcagactgtcttccactttgtaaccagctgctggtttgtcttatgtgaaacttctcctcaagggcccttacttctcctaccctgtgcctgagtgatctaacgtgtggctttctcccctaatccatcttttcaatcatctcctccccgcaccctcctcttgctgggaacctccactcactctggaatgctgcactcctgactgcaccacgctctgcctcacctctcctttcatactcactgtactcctttatcacatacctttgtcttcatggcatgcacatttttctcaatgctcttgtttctgaaaatgtctaaatgttatcattagtttttagctcatcatcattttacaccaaataactttatccccaccaaaatctaaaatcctaggttcttttctcatgcctttttttcttatttgtgtttaataacttgctctcttttccctctacatagacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaaggttagtcctgctgttatttcacttcccaccacctcctctaagatcaagagtaggaagatatcaaaggataggagcttaaataacaagttatttggttcccaaaggagtgaatggggtcgctgtccaagcttgtaggtttctgagttcataacctctgaactcgagttataacatgacacttttttttctccttcctgccttagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagtaagaaatagcagggacccaggctggaaatgccaggaagtgatcttcaggcatagagggaggcactggggaaggatagagcttgagagatgaaagagggagagattgattgattgatttccctgaccccaatcccaacaggagtaaaaatagataatccaagttatcaaaaatgtaggaattaaggacctgtaaactgggtagaggggatcaaaggatggatatatggtggccaggaatatgagagaggaagttggaaatgaccatacattggaagtaggtgggcaaaggaaggccaaggaattctgtgtatagtatctgaagtgacatccttttgtcctctctcaattgccaggaaaccccacctccattggctcaattgttttggcaataatagtgccttccttgctccttttgctatgccttgcattatggtatatgaggcgccggtgagttgtgggtggtgttgtttttttttttaatatgtcttttctgttcacccttccactgttttttaccattttatctatttaaaaattgtttatcctcaatcctttcaccatatcctttccccaaactcccattcgttttatgtggacttaaaaaaaattctgttaaaatacacataacataaggtttaccatctttaccatttttaagtgtacagttcagtggtgttaagtgtgttcacattgttgtgcaagcaatcttcaaaactcttctgtcttgcaagactgaaactctattcctattacgctgcaagttcccatttcccctcttctccaggccctggttaggacagctctacattctgtctctatgaattctactattctaggtaccttatataagtggaattgtaaatatttgtctttttgtgacttatttcatttagcgtaatatcctcattgtagcatatgaaagggcttccttccttttttgaaactgaacaatattccaccatatgcgtataacacattttgttcatccattcgtctatctatggacacttgggttgctttcacttttaactatcatgaataatattactatgagcatgggtgtacaaacatcttttatgtggagctcttttgttcttctgtttttaacaggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgacttaatggtgactccctttggcttcctaatttaaaacttttctttttctgcttctggttaaatatcatttgtcaaagaaaaccaaatataattatgccagaatcactgtatttgcagagatgcagagccttttggatgtaatttcttctctgtctctgcctggatgaatttctagccctgaaggctcagctgagatgtttcttcctcaggaagactttcctagtgctataataaaaggaactatgcagagatccactttacactttactcacagcattggagttatttttgtttttcctccccttctctttgtaagttccttgaggacagtgttccctatttgtagatctctggcaagatctcttagctgcaaattcattttctcagtaaaaactatctgagttgctgtaactgccaagttaagtgttttctttcagagtcatctactttcttccatttttttttctttttagttgatattgtagattctcctcatcttgctaaaatagtttccacttagccaaaaaatattatgttttctttatttctgttccaaactcctttggagaaaaccacccttggcttactacagctatagtctagcttttaaagggtcatagtgagaggtgaagccagctgcactccctgggttgagtggggactcctataacttttctgtagctagcaagagttttgtaaaatgcaccaatcaatgctctgtaaaaacacaccaatcagtgctctgtagctagcaagaggtttgtaaaatgcaccaatcagtgctctgtaaaatagaccaatctgcactctgtaaaatggaccagccagcgctggtccattaattaataattttataggggccaagcgtggtggctcacgcctgtaatcccagcactttgggaggccgaggcaggtggatcacctgaggtcaggagtttgagaccaggctgaccaacatggcaaaaatctgtctctactaaaaatacaaaaattagccgggcatggtggtgcatggctgtagtcccagctacttggaaggctgaggcaggagaatcacttgaacccagcaagtggaggttgcagtgagccaagattgtgccactgcactccagcctgggtgacagagcaagaccctgtctccaaaaataataataataataataataattttatatgtgcaaacataaagcagtataaaaactatcctttgctcattagacagttttgaaaaaattatcaactcatgattaaaataaattttagatattgtatcatttcatccttaactatttcaacatgtctttctgtaacatatagacttttttaacatatagccgaaattacattatgacatccccaaataaaagatttcttaatatcattaaatatatagttgttcagcattcaaattttttccaattgtctcatgaattgtttttacagtttattcattaaattggaataaaaataagattcatgcattaaaattagttgatgtttcataaaccgtttttaatctgtaggattcttctctcatttttatcctagaatttgttttttaagaaatttcatcattcttcttgtaaaatcatccacagtttggattttgctgattacatagctataatgtcatttaacatgcccctttgttctctttatttactatatataaatagatttgtgggccgggcatggtggctcacgcctgtaatcccagcactttgggaggccgaggcgggcggatcacgaggtcagttgattgagaccatcctggctaacacggtgaaaccccatctctactaaaactacaaaaaaaattagccgggcatgatggtgggcacctgtagtcccagctactcagggaggctgaggcaggagaatggcatgaacccgggaggcggagcttgcagtgagccgagatcgcgccactgcactccagcttgggcaacagagcaagactccgtct

SEQ ID NO: 16487 - DNA, 12082 bp, Human
gaggccaggagttcaagaccagcctggccaacatggtgaaaccctgtctctactaaaaatacaattagctgagcatggtggcacatgcctgaaatcccagctacccgggtggctgaggcacgagaatcgcttgaacccaggaggcagaggttgcagtgagcagagattgcaccactgcacttcagcctgagtgacagagaggggcaaagtcaaaaaacaaacaaacgatcatcccacacactctcacttttatcttgtttctataaattaataaatacagcctttgtgagttggtttatgtgagtcagacccaaagaaaatgatcaatcctgaaacgtggaccaaattagttgttttgttttttagttggagttactctcttgtcgcccagcctggagtgcaatggcgcagtcttggcacacggcaacctctgcctctagagttcaacgattctcctgcctcagcctcctgagtagctggaattacaggtgcatgccaccacgcccagataatttttatatttttagcagagatagggtttcaccaagttggccaggctggtctcaaactcctgaactcaggtgatccgccggcctcagcctcccaaggtgctggggttataggaatgagccaccactcccgccccaaattaggttttgaacttaaaagacaggctgagccttgaaccagaatcctgacagctcctccttgggcctctgactggagttatccagaggtgaggataaggcagccattgccttctctgagtgtctacctcctttcaaaactttaacatggaaatctgaatttctcatctttccttaattttttttccagttaaaaatcattattactggccagttgtagtggctcacatctgtaatcccagcaggtggcagaggtgggaggatcagcctaggcaacatagtgagaccctgcctctacagaaaaaaattttttttaactagctgggcgtctttgtgcgcacctgtagtcccagctacttggggaggctgagatgggaggatggcttgagcccaggagttggagtctgtagtgagctgtgatcatgccactgcattctaccctgggcaagagagtgagactctatctaaataaaataaaacagttgttacttccactttatttgcagaaatgttccttattctctagaaaacattatgcgttggctgacacactttcagtgggattcgttttagaaaatgacatgtgaccctgatactatttgacaggctccatggcagcaaggggcaggcctgggcttacggctcagcagatgaatccaggggggtggacttgcaaggactctggagggctctagcttccctgtcattttaaagatggagaaacacaggcctggagaaaggaagaaataaacccagggaatgcgatagatggcactgtgctggcaggggcaggaagaccaaggctgtgacattccagggagtgcgactgcagtgaagcgagtgaccacaaaacactgaacgtaagccctgaggctttgccacttgctggcaccaaggactctgcagtgttgagccaagaggatggactttggagccagactttctgggtctataatcattcagtgtctgtctcctcctctaaaatgcggacggtgggaaattctgacacacgcttcaacacagatgcaccttgaagacattatgctaagtgaaatgagcgagccaggcacgaaagggatgggactggggcctctctgtgcgtccccctgagagacaacggtctcttggccacccaccctgatcccacaggagccaggcgggcccagccctgagacaggccgcccgccgcccgcaattggactaaagagtgtcccaggcgtccgtgccgcccaatggggcacagcggtcggggtgcgtagccgcaggggcgtggtctgaggtccgagacccgagtcctggcactggagtttgctgactccctctggtttccggtcaggtcggtcggtccccactatgggcctggagctgtacctggacctgctgtcccagccctgccgcgctgtttacatctttgccaagaagaacgacattcccttcgagctgcgcatcgtggatctgattaaaggtaggtccagcctcgggtttggggaaccgaaaagtcaggaaggggacaggtaggcatacatagcttagggaacttctcccagcgccaccttcttcctggggccattgctggtctggtttggagaccgaacagagaaaggtgagccagcagggagatccaagagtcagggctccccaaaactctgctcggtctcacggaatagaccacggggttcccctgaggccgaataaaggggtggggatcatgaagagaagccagacaggaggacaaaaacgggcgcagctgggtgcaggggcacacgcctgtagtcccagcaactcgagaggctggggtgggaggatcgcttgagcccaggaattccaggccgcagtgcactatcatggtgcccttgaatagccactgcactcccgtcagggcaatctagcgagaccccgtcttaaaaaaaaaaaacaaaaaaaaacaaaatgaaagcaggtgtgacctcggcctagggaaaggtgggatgagagaggtcaagggtgccaagtgtagagactgggacagcgtcaagtcccttctttatggcccagctgctgagattctgcaacagcaaacagctcaggacgtgactttccatccctgccctctgcactcgtccagtctgcattggggtccctctttgtcccttccttcctctgttcctcctgttttgcctctgaccttgtccttgtccttttttttttgagacagagtcttgcttttgctttgttgcagtgcagtggcacggatctcgaatcactgcaaccaccacctcccgggttcaagcaattctcctgcttcagcctcctgagtagctagattacaaatgtgtgccactatgtctggctaatttttttgtatttttaacagagatgggatttcacaattttggtcaggctgttctcgaactcctgacatcaaatgatctgccggcttagcctcccaaagtgctgggattacaggcatgagccactgtgcctggcccaaggcattttgtttatttgtttgtttgtttttgagacggagtctcgctctgtcgcccaggctggagtgcagtggcaggatcacagctcactgcaacctctgccgcccgaaaccttgtcctctgcctcttgttcctgctggggaggtaggttgccccaggctgctgatgctggaagcagcagggggaccctggggcttgatgagccctacaccctgttttgtttctctagcatgcctccaaggcccttgaggactcagctggcaggcccaggcccaggcccagtgcagggtggggtagtaggaggggttggaagcagaatccaggtatggctggtggggcaagtaaggcgactctacttggctaagccttctgcccagggctcccactccatggctggccctctgcctgaaacttctccacataatctcttctgcaaactgcccactgtcctgcgcaaggacttcctctgcagagtgtggagtagaggaaagggaatgggggacaagaggacgtccaagctggttgtcaaatgtagtggtgcagagggaagtgtgttttcccaggagacagaggagggttttcctggtgaaggaacagtctgaagggagggtgaagagagggtagcaggctgggcatggtggctcacacctgtaatcccagcactttgggaggccgaagtaggaagattacttgaggccagtagttcaagaccagcctgggcaacatagtgagaccccaactgtaaggggaataaaagtttggggcacagggggtggtagcaggtatgctacacacagctccacagtgcccagggcagggtgaacaaagggacatggtggggccagtagaagttgcttctaagtaggtagataccagaaaaagaccacttctctgtgtttcatgaccctgccttagaattaatggtggaagggacaaggtagtcagtcccctcaggtgacctatcgtgcagcttggggtgctctgattgtgagttcatgaagctggcaatagtggaaagaggagatgggtagggtgcatgcaaaggtccaggaaccacaccctgcacagtgagctctgttgcagaggggcagcctgtgggaggaggctgtgcctacaggacttagcaaggggtgttgtctattttgtaccagccggtggagtggtctcctcctcctcccgcaggggcccttccagtctttgccaaccaggagtgcagactggtgggaagaagaactgtgaaactggggccagagcattgcagggaggggcacaggccatggcgggctcagcgttctcctcccaccacccaccatgctggactcttcccaggtcagcacttaagcgatgcctttgcccaggtgaaccccctcaagaaggtgccagccttgaaggacggggacttcaccttgacggagaggtaactgggaccctaggactgctgccaggcctgctggaaccatcctgttctaaccctctatttcatagacaaggaaactaaagtcttcagaggcagagagtctctgtgccccgcatcctgcagagagtcagtactggaccccaggcccttgccttcctgctattccagttcaccctgatgattagaaaagcaaatatctactttacttccacaccagtgctttggttgctggtgagtggtgagagtatccttgagacagggtaggccagaggacgatggcagctttgcccaccatggggcaggcctctggccaagcttgtgtggcgatggctcagtggcatctgggctgcccggtggctccatctctgggctgcagcttcccaggatgggtcttccccatggaagagccaccagatatggacgtcttacatcacagctggtcccaagaagttgaatcctcttcaggaaaagccaatctttccccagttctgccccttttgtcaccagagtcacccttcccctaacaagaacctggagtttgtgctttaaagctcatctctgaaatctcaggatggacgcacctccgatgaattcctctgacattctgccagggcccttcttcctccctggtgccccaggtgtcctgagtccttgtgtcactcagcgttgtgacccccaggtaccagccagagtcaatgtgcaatctctgcctctgtcactactctcaccttcaggtctgtggctcacagagacctgcagccctcctcagaggtggcttgaacaattggctgggagcaaaaggagctcctgggcaccctgcacagacaacggagtcgttaagctgggacacgtgtgtagccccagcttaaaagagaatataggcccgtggcagatacagaggttttctgcccttttggcctgcatgcccaacctttgggaaaccccaagttcctgaaagcttttctgtgtctccaaatggacacatcctgtgtccttccaggtccatgctcatctcatcaccatggcggccctcaaaacccagggaaggaggagagtgccagggggccttgtctgttctgttgttctaggatcctgcagctgcaggagtgcttcctgagtggtactttaggaagccaaactaccccagtcagcttagataggagctgattcttggcagaaagaatgacagaaagaacaaagggacacggaagcctttttgaacagtcaggccatcagaggctggtcggaatcccagcagatgagagtggataccgaatggaaagaactgagcttctttaaagctcagctttgatgccccgttctcctggaagctctctctggttctctgatcagaaactgtctctaaacatttggcaagacattctgttgtgggattttgcctggtggtaggaaaagcttgggtattagcctcagaaagattctcagctctgccattaagagctgtgtgccctagggcaagtctctgcctttctaagcctggttttcttctctggaaaatgaggctaatactttggcaaattgtcagaaaggttaaagaagtgtgctgggcacagtggttcatgcctataatgccagcgctttgggatgccaaggctggaggattgcttgaggataggagtttaagaccagcctggcaatacagtgagatcccatctctacaaaaaagaaaaaaggtagccaggcatggtggtgcactcctataaaaattgaagctgcagtgagctgagactgcaccactgcactccagcctgggtgactgaggaagaccttgtctccaaaaaaaaaaaaaaaaaaaaggccaggtgcggttgcttatacgtgtaatcacagcactttgggaggccgaggcaggcagatcacaaggtcaggagttcgagaccatcctggctaatatggtgaaaccccatctctactaaaactacaaaaaattagccaggcatggtggcacgcacctgtagttccagctacttgggaggctgaggcaggagaatcacttgaacccgggaggtggaggttgcagtgagccaagatcgcaccactgcactccagcctgagcgacagagcgagactccgtatcaaaaaaaaaaaaaagcgactatgtatgaaatacccagcacagtgcccttcccttacccatcatgacccccacacccacagtgtggccatcctgctctacctgacgcgcaaatataaggtccctgactactggtaccctcaggacctgcaggcccgtgcccgtgtggatgagtacctggcatggcagcacacgactctgcggagaagctgcctccgggccttgtggcataaggtgaggctgggaatgtggggggcggcagcgagagcattccccaaaggtgttcaggcaccagtctcttcttttcagttttggattatttctactgacctgtctttgccttcacagattctttcctctgttgtgccaaattgctattaagcccatccaatacattctttgtttgagatatgtatttttcagctctggaaattccatttggttgttttttagaatttccacttctctgatgaaattcaccatctgttcatccattttatctgtcttttcttgtaaattctttaacatatttatcactgttacctaaaaatctttgtcaactaatttcaacacgtaggtgttctgtgggtctggtttttttgttttgttttgtttttgagatggggtctcactctgtcacccaggctgagtgcaatggtgcgatctcagctcactgcaacctccacctcccaggctcaagcgattctcctgcctcagcctcctgcgtagctgggattacaggcacccaccagcacacctggctaacttttgttatttgtagtggagaccaggtttcaccatgttggccaggctggtttcgaactctccacctgaagtgattcgtcctccttggcttcccaaagtgttgggattacaggcatgagccaccatacccagcctacgggtctatttctattgattgttgttttctccctcttgattatgggtcacatttgcctgcttctttgcatgtctcatgatgtattatcattattttttatttttttgagacggactctcactccattgcccaggctggcgtgcaatggcacgatcttggctcactgcaacctccgcctcctgggttcaagcgattctcccacctcagcctcccaagtagctagaattacaggcacctgccatcatgcctggctaatttttgtatttttgtagagacagggtttcaccatgttggccaggctggtcttgaactcctgacctcaggtgatcctcccatctcggcctcccaaagtgctgggattgtaggcatgagccaccatgcccggcctcatgatgtatccttgtgtgccagacattatgataaaagaagagcagagattgaattgcataataaacacccccaagaaagggcttgcacttccctgtgtcaggtagccaggatgtgaggctgttctcttctaagctaatcaggaggtgggctgggttgcaggtttagttggtttcagtttatctttggtttcaaatatcttgaatgtgagatcaggtcactagctcagtctagcatggctttggaatctaatcaccaactacgatgttgcctgtaagatctctctgcttttcatccctgcccccagttcccaaactgctgctcagtcagaaaagcccatgcctgtgacagtctttctcccagcctgcttgggcccaaggaaatgaaattggaatgaaagtagctcatctaggaacggcttatgcctctctggaatttagttcatttagtcaagtgctgtccgatagaagtataaagtgagccacatacgtaattttaaattttctagtaggcacatttaaaaagtaaaaagagtccaggcacagtggctcatgccaataatcctagcactttgggaggccaaggcagtggatcacctgaggtcaggagttcgagaccagcctggtcaacatggggaaaccttgtctctactaaaaccacaaaaattagccaggcttggtggcctgtgcctataatcccagctactcaggatgctgaggcaggagaattgcttgaacccagggggcaaagttggcagtgtgccgagatggtgccacttcactccagcctgggtgacagagctgaacactgtctcaaaagaaaaaaaaaaagtaaaaggaaattgatatattttacttaacccaatgtgttgagaatattatcattttggccaacaagtacaagaaaagatgcttggccgggcgcggtggctcacgcctgtaatcccagcactttgggaggcggaggcaggcagatcacaaggtcaggagattgagaccatcctggctaacacagtgaaaccctgtctctactaaaaataaaaaaaaaattagctgggcgtggtggcgggcacctgtagtcccagctactcgggaggctgaggcaggagaatggcgtgaacccaggaggcggagcttgcagtgagccgagatcaccccactgcactccagcctgggcgagagagcaagactcagtctcaaaaaaaaaaaaaaaagaaaagatgctcagcatcactaatcattagggaaatgcaaatcaaaactaactccctaccccagtaactcccgactttgcctgcccaatccccaggtgatgttccctgttttcctgggtgagccagtatctccccagacactggcagccaccctggcagagttggatgtgaccctgcagttgctcgaggacaagttcctccagaacaaggccttccttactggtcctcacatctccttagctgacctcgtagccatcacggagctgatgcatgtgagtgctgtgggcaggtgaacccactaggcagggggccctggctagttgctgaagtcctgcttatgctgccacaccgggctatggcactgtgcttaagtgtgtgtgcaaacacctcctggagatctgtggtccccaaatcagatgctgcccatccctgccctcacaaccatccatccccagtctgtacccttttccccacagcccgtgggtgctggctgccaagtcttcgaaggccgacccaagctggccacatggcggcagcgcgtggaggcagcagtgggggaggacctcttccaggaggcccatgaggtcattctgaaggccaaggacttcccacctgcagaccccaccataaagcagaagctgatgccctgggtgctggccatgatccggtgagctgggaaacctcacccttgcaccgtcctcagcagtccacaaagcattttcatttctaatggcccatgggagccaggcccagaaagcaggaatggcttgcttaagacttgcccaagtcccagagcacctcacctcccgaagccaccatccccaccctgtcttccacagccgcctgaaagccacaatgagaatgatgcacactgaggccttgtgtcctttaatcactgcatttcattttgattttggataataaacctgggctcagcctgagcctctgcttctaactctaatgtgtgatttatttgactttcctctgtcccagacctggtcatggtctctatgcaaaagacaacccccttcccaggccgtgtgggtcagcttccccctgatgtttgccaagagtgaaattaataaatgtggctgaggccgggtgtggtggctcacgcttgtaatcccagcactttgggaggccggggcagggggatcacgaggtcaggagatcgagaccatcctggctaacacggtgaaaccccgtctctactaaaaatacaaaaaattagccgggcgtggtggtgggtgcctgtagtcccagctactcgggaggctgaggcaggagaatggcatgaacccaggaggcggaccttgcaatgagccgagatcgcgccactgcactccagcctgggcaaccgagcgagactccatctcaaaaaaaaaaaaagtggctgagtgtggtagctcatacttataatcctagtactttgggaggtccaggttggggggattgcttgagtccaggatttcaaaacaaacttttttttttttttttttgagatagtgtcttgctctgttgcccaggctggagtgcaatggcatgatcacagctcactgcaacctccacctcccaggttcaagcgattctcttgcctcagtctccccagaagctgggattataggcacgcactatcacacctggctaatttttgtgtttttagtagaaacagggtttcaccgtgttgtccaggctggtgtcaaactctgtacctcaaatgatctgtgcacctccacctctgaaagtgctgggattaccatgagccactgtgcctggctccccaaaaaaatattttttcagagatggggtctcactctgttgcccagcctggagtgcagtggcacagtcatggctcactgcagccttgacatcccaggctcaagcaatattcccacctcagcctcctaagaagctgggacaacaggtgcaccccaccacgcccagctcatttcttttttatttttgtagagacagggtcttgccatgttgcccaggctagccctgcactcctgtgctcaagagatgctcccacctctacctcccaaagtgctgggattacgggtgccaagacaccgcacgcaaccaaaagaaattttttttttaattagtcaggcgtggtgatgcatacctgtagttctagctacttgggaggctgaggtgggaggattgcttgagcccaggagttcgaggctgcagtgagctctgattgagccatagcactccagcctggggcaacagaacaagatcctgtctctaaaaacacacaaagaaacccaaaacaaaacaaaacaaaacatttcctgtagccttctaattatcagagaaagtagtttatctgaccgctcagggcccagcagcatcccacatttcttggctataagcatggtgacctaacagtcggctgagttagcctcccaggacatgacccttactggtttttggattgtgtgtgtgtgtgtttttttttgtttgtttgtttgtttgtttttttgagaaggagttttgctctttttgcccaggctggagttcagtggcaaaatctcagctcaccacaacctccgcctcccgggttaaagtgattctcctgcctcagccttctgagtagctgggattacaggcatgcaccaccacgcccagctaattttgtatttgtagtagagacagggtttctccatgttggtcaggctggtctcgaactcccaaccacaggtgatctgcctgcctcggcctcccaaagtgctggaattacaggcataagccactgcgttgggacgactcttactgtttttgttttgttttcttttgcttgttttttggtatttttttgagacagtctcgctttgtcgccccggctggtgtgcagtagcgcaatttcggctcactgcaagctccgcctcccgggttcacgccattctcctgcctcagcctcccgagtagcggggactacaggcgcc

SEQ ID NO: 16488 - DNA, 6000 bp, Human
ggcggggttcccactgtccccagctcccactggctacatggagcatgcagccctggccgtgcctccctgctgcagccagtgtgatgacagcagccattccagacggcccgccattgccatctcttttttttttttttttttttttgagatggggtcttgttctgtctcccaggcaggagtgcagtggtaagatcaaagctcactgcagcctcaacctcctgggctctagcaatcctcccagctcagcctcccaaatagctgggactacacaggtgcatgctaccacacctggctattttttaaatttttagtagagatggagtttcaccatgttggccaggctggtctcgaactcctgacctcaagtgatccgcctgccttgacctcccaaaatgctgggattacaggcgtgagccaaagcacctagacttgctgtttttttaaatgttggcaaaagctagtgactaagtgttcaccatgtgccaagtgttttgtatgtgcaagtcattaaaatgttataataatcagatgatataggaccccgttcccagtgtacagataaaactgagggctcaggaggtcaagtaatttcccaaagacatgcaactaggaagcagcaagtctagaaacagattgctgtgcttccttctcaccaatgcactgttctttcttctttgtattttccaagcttttggcaatgaattgcatgtcactttcataatcatgaaaagtcctacaagggacagatttttttaaagattccttccgctctggtgttctgtgcttctctggttctcagaacctcaccctgcacggcctccaccccacatcctcacaggcactggcctcactgcccccactcccacaccagctgttgctggggcaggacgcccaatgtcccagtcttgctgaagtctgcttgaaatgtccctggtgagcttctggccactggagaagttcagggggcaggtctgaagaaggggaagtaggaagggatgtgaaacttggccacagcctggagccactcctgctgggcagcccacagggtccctgggcggagggcaggagcatccagttggagttgacaacaggaggcaggtgaggccagagtcccagagggagggggctgcagagttctgggacccaggggagctggcccaggaggctgggcagctgaggcagggagggagggaaataactgtgcctgattctaggacagggatgggggtgcagcactgatccaggacccagaatgggtgagtggagggaccttaactccttgagccagggcttgggggagggtgagaggcgatgagttagacctaacaactgaagggtaagaccagggttcctgggtcctggccccataacacataagaaaccaggaaaagcctggggtgctagagctggcagtgggacccagcagaggggactgtaggggcagccagtcacccatgctcaggtggatgctgaaaggcgctgagcatgcagaagagtgagcaggtgtcgctttgggcgtttgtgaattcctgtgtgtatgcagagctccaccatctgggtgagccagtgttaattaaataaggagcaggcgctcaatacatatttgttcaatgaaatcgattacctgtgggagtgtatgaatgtgtgtgtccgtgcaagtgagggacagggtctatttgggtatcagttgtgtgtctaggggggtatagtggatttctgagtttgcctactgtgttttgtaggtgcgtggatgagagctgtgtttgtgtgagtgtgtgaagatgtgggtgtgctctgttgcatgtgtggatgtgtgtgagtttgtggttctgtgtatatgcgtggggtcctggggctggattgagagtggacattgagagccccagagggtgcatgtgcacttggggaggactgtgcatatatcattgtgtgcatgggactcaagggtgggagctgggtgtgagtgtgatgtccaacctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggtaagcacccttcctcgggacccagccccttggaccttggcctgacttggcctccagggtgaaggcttggggtggcactgagaatcaggagtccgtctgcccccagtgccccatgaatcctctccagtttgtacttggccacaggggctaagggaggcctagccttctcgggccatgtcctcaggcctctccactccctgtgtactgcctgggccctctttcttcggcttcaccttccccctctggagaatgacttgctttgaccagtgaaagtgaaagttctggcagcaatgctgagtccttgttcatgtttctcttgccagaaaaacgaggactcagagtttagactcaggagccactgccttgctgtgtgacctcaagcaagttattggccctctctgagcctaagtgggctcatctgtaaaatggaaaaataacactgcctggcacatagagagggatcaaataactgaatctgtcccttcacttccttccagcacccccaacactgtccctgcttccccctccccagccccttcaggcttcagagactcacattctagaagaaaggccaggggtaatggaaaagggaagaggtcctgaccaaagtagaaagggagtctcatggaatcaccctgggcctcctagtccaaagcagaccagaaggatcacatagacatttgcagtaatttgcatccgggcatcctacatgtggtacctgaacctgaagccaagtcaaggtcagtgccccagaggggtatgaagtcctcagccttgggcaggaacacagcagagcagccagagttccatgcatttcccagaacctgacactttcccaagtgcctgttcacacttctctccactttacagatgaagtggaggctcagagaggttgagacacttgcccaaagtcacacagccaatcagaatcgatgtcctgaaggcccaggtgcttcattgccctttatcccatagactcagggggtccagctctctccctgaggaccagtaggcattggactctcacttccaatctggcatttctccccacaggggcccctggcatccggacaggcatccaaggccttaaaggagaccagggggaacctgggccctctggaaaccccggcaaggtgggctacccagggcccagcggccccctcggggcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaacatgagcttcagttgctactcggagcattgagagggaggcctaagaataataacaatccagtgcttaagagtcaggcccgtccttagtatgtttttttgttttttgttttttaagatggagtttctctcttgtcacccaggctggagtgcaatggagtgatcttcggtcactgcaacctccgcctcccgggttcaagcaactctcctgcctcagtctcccaggtagctgggattacaggtacctgccaccatgccccgtgaattttttgtatttttagtagagaaggggtttcaccatgttggccaggctggtctcgaactcctgacctcaagtgatcctccagccttggcctcccaaagtgctgggattagaggcatgtgccaccacgcccagcccattcttagtatttcacatgatgtgtttagcatgtcctagcagcctcatctacccaggttcgaatcctgatgccaccacttattagctgtctaatcatgtgcatgttaacccagctctgagatctcagtttcctcatctgtaaagtgggactgatgatcccaaagggtcattgggaagattaaatgacttaatatatgaaaattgtagagcagtgctcagtttataacaagggctatggaaatttttgctattattatattttatttaatctttatgaccaagctctgggtatggtatgatggccctacattacagatgatgaaactgaggctgcgaggagtaggcatcaatcagcaaatcagcatctaaggggaggatctgggggccagtcacagtggctcacgcctgtaatcccaacactttgggaggccaaggcgggcagatcactagaggtcaggagttcgagaccagcctggccaacatatagtgaaaccctgtctctactaaaaatacaaaaattagctaggggtggtggcgcacacctgtagtcccagctacttgggaagctgaggcaggagaatcacttgaatcagggaggcagaggttacagtgagctgagatcgcgccactgcactccagcctgggtgacagagcgagactccatctcttaaaaaaaaaaaaaaaaaaaaaaaaattggagggtggggaggcgggaaggagctgagatttgaacccaagtcttactgatgcccaagcctgtgtttaaccactaccctcaccagcctccctggcttctatgaagcacatgacacatcacacaggtgctttttcaaccctgtgttgggaaggcaggggcaggaatcagagaggggaagcaattggcccaagggcactccgcagtccttcctgaagctaggtttcctgagtccagccctgggcttccacctggcaggtgtggagaccagggctgctgcctctgctgcctgatggacattccgcccaggctgggggctgggagagtcttgaatgctcacagtgcattccagggccctatttgtctgtctggaagctactatgaagcagcaaaccccaccctgtccctcgaatgcaggagaaataagggggccaggagttcagatctgaaaatgtccaatgcaccatgcagtttctcaaaggaagctgggtttagctttgtgctgcacacacacacacacgcacacaccagttatgccttcacacccacagacacactcagggaggcacaatccatcataccacacagcccctgcctcagacatacaagtaacatccatgaaccatcgcatattctctctctcttacgcatgtgtcccagacacactcctttcacccggggacacacatcctcctcactccagcatgcacgagcctcagaatgcctgtgttctctcccacacggaccccccaccacccacacatacactcaaactcccacagggccatcctcagaaacacgggctgtccctcccatccactgccagatgcacaaatggcctcatggtcctcgagtgcacaacctgaatacccacctctaaagtacaagaccccctcctgggactg

SEQ ID NO: 16489 - DNA, 17629 bp, Human
acacatacacacacacacacacacaacaagcagggacttgagagtcagactgcttgggtttaaattacagttctcccagttactggctgaatagccttggcttagttacttgctgagcctcactcttcttatctgtaaaatagggataatacagcacatacttcataggctttttgggaggatgaaatgtgtgaatatgtgtaatatgttttgaacagtacatagcacttagtaaatgctgtatgagtgtttgctgcttactattattatttgagtgcttttagatttaaccagtaattgattgatcttagggatcagggttgttaatctttaatgctgtattagttagtatgggtgcttcttagtgcataaaagggaaaggagaaggaaaaaggagatataaaaggaagttgaataaagaaggataaatatggctggctgcggtggctcatgcatgtaatcccagcactctgggactttgggaggccgaggtgagtggattgcttgagtccaggaattcaagaccagcctgggtaacagtgagacccgtctcttaaaaaaacaaaaaccaaacaaaaacccagccgggcatggtggcatgcgtctgtggttccagctacttgggaggccaaggtgggaggattgcttgagtctgggaggtggaggttgcagtgagctgaggttgtgccactgcactccagcctgggtgacgggagtaaaaccctgtctaaaaaaaagaaaaatatactgcagataattttgatgaggagcgggagagtgtatatttcatgtgagttactcacactaatgtagtttcatgttcttttgtttcgtgatttttgcatccaatcaacaactcacagtgtgtcagtctagaagtgctcagtgctagaagtatagtggtgcatgaggtagtataggttcatttacagggatgttaataggcatttataaattgttatgattaattgttgtgaatggtgctataggagcatggtggcatctgaccaagagttaggtggttctgtatttttatgtttaattataacccctttaggattataatttaaattaatttaaatataaatcttaaaatttaggtacatattgggtggtgtttctttttattctttcagaaaactgttaaagtatttcattgaatctaagattccaatttcatagaagtcaaaatgtgggggaaaaatggctgataatgattgtaagagactcaaagatacattctgactttagagatgtttacatgaaaaaaagcatctcaaattaatgactctttggtacttgtaattgatagcttcttaaaatggaggaggactctagtaagagaagctatagtatctgtttataagtcagtatgctttagagcaatctgactttttcattataaaaatgtaggttttggactaggcattctggtgctaaaacagctgctgaggccagcgatcaccctgttctttgttcagttcctcacgttactcatataattaccgtgtgatcgtgtggtgctctgctgcttgttggtcagagcctgagtaaggctgaataaggctggatcatgaaccattctttaaagcagtggcctttgtattgcagtctagttgacatacatgcatacatacaggtgtgtgtgcacgtgtaactgaagaacagctttcacaaaataatatttagcacactgtggaattttctctgatacagcctcttctctttcatgataaaaataaattcgctgattatcacaccactttggaccttttaaaaataacacttaagaagttggaatagccagggatcagaaacttagaaatggaccttatttgttattgtaacttatagcaagtcattgtgtctcttattgggttcttttagccataataattgtgctagttcttttcttgctctgagtgcctgaacctgttgctaagtgaggaagaaaaatccatatgtaagtataaataaacaaatgtctttaatctttttgcaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtaagtataaaggcttccttctgttagtaaaatgttgtaaaatttgatatccttttgaaaacgctttctctatgtgtactgaatttttttctgttgtctgcctttgtttcctgtttttaaagatcttgacttctcatgggtaaattatatacactttaaacagctgaaaaatcagtggaaagtcagaaggggtgacacagggtttgcaagaagtgctgggaggcaaaactccagtagacaagattctaacgagtggtggtctcaatttggtgaagtatgccctacatcttggaatgaggtgacttttttttttttttttttgatattttggccaattattgatcagtacttggaggtctcctgggataccatttgaggtcctgtaacttgagagaaagtagtatgtgtctccacttttcttgtggagctgttcgcttagcagtaatggagctccaaactggttcttaggggcagagaagagaagacctgttatgtttcgagaacaccaacagagtcctttgggggtcactcccacaactgttcttttctttttttctttttttttttttttttgagatggagtctctatcgtccattctatctggagtgcagtagcgcgatctcggcttgctgcaccctccgcctcccgggttcaagcagttctcctgcctcagcctcctgagtagctgggattacaggcgcccgccaccacgcctttctaatttttgtatttttagtagaaacggggttttaccatgttggccaggctggtcttgaactcctgacctcaaatgatccacctgcctcagcctcccaaagtgctgggattacaggcgtgagccaccatgcctggccccataactgttttttaaatcaactctttggaatggtagaaggaagatgggaataacaaaaatattgaagtgagagagagacaagagttagagtaacactcatttgtgaaaggtagtgagaccctgtctcaaaaataaggaaagttttttttttgaaggggggagaatttgaaggtattattaaacactaaaatcatattgatattttgaattggctcatttggagacaagataaatggaagacgttttgaggttcagtggacttacaggggacatttagaggtacatgaatcttgtttcagagtgaggacagctatcagaatttttctgtttcagtctccattgaagttatttacttgtaaacataatttctgagtcttttatgactttgatcttctggtgttatattttaagtgggcttgtgggtgttttatatgtatgtttgtgttgtacatctctggaaaagtgatagagtggaaggaagagtagtagtagaataaaattttaaatgaaccgatttaggtaaatgaatggaccatgaggcacaagtaatgttctcatggtacctgttgaagttaatatggaaatggatttggtgtagaatgcatttaagttcccatctatgagttggggcttgccatttctagagtaatagaaattcagagctggatgggacaatatatattgtcttacccatctcttaatggatgagggtactcaggcccaatttagggatgagacttagaagtctaagtttaattacttagcgtaattacactagcataagtagactttggaatggaagccagcttttctgattcttagtctagttttggatatgaacaatctagtaaaggagggttgtttttgagtctcttaagtgtgatttaagaaaataatctgtttggtttgagagcttaaccacattcattcaatttctttgttcctgtttttaagaaccgactttcctttaactgtcatctccctcatgcccttgcttctcttctttacatttaaataagctctggaacaatctgttaaaacataagtcagaaaatcagagtaggtacctaaaagttaagtagggctggtcttaaaatgtggcattcttctcctagttggaaagctttgcttttctttttatagatatcatttaattttaaaatttttactgtaaattgacagattatagttgtatatgaaagcattgcttttcaattgtaaattaattctaaagactccagaatttgtgttgggtcttttcccatttagcattgttaaacctcccattttcacaaataacttcgtacaaccgatattagcatatgctttactgaatttgataagggttttatggtctatttacatattaagcatcttgttaaagaagatgtcttagatcatgcagtttgtgcccaataacatgaattttactcataaaattcccagctggctgggtgcagtggctcacacctgtaattccaggactttgggaggccgaggcaggtggatcatgaggtcaggagtttgagaccagcctggccaacatagtgaaactctgtctctactaaaaatacaaaaattagctgggtgtggtggcatgcacctgtagtcccagctactcaggaggctgaggtgggagaatcgcttgatcccaggaggcagaggttgcagtgagccgagaccatgccattgcactccagcctggatgacgcagtgagactctgtctcaaaaaaaaacttcccagcaaataatctgccagctttttcttggacactttgagtactttgagggaaccgttatttctctcaaatgggcttgtttataacaaggctcatcttttctaggactctgaaaggaagaaaggtcatggatctaggatattttatttctagatgaaaaggaaatggtctatgaagaagtagtttcttaggaatcagattgaatgttgaggtagaccactgtctgaaaagtttcaaacttgaacaggttcattttgtgtagctagaggactctgctcctgtgacacctctaaaccttctctggctctttatccaggctgctggggtagagcagaaatctcagaacacatcctttgtctttttccaggaatcatttagctcatgcaaggactggttggcaagattggttatataaggatgatggatggactaagggacgattaagtcttagcaaggaaacactgccttagcttaagagttgtcctgtcccattttaactctctccttgcacactaacagtgttgtatttttttgtttttaggtttttgacaactatgcagtcacagttatgattggtggagaaccatatactcttggactttttgatactgcaggtgaaaacttaatgtcttttatactgttttgatctttaacagttgctagttgtctgtctcttgtggacattttgagaaactagcacatgagcaaagtacttgccttttgttattagttagcaggattgaatataatgattgtcgatgcttgaccaaggagcagtcccagacctgggttggcaaataggagtttggagtaccctgggtgaacagtgtagtagatgaagtagagtgagactggagtgcatcatacaagctccaaattgaactaaaatcctgatgcgtgcaccttgcagagaactggggactgcattagtggttggggagggactaagggaatgaattcataggaatcatgcccactgattctctcccttcacccctacctgctcctttttaaagcctagagtttcctaaatatgcctaaggttataaggtcataagccatttacagtatttattattattactctcttgatatttgaaggcgtattcaatttatgtgtctaataacatgtttagtttcttacgatagatagcttattttaaactgtatctgaaaatattttgagagtgaactattatctgctcacagtattgacatttgtcagctatccaaattgtaagaacaaattactttcttccttaaatgtacctaattcctcagtgctatttcttgttttcaagagtggctgcacatcttaatttctgacttttctctatgtgccgtcttattatcagctcagttagccagaggaaaatctcagaaagatatcctttagagtatctttagaatgtaggaattctaaactttgtgctttgagttactgttactgtttgcaagttaacatgttgcttccatggaatgtggtgttacactgtgtaccacgaggaactatttggatttaattgagaacgtgaaatggagagacagtaaagattagagaaatttttaatacattaaaatcataaaagtaatggtatattaaatttggaatatagagaaaacaatgacccataatgtcatgataaatgaggggttttcttctgtgttcatttgtgtccaaaggcacagagaaaatttttttttttttttttttgttgagatggagttttgctgttgttgcccaggctggagtgcaatggtgcaatctcggctcaccgcaacctccgcctcccaggttcaagcgattcttctgcctcagccttctgagtagctgggattacaggcatgcgccaccatacccggctaatttttttgtattttagtagaggtagggtttctccatgttggtcaggctggtctcgaacttctgacctcaggtgatccgcccgccttggcctcccaaagtgctgggattacaggtgtgaaccactgcgcctggcgagaaaagataatttatggctacttgtggttgaaaattagtattttcagatttcaaagtttattatttataagcctttacattttctggcgagtacttttgaaagcttttttgatgcgtagtgcaataaaaatcattttaaggccaggcgcggtggctcacgcctgtaattgcagcactttgggaggctgagacaggcagttcacctgaggtcaggagtttgagaccagcctggccagtatggtgaaaccccatctctactaaaaatacaaaaattagcccagtgtagtggtgtatgcctgttaagtcccagctacttgggaggctgagacaggaaaattgcttgaacccagggggcggaggttgcagtgagccgagattctgccactgccctccagcctggctgacagagtgagactccgtctttaaaaaaaaaaaaatcgttttaagtgttcagtgtgatgcattttgctgaccctccaccataataaaatgtgtaacatttttatcacccctcaaattttctgtggtgagttcttttaccactgaatggtgttggcacccttatcaaaaattatttgaccatatatgtgagtgtttatttctgggttccctttgcagtcagccctgtcccttgacctggttccaggcaaccactgatctgctttctttgtttctactgttttgcttttctagggtttcatataaatggaaccatacaatatgtagtcttttgtgtgactatttttacatagcataatgtttgtgagagttgtccatgttgtgtgtattggtagttgtttcttttgattgccgagtgttattctgttctatgaatatatcacagttttgtttatccattaacaagttgatggatgtttgggttccagttttaatactggtgctatgaattgcttccacgttttagctattttgaataatgttgctatcaacatgggtatacagataccttgttgacaccctgctttcagttcttttggggtatatacccagaagtggaattgttggatcatgtttttaatttttttgaggaacctccgtattgttttccacagtggctgtcccattttatattcctaccaacagtacgtggggtttgatatagtcacattcttctgttcgacacttatttcctgttttttttttttttttttttttttaattgtagccatcctaattagtgtgaggtggtatctaattgtggttttgatttgtatttccttaatgattagtgatgttgagcatcttatggccatttatatatctttggagaaaggtctgtttaatcaagttctttgcccatttttgaattgggattttttttttggggtaagttttaggagttctttgtagattccgggtattaatctcttatcacatacacgatttgcatatattttttcctattttgtgggttgcgtttttattctgttgatactattttctgatgtataaaattttcacagcttcatgaagtttgtctattttttggtggtttggtgtgatatccaaacaaattattgccaagtccacctgaatcttttgccctatgttttctgggagttttaaagttttaggtctaacatttagaccttttatccattttgagttaattttagtatatagtattaggtaaggtttcatctttgtcttttgcgtgtgaatatgtcattttctcagcaccatttattgaagagtccttttaccactgaatggtcttggcacccttatcaaaaattatttgagctaggctaggcacggtggctcacacctgtaatcttagcactttgggaggctgaggtgggcagatcacctgaggtcagaagtttaagaccagcctggccaacatggtgaaaccctgtgtctactaaaaatacaaaaattagcctggtgcggtggtgtgtgcctatagtcccagctactcagaaggtggaggcaggagagtctcttgaactggggaggtggaggttgcagtgagccgagattgtgccactgcactccagcctgggtgatagagtgagactctgtctaaaaaaaaaaaaaaaaaaagaaaagaaaaatcatttgcccacatatgtaagggtttatttctgggttctctagtctattccattgtcttatatatctccctatgccaataccgcactgttttgattattgtagccttgtagtaagttttgaaatcaggaaatgggagtgcttcagctttattctttttcaagattattttgtctattgtcccttgtttcaagattactatcccttgttgggattttgatagggattgcattgagtctgtaggttgctttggataatgttgacatgtcaacaatattaagtcttccagttcatgaatgtgggatgtgtttccatttatttatgtcttctttaatttctttcagcagttttgaatttttttgttatccaagtcttttgcctctgattaagttaattctaagtatttttattattttgagtatcgattaattcttgctaaatttgttttctaggctttatcagtttcagataccggtcttatatacacgcattaactaaatatgtgaacctctgtttgtagtcatgatgggcagtggattttgtcatctgggtttcagtgaggtttttctttccttagatgatttcactgtgattgtttctttaccatatctgagatggagtctcactctgtcacccagactggagtacagtgatgccatctcggctcactgcaacctccgccttctgggttcacgtgattcttctgcctcagccttccaagtagctgggattacagatgtgcaccaccacacccggctaatttttatatttttagtagagatgaggcttcatcatgttggccaggctggtcttgaactcctgacctcaggtgatccgcctgtctcggcctcccaaagtgctgggattacaaggattgatttttaaccatttctgtagcaggagtttattattacatttattattgggtttctaatggacacaaagattgaacaccacaaactggtaataaaagcaaataacataatagtaaattcattgctgttctgagtgcttgaagtttgtagaattagctgattgagaatattgcccacatattatattacaaagccatacattttattagataagtaagttgctttttgagtaatgaccagcatgcttttaacactttgaggacaccaagattcagttgctgaattctctccaatatttttcttttttctagggcaagaggattatgacagattacgaccgctgagttatccacaaacagatgtatttctagtctgtttttcagtggtctctccatcttcatttgaaaacgtgaaagaaaaggtaagctgatcagatactcttgccctaagaagatcatctcagaatttctactgacctgttataaatagcattagaggcttgttgattaacaaaggtgtattttaaaatacctttttttagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacaggtaagaatggcatgaaaccccatgtgtatttatggtcgagtcatttattagagcattaggatacaggagttatttctaacagtgatcagcagtgctcaaagatgcccagcaagaatatgaacagcttcatattgtatgttcttttgttagaggcctctgtgttttttggagaatattattagttcctaaaccccttgtgttggtaagctctcgtattgtactgaatgattcgtagtggtcagggttgtgttaaaacaaaaaccttacaggaaaggttcagataagcataaacttgcaagagacgatgtgaatgattttttttttttctaaacacttaaattttcatctgaatatgtctgatcttttcttgccaattctgacaattgatactatactgtttcttgggcaattcaaccaggatagggaattagtcataataattgagactttaatgtcaaagaaggcagccatggctatttctgccacagttctcaagcgtgctttatatagtgtccctattcctatatttttggaagtattccttcctcatgcattccggccgtttttgagtgatttaattggaactccttttgtagtttgatgggaaactcagattttgaagatagggagcaatgttagggtatttggaatgggacttgtaactgatgtgtatggtttaaactttttcaccttcatgatatcgctgattccgtcctttgagtactgttctgggggcaaaggaaaaggttatggaaataattagcacaaaagttttatgttctactggtactggtgctttgaagtttgaacactgagcagacatgcctaatagggcaagattgaagggtggaggtttctaataattatattaaactcattatatttatgcttatgttttcaggtaattcattcatttttattgtgtttctaaaaaacactattggattcttaactacgtgtatactagggtaaatggcatatatgattacttattacatatgcactaggtatttagtttatagggcctagtgcataatttaatagtaagtttagtacttggttggatatttacagataaaacttttatgcttaactgggatatccctcaaaataacttcgaggcctagtatcagatgatttaaacataatcttctaatcctcgtttttttgggcagtttagtgctattatagaagcagttatttaaaagtttagaagattttacaccttctcatgcatagcaactgttttgagagttttaaaaaatgcctggtgcttctctgtgtgttttagtaacattcccagaaaagtgtgcctgtgtgtgtatattgggggagacaagggaaagtcatgtgtgaaacactcatgtccatgttagacactaattctgtgtgcttctgatgcatacctctgttctctagatatgggttgctttgagggaagacacataggccctgtggattcacttttaggttactagtgatgctttagataattggatgcttttaatgtaagatttttacagtatcaacaggtgtatatagtaaatccgtttgtagagagtatgaagtttaaaaggtcttagcaggtacatttttcttaccagagtttgaagtatggagaagtcaaaagaggggaagttagaaaatggggtctgtggttgtgtttgggagctagaactttgaggcttacagattctgtttgttgattcctctaaaactaaagtcttaatataaacagatggtggtcaagcaaagattagttttgtttcatagagcatttgttgatcttcgtccatggtaagcaagaaaggaattccttcttgttaagggatacactccagtttctaatagtcctcctcctctttttttccttataaagtatatttccctttctgtactccttccttccttttatattttactgccagagttggttcctagatgtgcagaaagaattgcagtggaattttaacttttatgtggcatttctactttgtaaatgatgtagaaagaggaaggctttttaacttttgctgcttttaaagaatttactgctgtttctgatttattttgtgtctaatgtgacatgtgggtaccagtcctgtgggatgtcatggatgggggcagggtggaggtgggaacacttggggtggtctggggttggcacttacaattggagctgtgttctgggacttttaggacatatttacttgggatcaaactgatcaaactaaagaacatgtgaaacaaccttgggtggtaaacttgtggcttcagatttaggtgattttaggtgagtctgtagacctgggtcctaagtgccaccaatgctgagtcacactgtcatgttggagtttctggctgaggtgtaagtgtatttctgtatcttaatccccgtaagatctgagaatattcttcgttttcactccatgctttatgctctgatacccatgcagacatcttaaagcactggactgcttgctaaaactcattctaggaccccattctttgttttcttatgacttgggtggtggttacttgctctaataacattgctgaataactgaagtgtatgctgtttctagagtctgttctttaaagtccttctagttggtactgttgcacaattaacactttttaaatgtctgaacctttccgttctgggaaaccagtttactctgaaatcttgattaatcacattcagatatgtcattgaacctagaaacacatagcatgcctgttagtctgctatttgtgtccttcagttattcaggggctgaattcacataagcctgaaattgtaatagatttatttccaaaatgtgttagaagtcaacatattgcattttaataaaaattgctttcctgctcagttaaccttgcttgaggtgaagtttttggtcagttatctactctcctggttataatgggcttaagatctagcattctagcgtttttcttaaggcacattgcttctgtgaattcagctcatttaatccggactgctgttgtacctgctagtctttctaatcctctaacctggctgctattctctctcctcccctctgtcttgtagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtataaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataaggatgccactgacccgtgcccgtcctctcagtcctctgtttcatatccaactgtttcatttgaatgcagagctgcttcccttgtttttatgtaaaatgtttcagcagcacattacaaaactcatactgaatgagcaaatgacacatgtgcttgtttgcttcttgtgacatacattggtctgcgcaaagctttctcaaaggaccactgtctcactcatgaatatctgctcctctgctcctgaattgctgaatccttccagtgccctggacaaatcttggtgaagtgagattattgtgttgagattcagggttgtttttaatgtttctttctttgccaactcttgggggtttgaatgttttaaatttgaactccaactttattatactgaaaatcagaccgcccattttttctttctaccccttttcagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccgtcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaagccagcctgagggttgttattttccctccgtctcttacttttcagatattgaggagtgggaatttgactcttgataacatcaatttctaacaaactttgggataaaattttaaagctttattatttttattttctggcattttagtttgagataatatttagccctctatatgttcaggtttgtgctttctcctctaagtttgacccttcccttaaataccaagtaggtccataataattcttagtgaagcagtgttcaggaagctcactgctcatggtggaaggaaatgtcagtgtacctttaatccatagatcattggaaagcagctcattttcccccaagttttctgcatcagtggttctccaactggagtgcagcttgaacaatgtgatttttaagttttccaggcatttctaaaatgtagccaagtttgggaatcaccacacctagttggttatctcaaactactactatcagaatacaggttctgtgctgcgaatctgaatatgggatacattttctttaggtagcaagaaaggtttatttacctttaggacattatactgatctgcatgagaatcttagaaactaagaacccttaaaatcagttaaggttggtacactgtggcctcattttgatagttctctgcatggagtcatgtttggcatgatttgcatactgtgctagaattaagctgggttggttgagaaggggttaggaagaggcagatgtaagctttaacagttctaaccaagaaatgcatcttatttattccttgttgactatactagggagagatacctggatcatgtgataccctggaaagcagggacatatgtatccttagtgtagtcaggggcgtataggtccttgactattgctatatctttgtcctaaagcaatgcttgacatgatatggctctagaagtagtcattggatgggtatattattttataaatgagtaagtgaaataaagcaggtcatacagttgtgtcaacgaattatccgtgtatcagaagaacaaggatgatggggattgattgaagctaatgttttcttaaatattttcagattgatttctgcatgtcagaagaacttgg

SEQ ID NO: 16490 - DNA, 6242 bp, Human
ataaaaaggaatgaagtactgatacatgctacaacatagaaacatggatgaaccttgaaaacattaccctaaatgaaatgagtcagacacaaaaggtcacacgttgtataattccatttatatgaaataataggaataggtaaatccatagggacagaaagcagattcatggttgtcaggggctgggggaaggaggattgagaagaaactgcttaacgggcatagagttttattttggggtgatgaaaagtcttggaactagatggaagtgagggttgcacaagactgtgaatgtattcaataccactaaaatgcttgctttaaattggttaattttatgttgtaggaatgttgcctcagttaaaaatatataggctgagggttaaactagatgaacttaaaggccactttgtcctgagagctaatggcatggaacactggccatgctgaccagtttgagacagcccaccggcttcttcctagttctttgggattaaaaaggggccatcactgccctcttgccagagtcacagctctgagaatattctaccagcagaaacagcctggtatgctggcagggacatcggcttcattccttcctgtatgactctgagcaagtgacttggcctccctgagcctcagtgtcccctttggtgtaggaatcacagtagatgcagggatgctctaagcatgcaaggtggcccgttcataagcagcatcataccctgaattcagaagctctactgaataagagctttcggggaataaaaccccaaactcatagtagcttagttgcctctccactcttgcttcctgtcacttgaactcttgctcccctctgtcatactggcctcctgctgatcctcaacatcctaacctctgtcctgcctctgggccttctccatattctctgtcctcctggaacattcttgcccccaccttttctggaccttcaggtctcagcctaatcatcacttccaagagtggcttccccttggagaagactttcctggtgggaggacttccctcacaaaacccaccacctcccacctccagcccagttactctgcctcccagcatccttctctttctttcagagcaccaatcacggtctatcactatttctatttactttatgctgacccatttatatctacctgtttatatctgtccccactaggggcacaagtccaggagggcagggactgtatccgtcttgttcttcactgaatccccagcaccttgcacagagtctggtagataggggacaatcagtgaacatatggatggaggaatggatggatggagggacagatggaggaatagagggatggatggatgaacggatggatggatagatggacagagggatggagggatgcaggggcagaaggatggatggatggatggatggagggtggatggatggacagatggacagagggatgcagggatggaaggatggagggatggatggatggacagcaggatggagggatggatggatggatggatgcagggatggaggggtagagagatggatggatggatggatggagaggaggatggatggatggatgcagggatggacagagggatgcatgggtggatgaatggatgcagggatggagggatagagagacagatggatggatggatggatggatggatggatggatggatggacagggggatggagggatggatgcagggatggaggatagagagatagatggatggatggatgaatggatggatgcagatagagggatagagagatggatggatggatggttggatgcaggaatggagggatagagagatggatggatggatgcagggatggagggatagagagatggatggatggatggacggatgcagatggagggatagagagatggatggatggatggatggatggatggatggatgcagatggaggaatagagagatggatggatggatggatggatggatggatggatggatggatggatgataggatcaccacggtggtaacctctcacattgtcttctccacaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaaggtaccatgggatttagcaggacactggtaatactgaccaaatttcccgtctcctgcctcccaagtcacagttgcctacctttgagactgcaaaagcactggcaaatccagcagcttgctgaacccttgcagtaactttgcaaggagggaattctgattcccattttacagagaggaaaactagcatctagaaagtctgctgacttactcaaggtagcccagtaaatgttgaggctaagaccagaccacggatctcttaccattaaattcaggtggagagggagtgccgctgtggccacagagtcctgtgtttaaacttacctcctgggcaaatgacttctctctgaattgctatttcctcacctgtaagatgggggcaatggtacttttttggggttgtcatggggttcaaatgagactcccagccttgaaaacccctctgtaaaatttggtttattcattcatttaacctacggttatagagcaactgtctgtaccagtcactctcctcacataatctcatctaatccttacaatcccacaaaatatcttcatccccatttcacagatgaggaggctgacctcaggaaatgtgactcagttaaggtgacaccactactaatggcagatgtgacacgcaaagcacatctctctgtccccagatcccatcttctcaggccctattctctgccactctactggaaaatcggtcttatcttgtgttgtgccaaaccaaggggtagtggctgcttggggggtggagtgagaaggagtctaaagtccatttccaggagcagcaagagtgaaggccatggttgattagggatgtctgccaggggtgagggatagagggagacagcactcattatccctgctctagctgaagaaggacccccacacaagctggggaggagggccggcctagcaccttccttagcaaggagccattcccctccccacgatcagcagcccccaagaaggtcaagcatatcacagactcaggaagctgggctggagggagacccagagcccctgcctgacactgcctccttcgttttacagatgggagactgaggctcagagagaggcagggccctgcccaaggttccagcgcaggcctccttcttttggtctcagtgatctcacttctttggtctctgcttttccagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccagccaatgcacacagtagggcttggtgaatgctgctgagtgaatgagtaaataaactcttcaaggccaagggacagtggtctaattcaactctgtgtcccagcacctggcacaccagaagtgccatgctcagaaatgttggttacatgaatgaatgaaccatgaatgaatgaaatctctgtccgtgtgctgctctgtgccagccacacagtgggaggtgggggtccagcaccaactatgctcccagtggtagcctacaccttttcctgattctctcactaatcctcacactcctcctgggagagggcgcatcgtgcccagcttacagaagagcaaactgaggatcagaagggatgaagggattgtccacaatctcacagcagggctgggattcaagggcaggcctgcccattgatggcctgagaccttttttaaaggcaacatgtctaggccagcccctaaaggggttctgtgcttgtcccttcctgttacccctaccaaggatcaaggggtcatcctccaaggctttaactgaccttggagcaggaacctttccctttcttattctccccacatgcccttcctcccagtatcttctcagcctagcacaaactcagccatccagttagagtaaatgtcactcccccgctcaaaaaccttcagtggctccccactgcccaccagatacagtcccagcccatgaacttggccttccagcctcactctactgggcctttctgtcttctaaacaagcccacctcagtgcccttcctcgcactgttcccttacctagaagccttccactctgcccatctacccatcctcattcaagccacacctcctccctgaagcaggaacaccctagctctcgcacgctcactcctctggcctcctctaccccagagcgtgcacagccagcatttggctcctcaccctgtctccccagctaggctgtagctctgcaccctgctcatctctgagccagcacagaacccatgatggacagcagccactcagtaaagatttattgcctgattggctgagaccacaggactaggactccagagtcccgcccagctctgcacctgctctcctcagcctctcctactagccccagcatcaagaccctcaaccaatcctgacctgagatgggagggatttaagatagtcccacccgtgtcaaccagtccagcctcctgtttggctggccagtctctcaggattccattcattgggtgcagcttctgccctatctcctgggcctggggcctggccttgatgacctgccctaaccccagactaggtccaaccgagacctagaatcttttctccaggagctggcccttatttctgctgctcaaccctttcaatgcaaactgcctggcctttgactctaatactaatagttatgatagtaatggtcacaccacaattgaattactgtgtatctagtgctttgcgcacatcagctcatttaattcccaaccacaacccctaggaggaacatagtatcatcctcatgtggttacatgacaaaaaatataaaactcagagagggcaagcaatttgtccagggtcacagagctgacagctacacagccaggtttggagcctgcttttgtttgcctcagatttcatcacctccttgccatccacatctgttggaaccccttctgcagcaacccccctctgcagccccatgacctctcacctgaacccatctgacctcaggagttcacattctcgagcctctgcagttgggtccatccttgctaggctacactgcacccggaagcagagctggctgctggtgtcgagcatgcgcagagcaccccatcttgctgcacagacccaggcagagccgggcttgtctgagaagtcagagctccacgctcctgcctgcttgtctcgggagctgctgtcaggccgcctggctcttctgcaagaccaaccctcctcggacccctgacccataaaccctgaccctgccccctgtcctccaccagacccccgcagtcaggacactcataacagtgcccttgtcgggccctcccaggagcttccagacctgccagaaatccaggctctgactgtgtgtctagccatggccatcatagtccaacatcccttgctctacgcagacgtgcatgcatctcgactcttcacatttatt

SEQ ID NO: 16491 - DNA, 43415 bp, Human
gattcttccatctgatgagccttgaagcacagcccggaggcctgtgggctacggccaccctactcacaggtctgcctacactatggtgttattaaaatgtttacattagctgccaaccttaaaaatcaagacgtaacacaaataagttccagatagacaactttttcttgaaaatgcagaaaactggacacacatctccaccagcaatgttggctggatctgggtacactctcctagcaggctctgtaagggtgcctgcctatctcatgtaggcatttgagtttgccactctgggtctagtccaatctgctttgtactcacctgccctcttacagcatctctgaacaatttctagctagtatctgcttaaatgcctctggtcacaggagtctcactacatcagtgaggcagtccacctgagctgcgaggaaggggctcctatggaactgtcttccccctttctgtagcaaaaaaaaagacacagaggaaagaaacgggcgttggagccaagcagctgtggatctgagtacctctctagcattcaaccagctgtgtgatctaaggcaaatgatggcctttctgagcttctgtttccttaggtgtgccagccctgcaaggctgtgtgaggcttaaactggagcgagtttataaagcccctagagcagggtctgactcagggcacatgttccccaaatggcctttctcatcctatgtaacttccagccatggctccaattctcctcaccccccagtgaccatgagagctgggaacgaaggaagaggggactggacgatggtctgtgccaggcggcagtgggaagcaatcaggcacttgctcccgtgggcatccaccctctcaggaggctgcaggtctcttgcctgcttctcggactgcttggcccaccaggtgtgtgagggacttgagggtggcagagcaggccccaggatgcagccctatatccctgtcctcccctcacagcccaaagccatccctggatgagacccctagtcctgggggatggaactggagacagggaaggtcaggggagggaaaagcagggaatgatagtccccctcactggataacagctcccatgaccggccacctggctgtgtgcccggccgtctgccaggagttccacctgggccctttcacgccaccctaggatatcgatactggtattcttgttttacagacatgaagttttagactcagagagcttaagaaacttgcctaaggccacacagcaggacacttgtcttcctggtccctgagcctgccctcctgaccactgcaatctaaggcctccttaaaatcccgtggtccctaaatgccaagttgttggggtggggaaagggagagagttttggttttggtgtttttttggtttttcacctaaaagtgcctctgagtttgccgctgagcccatctctgagcctctgcccatgaactagtgtgtatccatcggagtgtgtcaccacgcgaagcactcggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctgagccctgagtccaagtgcgcagcgcggggcgcgcccccgaaggtgcccgccgggggagtgtgggcgtgcgcacgtgcggcggcggtggccgcgggccgggtggccgcggtgcaggctccgtgtcccccaccccccccgcctcggtgctgattggctcggcgccgtgacgggccggcccccgcccggggcggcggcggcggcggcgggcgcgggtgcccgcgtgtgcgctgggagccgcgtgtgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaacccgcgagcttgaggaagacggacaggtaccggggactgggggacagtgggaaaggacaggagacaggactgagggatgtgcagctggggacagaatactgagggtcggacgccggggacaaggggacaggactggacagaagacaagagaagaggtaaggaggagagggtacagtgaggtagggcaaggaacagggttggggacagaggacaggggggtaggcactggggttggagggacaggagaatgggggaggaggttcagagggcagaaggcaaagggggtggggacagcattgagagataggagccaggcgctgagaaacgggaccccggagagcaggactggctttgaggggaggcaggaaggaggggtgcggaatgagagtctgggagaggggtcagggcccgagggccacagtctggcgacgggctggggagaagaagggagggcaggggagttccagctggaggagaggcagcttcgtgggcagcgggagcggcttggggaggagagggctgggggatggggaggccacagagagattgaggcaggcaggccccggagagcaaagtcttgtcagagaaggctgggatggcagggtcactctggggccctgtgtgggaggaaggattggggtggggaggtgcactgagtcgttgggaccaaaaaggtctgggaaatgacttctggtggtgggggcacaagaagagctgagagggagcacctaagcctgccacccacacacccgttagctccctggagaccccagctccatccagctcaggaggtttccctgggtcccactccccacaccccaacccctgccctgaccctcctctgttcccacagctctgccccaaggaagccagagcgtctctgtgcaggctcccagggctgatgtccagggaccagagctgggtcctcaccctgccaagatgaacttccaggtgtaagcgaactccggagctggtgctgctcttccacgcccagacagaccacacatctgcccttcacacacagctcaccgagggcccaccctacacacaagcacacacacaggctacttgggattcacacttgtgacccaggcctgtagagactgacatgtgcggtcagtctccccaccccacataacatccacagccacacacacagaaatgaagccagtatgcatgagcacaaacacacatgtacatgcacgtacagatgcatgcacatgaaaatacgcaactctgtgtctacatatatacatcacaccacatatgtaaggagcccgtcgtttgcatccatgcccacggaaatgcatgtgcaccaacaaacacacacagacacagataaaatcatagtctcccatgagcccagggcccagcatggaggagaggcacggcagggtggccgagaagtgagatgccggcagagcagggccgggtgggtgtaacaaggcacaggttcccggggcaccaggagaggtctggggttggggggtgctggggagtaggaaagggggcaagattggaatctaagaggccttggggccctgggagctgcacctgagaagacggctttctgagggtgggtggagggaaggggacagttcgtttgcccagcaggctctgaggcccctccatcgaggcgctgggagtcaggtggtgcacccccaaccccctgcctcaactctcttctctgggaaggagccagcaccctctggaatcacaggctggtagccccagagcccctcgaagagggggcttggaccaggctcatgtgctgaggacaaagcatgggtctggggaggggacctgtgcagtgggtgggggccagcagctgaggaagaggcaaggtctagagagagaggcaggtggggaagtctgtgtccatggtgaagggaggcatagcccaagggcgagagtccacgccctctccgatcaatgcagcagggtacccacagccaggcacaggttacccacacgagtcagacagccatggggtggagacctgggacctgagttccatgtggcgcatctgggagtcctccccagcactgtccctgggctggtctagagcaaccagagccagctgaggggactgttggaactcagggaggggcctgtgctcccagctgggtctagcaaaggtaacaggaccttagcctggccaaacaacagtccactcaacagtcccctacaacaggccactctcagagcttttgctggggcacccgtgggcccaggaagggccctgcacctgcagagacgccccccggacccctgccaggcccaaggctgcttattgctctctggtgtggcttatcctccactttgaggtgatctccaaggcattcagaatcctggctgacgtcccctggccaccccgaattctccagcctcaccatcatgcgctgcgtcctcagggaatgtaaatcaatttaagtattagtctcagcgaaatggaatgggggaaggcgacggtgctggagaaaaaaagaaatcgcataatgccttccacagtcgaacaggaacggcttaggagttatctgtgcttcccagagcaggagagggacccgtttgatccccccagaacagcccgggcagataggcctaggagggatgcctatggacatctttcagataaggaaactgaggcagaggggttaagtgcttcgcttcactgaagggccctaggagaccatggagtccgatccccgtgtttggtaagcggggagatgggcccacaggggagaattggcttcacagtccggcagcgcaagaggcaggagagaggccagctgcggtgaccagagggtctgaattcccaaggggacccaggcccaggctgggtgggcctaatggtggcgttctcttcagcactcatcaaacctcctatggacttggggcttccttcaagggacactctgcgttctcacccattcaaggggacatggatggggaaggtggagatggggacagaggaagaggagggaggggagggacatagaagggtctggaatgaattggaacaaacagccctggaatcccatagcccttcctgagtccgatagaattgacttttgacttatctttggattatctgatccccctggctggttgatcaagaatcagctgcagatacggtggggcttcccccaggagggcagggcctggagagcggtgtctgcaggccctgaagcctgcacgctccagggcgagaatcctaagcagtggacatccacttgagtggctccgggatagggacaggtctgggctgcatccaggccaggtcacagaaggggcccagtcaccccgagacctgtgtctgggatgcggggtggggcggggggacccatacgtgtgtgtccttccctcaccatctccccaaactcggctttgctggtctgggggaaactgcagtgcggccccctccccctcccaccagccagcaggaggagagagcttgcctgacccagttttctctacattgcctgagagggagggaggcaggcgggaagccttctctctgcctctgcccctggcgtggggccggcttggggagggggaggtccctctgcggacattcgctgtgtcccctgatcccaagtggcccctggggacccagggaggaatgcagggaggagcgcggagaccccctccctagttctgccagcctcactccagccggcctccttcagggtccctgacggtggggtggggagggtgagaggcaggagaaaatcagcaaataagagcatcctcactccagcatttcctgaggacacttgtctctgtcttcgaggggcaggcttagagctatgcaaatctcaggcagaaggacacccagcctccccacgggaaagttccaggagagctccacctttaacccccgtcacctgcccaagcccgctgattggggtggttaaaagcccatggctgttggctgggagaaggggtcatggaaggcagagtgaaagggaaagctgtgggactctggagccaaaagccctctcatacagcaatcaccagctagatcaaaaggaagcaaagaggtgaagggacttaaccaaggacacacagcagttagagacggctgaagccggagccctgatttctaaacagcataatgcatctgtttcaccttaagtgagggtgtgaccacaagggacatggagagaggcagggggcgggggacttagagaaggggaactagtgttggtaaggaccagccctggctccaggcttcacgtaatttcctgaccctcatcccacccttaggtactatgaacccattttacagatgagaaaattgagggtcactcgctaataagtagctgccttgagacatgggcccaggaatgtctgaccccccagatgggctcttttccctaccatgttgagcctgcagggtcccctttgcagagggcctgacttagagtgactttgccctttggaccagtgctccttccctgccgtggagactacccagaggttctgtttctcgggcccgagcatccagggatggtggatggcctgccgttgctacagcaagtgctccgaatggcagctccgccagctacacctgtggggctcttggcacattcccggacctccctgaggctcggttcttttatctgtaaaatggaggtaatactggccgcctctcaggttgttgtgcggggtgcagatgaggcatctcaagctccccttgcagatattggcacatagtgggtgcccactaagaggcagctcttaccccgctaagcccctccacaccagatgtgcacggaggacgtgctaaatgccaggcaccgtgctgggggaacagggtgattatgaagctggggccagtcctcagatgggaggtatgactttgcagcatggaccttgaatgccatcatggctcttacaggagacaagggtcaggtcatcatcacaaaagccctgtgggaccggaattgttatcaccccattttacagaggaggaagctgagactcagggaggtgagggggcttgcccagggactcacagctcctaagtggcacaactgggattcagaggcctgccagcttcgagcccacctcaactatcccactgtgccaccaaccaaggatgtctggcacttggaacagcttgtgttctgggagttcagaatattactttttggccaagagggtgagaagaaggcttcagggaagagaaagaacttaaactgggccttcaaggagaggggaagagagaaagggcattcaggcagagggacccgtgtgagctgtgtgctgggggctgagtgtggaccagtgtagctgggtcaggctgctcttgaggagctggggagaagtcagaggggcctgatgccctcttgtctcctgttttacagtgaatttgctggacacgtcgaccatccacggggactggggctggctcacgtatccggctcatggggtgagtgatgggcactggggacaacgtcatccctctgtgagcagagagaggctgccactcacagagtctgcatgagatagatcaaaaggaagcagaggcccagagaggtcaagggacttacccaagggcacacagcagttagtgctgctgatctcttaacagtttagtgcatacagacccttgagattacagaaccaaccctggcaccagatccctgattcttcaagtctgaggccctaggtccggggatccccatggctgcatcctacagattcatgaggtgccaggccaggactaaagaaggccagccaggccttcctgccttctgggttgctccctccctcccagctgccctggcctcaccagtcctccgacctctggagtctctgcttgtctgtctccccaatgtggccaagctcccggtcctggccacagactctggactcagccttcaggtcgctgtgggtcatgtgctcacaggccgtgcccccatcctcctggggaagggctgcagtgagcaggctgcactgccccgtccctctgcttctcttctctgaatcctgcgggggcagggcagtagagtaggagtgagcccgcgagcctggtgagatcccagctctgcccttgacaagcaggtggacttgggtcaccatttcacctctctgagtctcagtttccccatctatagaaagggacaagtctgtgatgacctcccaggtctgcgccagggtgagagcagatgacacagtcttggcaccgagtctggcacagggtgagccctcgatgaacataggcttttataatgatcattaacattgttactcacgtgtgttctctcacacagttactgtcacatgaacttcctctcaccagcgtgctcagaaacacacacatgcacacacacgcacgcatgtacacacacatgcacgcgcgtacacacacatgcacacgtgtgcgtgtacacacatgcacacacgcacacatgcacatgcgtgggtacacacatgcacacacgtgtgcgcgtacacacacgcgcgcgcgcatacgcacatatgcacacatctctgccacaggcacgagcacattgtgcatacttgagttctttcatgtccacgttcagcttctatggctctgaggacagaagaataataatattaataatgatgatgataacgacaccaacaggtaacatttatgaagggcctttcttgactttgggtagagttttcatctgggccttttgtgggggcctgtgattggaagtgtagacacggccccacttctctctctctgggggtctggtcaccaggcagcggtgagctgagcctgttatcagccctcatgcaccgggctcccgggagctgggggcaggccacatggccctggctctccaggtccctgagcctggaggaagccctcgtcacctgacccagcaccactgcctgagcgcggacgccaggttcttgaggtgtccctttacctcccagcccatcagttccccactctgtaaaacactccttggtgtggctgtcttccccgcgtgagcgtggtgtggaagggctttggtgcagtgagctggtccccccgtggcagggttccacccatgaggaggtgggtcctggtccctccctcactgcatggcggttggctgagatggcattcccctgagtcccagcagctaggagggcacgcctgggccctggctggctccggggtgtctttatcccactcagagcatcggacttggtgtttagggtagtgaggaattgtcagggttttcagcaggtggggagcatggctggcctcgtgttttggacgctcacactggcagtctcaggtgggttttcatgcggggcgctataatgcatagctcagcgttctagcattgcatttgcgagttagaacaaatcaggcaacttagattcgctgagctctgaacaggtcacaggcgtaatctcatcactccccacaaccaatccttgaggtgggtgcagccaccacacttcacaggtgaggaaggtgaggctcagggcagtgaggagtaatttgcccatcatcaagcaggttccagctgatggcaagctgggactcaaacttgggtctctctgggcccagagcctgtggtgagtcccttccgccaccttcgaactgcaggcagcgaggcctactctgtgaccatttcatgagatggggaggcaagcctgcactctctgctgaggcagggaccacctgccatcttcagggggcctggagactggggtttctcggagaggagagaaggctggaatgagatgcctgatttccaaactctagaccttgaacctgtgccaggctagcaggtgaggcatgcagagtcccacatccaggaggtctgcagaggggcctgggaatcttctgtttaattagctttccagggagccaggcatggtggctcacacctgtaatcgtagcattttaggaggcttgcttgcgaccaggagttcgagaccagcctgggcaacatagtgagaccctttctctacaaaaaaaattaaaattagctgagagtggtggtgcacgcttgtggtccccgctactcaggaggctgaggtaggaggatcgcttgagcctgggaggtcaaggctgcagtgagccactgtactccagcctgggtaatggagagagatcttgtctcaaaaaataaaaataaaaaataataagctttccaggtgattctcctgcccagctgggagggggaacctctggagatggtccttgaggttctatccacccctctgactctggagtccattcagtaacttgaggacaagggtcacccagggcagtctccagcctcagaaatgttacccgattatcagacaggtgcagagcctgaagggccagggcactgggtcctgatgaacgggggctccgcctcctgtagtcagtgtgattcgggcagattacttacttcgcctccacctcctcatttataacgtggggacaatcttagaactgctctgtgcagtgccatcattgggctgatagatgaaaaggccattttaccaacgagaaactgaatactctcagaggcaaagcaattctacgaagactgggggaggtctggcccagaccccctgctcttcatcaggctgcgtccttccctctgctcccgggaacttccgcacgctgggacgtgctccgcctgctctggctaattaacatggactaacgaatgctgctttaggtaagtgggcaggttaatttccattgtctcactggattctcaccacgccctggagtagatggaaggagcaggcatttgctaccccattttacagaagagaagcccaagccccagagaagggatatgcctcaccaagcgctgcacagctggttcgctgcattctgatatgggaggaggacagagttgggggagcagcgtgccagagtcagtttttgggcagcggagatgagagtggcacccatcacggggtgggggtgccccaggcagagaacagggctgattctgcccttgcaccagacctccaggagtctgtgccactctgggcatcagcagctcccggggctggcagggctaggccagaccattggccccggtggggcagctggagtagactcagatggaactgattaatttatccgggtccctggcaggaaacagacagggagcagctggctggctctttggtgctccattaattgtgacaatgactttaaccccagatgtgacgctgtgctgcttggagcctctgacagcaaagcggggtgtggagcaggggtccttcttgggtcggggagactcggaagcctaaactctttcaggtgaggctggcgctccctggggcccctttggaagcaggaaatcctcccgcatggtccctggaggcaggcgcggtaggctgtgaagatgctgccagttcagtataatattagggccattcgtcaagggccttcccgtgccaggcctgagctaagcactttgcagaaattttcccattgcatcctctcaaacctcgctcaagtggggcctgtttgagtcccattttacagatgtgggcactgaggatcaagacgagattagatggaggggcttgggatgggcagaaaaagacttgagatgcccatgaccttctctctagtgcttgtggaataagcccagaactccacaggttctcagagcatctggtcatgaagcccccctccccctttaagcaataggatctctagttcaaggacaattgaaaaaggtcaaggtgttgcatgcgtggaggaaccaggacaggggcccagagaccaacccctccctctgccctcatcctccagctcctcctcagagccctcatgagtccctgaagtcagctcaacaagggactgctcctggccagccagtgctcagcagccgaggaagctaggactgtcccctcccctgtcttctgcagacctccacccttgcaagaaggtcctgcttcattgcagtgccaggttgacaggtaaactacagatgcccacacccaggagggctgggaaggggcctgggagtcttgcccacctggattccctcagctcatcaccctgcactgcctagtctggtggacccggggcacttgaggacagggagtgttcttggcatctttctttttttgagacggagtctcgctgtgtcacccaggttggagcgcagtggcacaatctcagctcactgcaaactccgtcccccgggttcacgccattctcctgcctcagcctcctgagtagctgggactacaggcgcccgccaccacgcccggccaacttttttgtatttttaggagagacggggtttcactgtgttagccaggatggtgtcgatctcctgacctcgtgatccgcctgcctcagcgtcccaaagtgctgggattacaggcgtgagccaccgcgcccggccaggcatctttctttctttcttgtttattctggtgaaatacacataaggtaaagtttaccgtcttaaccctttttaagcgcacaccttggtgacatgtagtgcattcacattgctgtgtggccatcaccaccaccactgccagaactccgttcatcctgcaaaacggaaactccacacccttaaacagtaactgccccctccctgccagcccctggcagccagcattctactttctgtctctctaaatctgactatctaggtactgcgtatacatggaatcctaactatttgttttttgtttctagcttatttcatttggcatgtctttaaggtgtatcagaatttccttcccttttaaggctaatactccgttgtaggtatatgccacattttgcttatctactggttcattgacgtacacttgggttccttctacgttgtggctgttgtgaataatgctgctatgaataggggtgtacaaatatctttttgagaccctgctttcaattctttgggatatatacccagaaatgggattgctagatcatatggtaattctattttaaacactttgagaagctgccatactgttttccacagcagctgcactattttacaatcccacccgtaatgcacagggttctaatttctccacatccttgccaacacttattattatcatttttttttaagagggagtctcgctctgttgctcaggctggagaacagtagtgcgatcttggctcactgcaatccctgcctcccaagttcaagtgattctcctgctgcagcctcccgagtagctgggattataggcacccgccactgcacctggctaatttttctatttttagtagagacagggtttcgccatgttggccaggctggtcttgaactcctgacctcaggtgatccacctgcttcggcctcccaaagtgctgggattacaggcgtgagccaccgcacctggccttattattattgttttttataacagccatcctaatgcgtatgaagtggtatctcattgtggttttgatttgtatttccctaatgattagtgatgctgagcatcttttcatgcaccatttggccatctgaatattttctttagagaaatgtctgttcaagtcctttgcccattttctaattggactgtttcttttctgttgttgtcgagttgtgggaattctttatgtattctggatattaatcccttatcagctacatgatttgcacatagcttcccccatttcctgggttaccttttcactctgttgagagtgtctggtttatttcggaatcactgatgcccagccagcaggcagcacagaagcaattaacactcaactttctcacatcctgggattcccttgagtgggacccaggccagcccaggggaacagcaagaagagcagggtggagggagtctgtggatcaggcaatcactcaacaagcagctgtgcaggagaggcggctgaaggatttgaagtgggggcaaggcatagtctggttcatatattagaaagattcctctggcagctgatatggaaactggacttgctgacttccccaggcaagttctcccactctaagaaagataggaggagccacagagaaatgagggcagagctttggcatcagacaggaccgattcccgtccagccattgctcgataatgacatgacctcagatgtgtggctcacaggtcagagcctctacttcctcatctcaagagttagtaaataacacttcccctgaagatcgtggccctcttcgagatcatgtctgcagggggcctggcatctagtagccaccaggaggccagctcctttgtctttttttttgccagcgtccccagcacagaacacagggtcattggcaaaagagggtgaggtgctggctctgctgtagtggctgtgttctctctgcccacagtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtgggtgagcgcgccatggcctgggcatgggtcagccggcagcggtgcttggtcttggcagggctgccagggtgtaaggggggacgtcagagcccacaggcacctgagtgacccacacagcccctgggaagatggataaacctccagtgttcctacatcaggaaatatgcgaggccacctgtgtccgtgtgttgggaaggacgtgggagcaagatgggggaggggagagggagggaaacagaccccagcgaggcggtgccttctgtgggaggtacagctaaaggcacctgtgcaattgggtatgctatgggattcctacccggattagggagtgataccatgggctaactcaggtcagacatagttctaagcactttgcgagtattaactcattgaatcctggccactacactatgacgtaggaactactgttatcctggttttatagatgaggagagacagtgaggcaaagcaacttgcccaaggtcatgcagctggggatggcagagctgggatttcaactcagaagtctggctccagagttggtgctcgaaaccgctgaacttctaacctgtagggtggagggaagtgggaccggggccctgggtgaatgagcacactgaggggtatgaagccagggacacccagggagtacagtctgggttgggcctgtccctggggccctgaacaggctgcttctgttcagggggatcttatcagggacctgtgtgagaagacaggcaagggccttgtggaggaggacagtgagaagagagcccctgggccatgacttagggtggcagctgtacccataggtgtgctgctgggttcctgtgtcggagcaggagcaaggcatgcagacgagggagcctaggcccaggtggtgtgcatgagtgtgtgtgtgcatgtgtgcgtgtgtgcgtaagtgtatgtgtgcatgtgtgtgcatgtgtgcgtgtgtgcatgtatgtgtgcatgcgtatgtatgcattgtgtgggcctgtgttcatgagtgtgtgcatgtgtgtgtatgtgtgcgtgagtgtatgtgtgcgtgagtgtatgtgtgcgagtgtatgcatgtgtgtgcatgtgcgtatgtgtgcatgtgtgcatgtgtgcgtgtgtatgtgtgcatgtgtgcgtgagtgtatgtatgcatgtgtgtgcatgtgcgtaagtatgtgcatgtgtgtgcatgtgtgcgtgagtgtatgtgtatgtatgcgtgtgtgtgcatgtgtgcgtgagtatgtgcattgagtgcatgcacatgtgtgcatgagtatgtatgcgtgtattcatgtgtgtgcatgtgcgtgagtgtatgtgcatgtgtgcatgtatgcgtatgtatgcatgcgtgtgcatgtgtgtgactatgtatgcatgtgtgtatgtgcatgtgtgtgagcgtatgtatgcatgtgtgtgcctgtgtgcgagtgtacgcatatgtgcgcatgtgtgcgtgaatgtgcatgtgtgcatgtgtgcatttttgtatgcatgtgtttgcgcatgtgtgcgttgagtattgtgcatgtgtgcatgagtgtatatgtgcatgtgtacgtgtgcatgtgtgcgtgggtgtatgcatgtgcgtgtgcatgagtgtatgtgtgcgtttgtgtgcgtgtgcgtgagtgtaccaatgtgtgtgcatgagtgtgtgcatatgtgtgcatgagtgtatgtgtatgtgcatctgtgcagttgtgtgcatctgcgtgagtatgtgcatgtgtgcgtgagtgtatgtatgcatgtctatgtatacgtgtgcatgtgtgtatgtgtgcgtgtgtgcatatgtgcgtgagtgtgcatgtgtgcatgtgtgcatgagtgtatgtatgcatgtatgtgtgtgcctgtgtgcatgtgtatgtgtgcctgtgtgtgtgcctgtgtgcatgtgcgtgagtgtatgtgcgtgcgtgtgtgtgtgcaatgtgcgtgtgcatgtgtgtgagtgtatgcatgtgtgcgtgcacatgtgtgcgagtgtatgtgtgcatgtgtgcatgagtgttcatgtgtgtgcatgtgcatgagtgtatatatgcgtgagtgtatgcatgtgtgcgtgtgtgcatgtatgtgcatgtgtgcgtgagtgtacgcatgtgtgcatgaatgtgtgcatgtgtgcatttttgtatgcatgtttgcgcatgtgtgcgttgagtattgtgcatgtgtgcatgtttgtgtgcatgtgtatgtgtgcatgtgtgcgtgagtgtatgcatgtgtgtgcatgtgccagtgtagtgtgcttgtgtgtgcatgtgtgcatgagtgtgtgtgcatgtgtgtatgtgtgcatatgtatgcatgtgcatgtgtgcatctgtgtgtgtgcatgtgtgtgcatgtgtgcgtatgtatgcatgtgtgcgtgaatgtatgtacacctgtgtgtgcatgtgtatgtgtacatgtgtgcatgtgtatgtatgtgcatgtgtgtgcatgtgtgcatgagtatgtatgcatgtgtgtgcatgtagcgtcagtgtgtgcatgtagcgtcagtgtatgcatgtgtgcgtgagtgtatgcatgtgtgcatgtgtgtatgtgtgcgtgtgtgcatgagtgtgcgtgcatgtgtgtgcgtgcgagtgtgtgcgtgtgagtgtgcatgtgtgtatgtgtgcatgtgtgtgtctgtatacccgtgtgtgcatgagtgcatgtgtacgtgtgcatgagtctatgcctgtgtgcatatgtatgcatgtgtgcatgagtgtatgcatgtgtgtatgtgtgcgtgcatgtgtgcgtgctttagtatatgtatgcatgtctgcatgagtgtatgcatgtctgcatgtgtacgtatgtgtacgtgtgtgcatgtgtgcgagtgtatgcatgtgtgtgcatgtgcatgagtgtgtgcatgtgtgcatgagtgcattagtgtattatgcatgtgtgcatatgcgtgcatgtgtgcgtgagtgtgcacatttgttagtgtctgcatgtgtgcatgaatgcgtgtgtgcatgtgtgcatgagtgtatgtctgcgtgtgtgcatgtgtgtatgtgtatgtgtgtgcatgtgagtgtatgtatgcatttgtgcatgagtgtatgtgtgcctgtgtgtgtatgtatatgcatgtgtgcatatgtgcaagtgtatgtacggatttgtgcatgtgtgtgaatgtatgtgtacgtgtgggcatatgtatgtgtgcgtgtgtgcatgtatgtgtacatgtgcatgcctgtgtgtatatgcatgtgtgcatgcatgtgtgtatatgcacgtgtccgtgtgtccgtgtgtgcatgtgtgcatgtgtatgtatgcatgtgcgtttatgtgtgcatgtgtgtatgtatgcatgtgtgtccatgtgtatgttcatgtgtgtgagtgtatgtgtgcatgtgtatatgcatgtgtgtgcatatgtgcaagagtatgtatgcatgtgtgtgcatttgtgcatgtatgtatgcatgtgtgtgcatgtgtacgtgcatgtgtgcatgtgtatgtgtgcatgtgtacgtgtatgtgtgcatgtgtgtgtgcatatgtgcaagagtgtatgtatgcatgtgtgtgcatgtgtgcgtgaatatatgtgtacctgtgtgcatgtgtgtgtatgtatgcatgtgtgtgcatgtgagtatatgtgtacatgtgcgtgcatgtgtcagagtgtatatatgcatgtgtgcatgcatgtgtacatgagtgtatatatgcatgtgtccatgtgtgcatgagtgtatgtatgcgtgtgtgtatgtgtgcatgagtgtatgtgtgcactgtgtgcatgtgttcatgagtgtatgtatgtgtgcatgtgtttgcatgtgtgcatgagtgtatgtgtgcatgcgtgcatgcatgtatacgtgagtgtatgtctgcatggtgtgcgcatgtgtgtgtgcatgtgggggagtctgtgcagccaggcaccccaagagtggggaacactaagcaagcttgtgtggacaaacagcaggtgtccagctgttcctggtcttggccaggcttctctccgtcgttttctttggtctcatgagtggctgggcacatggtggctcagccccccgggcacagtgaagcctggctgttgagatcattggatcccctggacagaggaggtgaaagggaggaggatgtttatatgcagggatcagagagacaagagcctgtccccagatacccttagtgaaaactggaacggggcccttgtcagctgctgggaatatgcttctagccctttgctgctactatacaggccctggggccacagtgagagggacctttagtcctcatcacccatcccccagcaggcaggcaggaaaggcccctgagcgctaataggactgggcatgacataggctgacagcctcaggtgataacaggtggggatggagtccagctggctccacttaggagccgtcttgcccagagatctctggggccaggatcttccctgcagccactaggccctttgaagcccttcccggaggctctctggttttctttctttctctttttttttttttttttttttttttttggagacggagttttcacttttgttgcccaggctggagtgcaatggggtgatctcagctctctgcaacctccgcctcccggttcaagcggttctcctgcctcagcctcccgagtagctagaattacaggtgcccgccaccacgcccagctaatttttgtatttttagtagagacaagatttcaccatgttggccaggctggtctcaaactcctgacctcaagtgatccgcctgcctcggcctcccaaagtgctgggattacagtcttgagctaccacgtccaactcgctctctggttttcttaagaaatctcatttcacatccccaatttctatgagtcttctcctgtcccgagctctaaaccccaaagcaccttctgtggcatttgcccatttctggatttgttctgccctctgcagcctggtttgccaggctccccaggccacaagctctcatggttactatcacagacagccctgtgtgtcagctttgcactgggaagaaaaacaaccaacacccctattgccttcacagctcatagcggggcgcatcacataccagctcatttgctcattgcagcaaggcaggtatcacaattccattttacagatggggaagctgaggtgtaagaggtagtgttacctgcttaggccttacagctagtgagagctggagcctgaagacaggtctgtattgctctgagccaggtacaggcttttagcgtctccctagcctgccccaggctgctttgtccgccagagctgcgccaaacctcccctcattcaggtggggctaatgaaggaccttagtgatgatttttcgtctttgatgtaatagttatccattctgctgagcatctactgtgtcccggcattggggatacaggtacagggagtccctgcctctggggacttagcaatttcttatccttacaacagtcctttaagataagtattatagtcccattttactgataagaaaaactgaggtccctcaacttaagtagcagagtagtgatctgatcccaggttgcctgactccagcaccttcaattgcttcctctgtgcacaaagccctctgcaaagccccacttccctcctccctggggtagcattcggatggatggttagcaactggtacagcataagtcataacaatctggctggttggccggtgcatacgcactcagggtcggccaccgtccccaagtctggatttagccagcgagtacaaatatgccaattatttgtcccaggtgaactgaaccacatctgtctgtaggaagaagacctgccctcctgtctttggggtcaagacctcgcttggaggtctcaggtaacgctgcagtctccctgtgtggcagaagagggaagcggagcccagagaggggatatgtcttgcccaattttctcagcacatcaggggtggggctctgagtggaaaccccagggcctgagtggcaggacctcacgggggctgggagaggccaaggccactcctatttcctggcactgctgccacattaataacaaataaaaagaaatgccaaagtggggttagggaattgcagcatattttgaattttacatttaaataataatacaacgtaattatgccagttgcaagataattacaggttttataaaaaatattaattcatagtgcactgcaggcagtgagatttgggaacggaaagcccgttttaagtcgcacaaggaaagacatttctcagccccgttggtggcttctttggctgcgtaacctcatttgggaaggtcagcacgggtctcaaactaaggcctttcacaaatgggagccaggtccaagagccctgcctggtccccctttctacccctggagaagcccttgacctctttggagctgcccggctccttggtggatggcctggggcaaaggaagggctgggaacagagtggggtacctttcctgggatacttgagatgtcttctgcaatctgggactgcccctgcccagcctgagggagtcttcaggagacctgctgaggtccatggggcccctgcctggtttgagaacatcctgatcccttctgggcagttctctcagcaaacagttaaggagaggaagggcgtggagtcagggggtctcagcttgcccagtcctgagcccttgtccttctagtgacaggagcaggggttgagagcctgagacccacagcaggggccaggcccccttcaacagctgccctccctgccttgggttttgcccttagaggtaccctcagaaggtggccaggcagtacttgattttgcagaagacagtatagcctgggataagggacccgccaggtcacatggctctttagaggccttgcttagattgcactcagacctcaagagacccatggaaaaatgtcagagccatgtggggttcgtccagtttaccactggggaattggaggcccagagaagtgaagtgactagcccaagggcacacagcgaggggtggttgatagaatctcacatctcccaactccttgcccagaggaagctccccacactccacaactccggatccagtgacctccccacaccagactgcacttcccagcaccccccgcaccctggttcaccccagaaagaggaagggcctctcagcgcatcacccagcggagcagcagctcagagtctgaagtcctggttgctgtccttcctgtcacctggacgcagaatataaatcacccttcgcggccctaatcatctttctataaatatcagagagtctcatttcggagggggagcaggaacagtgagctcttttgccttcctgactgtgtttaaaatctgatttagaattaatttcctttggttgtccaccagcggacaccttatttgtcaaatctccggctctttgcgggggagagcagagaggtggccagggccacaggcagctgctggcctgacaggcggcctgggcaaggtgccctcagcagggtcaggagcccctcctggctcgcggcccaacacccgggcacgtgcaggctccggaagcaccctgggtcgacaggcagggccgggccccagcccagagccactccatctgtctcagccattaattcccggcccagcctccaggtctctgggctccctgaggcctggtgattagtattcttattaaagattattttattttcattgcgtggattaatctggccttgacacattatagccatatgggtattagccgagtgtgtgagaactgccgactggtgagccacagcggcgcagccatctctcagctctgggacggtgctgggaggacggggggaaaggccatagctccagaggctcccccgcctgactgcacattctggctctgctgggaacctggggcaaggcattcaggctccctgagcctctgtttcctcttctgtcgaacaattgtaagaattccaactacatcaaattgttataacaacaagtgccaggcactgccctggcatgaatttatgtgtcttcactcatgtcatgcttgccatctccctctaaggtgggtagaattatgatctccaccttaaagacgaggaaactgacttccagcaccttgcctaatgtcactgagctcagataaagggggttagacgaggacaggaacccaggtgctacacccgagcttctgctcgggcctgacaaggaccaggtgggccctggaaagggtcagagacttgcagggccagccgtggtgctggcttccctcaggccccgcatcacgccatgaggctttgcctgtccgtctgccaatgccgtggaagctccctaagagcaggcccagctcttacttctcttgggtccatagtagaagctcagtaaatgttggggaaaggaataaatgagggagggaagaagcaaatggtctctgagatgctaatcgttgtggattggatcattacagtgaggattactgtcattcagctcagtaacaggttcaacaaatatttgctgacaaaatgcaaagcccttttctgatgatgccacccccagcggcccccggggctcagaaggagcctgtgcccaaggctgtgccccaggactgagcctcccggggggcttctgggaagaggaggcgagatcacagtgtgtcagtcaagactcctcacgactccgagctcctagacctgagctcagcccccaggcagaccagagccctcttgggatcctctggaggggagggaaagatgttgcaacaatggtgcgtattttcccccactctgcaacttacaagctctttctggctctgcagccttctagagtatgaagcaacttcagggcgttaccatttctcctgactccaggttttctctcaagtttgtagaattttacaaatgaacctggttttagcttttgtaataaagagatacgatcaacatccagagaagaaatgctctgcagtggcctgatgtctttgtaattgaaggttctctcaggcactgagttttccagaacaggatttagtggagagagaaccacagtgagcttcccagtggtccctgttgcaaaggacttcagttccatggacggagccgggagctgcctggctgggtggcatttggcccacctgaacctctggggtctctgcccagagcagataatggtgggatccattcaatttgaaaactcctgcctggagtttaacagcatctgcccagggctagcactggaccaggttctgggacattgagatgaataagggagtcgtactctgtttgcaaggatctgcccacgggggcctcccagtctagaaggagagtcagcactgacaagcgagtacagccatagtgttgcaggtggtgaggccaagcaggggccgcaggagcagggcggggaatggtcgtttctctgtgtgtgtgtgtgtgtgtgtgtgcgcacgcgtgtgtctagagttccagaagggacagtcaaaattaatcttaaaagaggagctcagtaggtggacagaggagaaaaggcagcccaggaagcgggcacagcctgtgcaaaggccccgaggcaggaatcagactgctgggtgtggggatcggccagtgctttagtttggcctaaggatgggggtgaggggcagcactaaacaaggctccaagtgggttttggctgggcagggagggatttgaacaccaggtttcattgtctaagccctggggagcctgtgaggcatgaaacaggcagtgactgagtgagatgtgcattttggagactccctcaacctagggtatccccctccctgcacagtggactccttattctttaggccacaactcaaatatcatctcctcctctgggaagtagctcctcccaccatttacccttccatcaccttagcccccttgttctctccctccctcctagcagtgatcccagctgagagccagtggctctggttcacagccctccaaggcccaaacaggcctggtccagagttgtgctcatgaacagtggttgactgaatgcatgatcacgcaggcagctgggtggggggaggcagggctggaagccaagtctgcaggctgctgtgggtgagagatgaggtagggtgtggcagtggctggagagagggtcagtcccagccacagtgacggggacagtgacagtgtgggcctgggaggggagaagcctgcgcttcttggatagtcaccctcccatgggggcttgtaaaacagaccccaggtaccggccctggctcttctaactcagctgtctgtggtggggccaggaatctgtatttttatggaggtggctccatgtctgcctgtgtttgggagcgatgggtcttaccaggtgtcccccccctttctagtcgcattcccagcacccccatccctggcctgcttcctcatcccacccaagtcagttccggggcatttgatcctcagccccatggccctggcccctaggctggcgtcccacgtaagaaccagtgtcccataaaagagagaaggacagcatctccacccctaaagctggagacagggcctgggggaggggtcaattagaggagggctggggaatttggagatgctcaggggtggggctcactttgaggctgggactcccatgtcagggtctgaacctcagctctgccctgactggctgtggaaccctgtggaagacacaggccccctctgcacttcagttctgccccctgcaaatgagggcagcactgggcagtgtgaaggtctgcacctccgtccctctggggcaccccccaggaagctgtgggccacagtgtgagcggtccccaaggccagccagggtggccctgctggctcatgtgcagccgccttctcctccacagcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccgtgagtaccactccgagatgccagcacccttgagcccaagactgggccgggcccctgtgtttggtcctccaggcctcagagagccagttctctgctggtggggcaggggcgggtggctctcttgagccagaggccagtctgaggtggggggggggtgactctgatccctccacggtggcctagacctctctgggctcccagcctctgtcctgtgtcacctacactggagggcagaatggagctggcctcacttctttccccacatcgggcagtttttgtcatcttctgatctagcagcgatgccgatgtcctgggggccaggtgggcaagccagggtgctcgcctgtgcggagagggtgagggttagggcagcaacccttccatcaccatcatctttgatgaacttgttggaactgctgaatgctgagagctgccttacatgtgtatggtgtgtgtgcatatgtgtgtgtacccatggagttcgaatatctgattctgtgtatgccctggggccctgcagtgattgtgtgttagcgtgtgtctgtgtgagcagctgctcttacagacgacgcctgtatcgtgtttggatgcctgcatgtaaatgtgtgacgtgtagttgagctcacatatataaaggattcgtcacatatattaaggattcttaggaggaggtgtgtgtgtgtgtacatctgggtacctgaaggggactcagaagtccttgtaaagcttgaatgagggtgtcttgtgagctcagcacgtgtgtgtgtgcgtgtgcacacctggccctgcaagggtgcatgtgcctggagagggtgtggctgcatgtgcacgtgccctgtggacctgaaggtatggggggattctgcgcccatgcctgcagggctgcgtgactgtcctaccttctgctgatgcagcgcctggattctctcctctcatgtgtcctaacgggccactcatactcccattccaggcctggggagggaccacagcctgctcagcccagcccagttgccaaccctgggctcttgtggtagggcaagaggcacttcagactgttctgattttgctctgaatctgcccaagcatcagcccccatctcccgctcccatacatccatcaccacccagccccagcctccctgcacatggcaggcgagggcccaggtgcattcatgcccacatgcttgtgcacatacacacagacacacacacccaccctccctccactgccctgcccagatctgtgcattttccacatgtgggacctgttggggcagaaaaggtggccaggtgacagcgtgggcacctcaggcaagtcgagtctggccccaggtcatggacacttgcgtgaagctggctggactctggtttctttccaaacccacagttcagtgcctttaggttctggaaagcttaagatcgtaaaggctgagcttttagtattctatacccttccgatgttaaaaattctcttctcttcaaattgtaagattctgattccaagatcttacaattctattttctgaagatttaagattctctgcctggaattctgagaactggaattctgaggccaggggtccccacagacccccatgccctcttggctcaaacccccaccccagcccctcaggcccccagccccacgtcctggtctcctcaaccaaggggtcacccctctctctccaaagtctttgtgctgcccagacagaggctcccatgcccagggttggggagcggctgcttggtgcacacagccatggggatacacggtgggcttctgggggcctccacttaattccacagtgcgtgctcagtggcattttgtatcggatccggcacagaagggtcaaggaatagatgtggctgcaaatacctgggtcacttacacacagggtggctgccgtgggcacccccgggactgtgcggtctctctcccactctgggtgagcagtaggatgtccagacccttggatcatggtggtcctgatgggtgggggggatggggtcccagggttctgtgcccagactctgacattgtggtcccggtctgatggcagagacacaaactctgcccttggggaggctacagaggatggagtagatgtggaccttatccttaaggagccctaaatatgatggggagcccttcccttggggagccccaggtctgatgataggaagacaggacagcccaaataaataaccactgccccatctgtcatcctctgccctcagggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgccccagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctctgtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaatcactcggatgatcattttccagaacagctgctacagctgcccttgggatagacttggctgcactggcttggaccacagtagtttatctatcagtttctggccagttggtgggctgaattcacccccggaacctctttcttcccaaactctggaggaccctgcccgtcaagtgacagcgtgacccaagagccctcctagggcagcttcctattaacagccaccctcacctgtgcccaagaccctcaggcccccacccaccatctcctcccaaaaccacacagccctggcctcgcagacaatatgcccaccacgtcacagaggaagaaactgaggcctggagagcacccagggccacctgacataggaagtggcagaggcagggctcaaacccaggtctgtgtcactcccaagtgaagcaggtccccccactctgaatctagggcatgctgctccctgacgccagggcctcagcccttcagaagattccctcattcgacagccctcgtggaacacccactaaatgccaagtgtggtgccaggtgctggcaacacagagagagagtgagctatgtgccccgtggtagagcccagccctggcccacctgtctctaggcacctgaggcccctggcaggctggtcccaagtggaggggagagcaagagaagttcacagcattcaggcagcatccgggatgccccaacattaaagaggaaactagaccctgccttgaacctgccttcccctccggtcaccagaccatttctcttcccatacgaccctctctgtccgtgcctggcgtatctacttcttcctctcctctgcgggacttctccatgtctttcctcacctcttcacagaaatcagcagccctgcgtggccacatccatgggcgcctcttccccctttcatttcctcctcctggaaacacttttctcttgctcgtgtgtcccagcccacgcccattttccattgacctgtgtggcctgtccctctctgtctttgtagccccacctcctttaaatggcctctaaaggccatgggtccctgggaatgtcctgggccctcctctctttcctgtgtgcccagatccatcttttctgggcggctgtttcagggcccatgactttgaattccacctttgtgctaacaacccccaactcgcggtcaccagcgaagacctctcccctaggacccagctgcccactcctgtctccattcggttatgtgaaaaacaaacaaccctgccacacctgcacctgccccgccctaggacatggcacctccagacccaagctgtcatccttgactctcatgcatgtcacatccatccccccctaaagccccagggacctcccttcaaaatgaccaactgacttccaccccccacgagtccatgcctggaccaccacaggagacccctcttgcctcacccccacaagacattctccacaccagtcctgagtgagctttaaaaatagaagtgagggctgggtgtggtggctcacgcctgtaatcccagcattttgggaggccaaggcgggaggatcacttgaggccaggagtttgagatcagcctgggcaacatggcaagaccccatctctacaaaaaaaattttttttgagacaatgtctctatctgtcacccatgctggagtgtggtggcacaatcacggctcactgcagtcttgatctccggagcccaagtgatcctcccacctcagcctcccaagtagctgaccaagggcacacaccaccatgcccagtgatttttttttttttgtagagatggggtctccctatatttcccaggctgatctgaaactcctgggctcaagtgatcctcctgcctcagcctcccacagtactgggattacaggcatgagccaccatgcccagcaccaccgccccccaagttttttagatgaaaatacatgagaacaagctgtcctcaaagcccttcacagcctaggctgagcgcacatgcaattcagacattctcatggcctgtggacccacacagcttcacccctgcctgcctctccagagcacctctttccctggctcactctcttctggccatgatggtctccggtgccccctccttgaacacactgggtctttccctgctgctaggccgtggcctggcttctccttcggaatgactcactcttcccctgacattcctatgcctggctcctctgccctggaagctcccccgaccacctcagctgaaacgtgccagtgcccttccgggccctgcagtggtcttctccatcacagacagcaccccttcctacctttcccagcaccaaaagaacccccattctcctgtttattggacgccctgtctcctttcctgggacagaagctcctagagggatgtcttgggcactgcagagttcccggctcctagccccgtgcccagcatgtgataggcactcaggagtcctagaggatcaagcgacagctctaagcaaatgtggaggactgtgctcaaagaccacctgcccctcctgcctcaccatcaccacttctctacaaccaactcctccctggagccctctcggacgcgaaccccattcccctcccgctctgggccctggtctcactctgtctgcccccatcccacagcacctcctgccttggtttttaagagacacaccctgtgtgtcccttgcaaacagtggcctcatcgaatcctcccctccccctggcaagtggtgctcactagcttcactttatagaaggggacctggtgtccgcagacagcaagtgactcacccagggtcccagctagcaagagagggagccaagtcccgaacccacgcctggctcccagactggtgggctttcccctggaccacacccttccagtgcaactctggagctgcttcttaatttctcatgccagaatcctcagcagcatttattgggcacctactgtgtgcagtccctgcccccagggagctcccggttgtgctggggatgcccagacatgagggaagacttagtcacatagggcagagagtcagaactcggggtgagcagaggggaggaggaggcctgagggctggaggggcagggaggacagggcagttccctctgtttggctgtggcgtggctgtgtctgacacctcctagcagcctccccacagggctgaccgcacctgagccaggagggagagatgcatgaagaaaggcatgggtgacgccgtcaaggagggaggggtgggcgggcaaccaagtgtgactgggagaatacttggggctcagctcacccccttccctcagcatccagaactgtcccaggtatgccctccaaacccaggcagtgaggggccagttcctccattctttctacacttctttctcctgacctttcctccttcctcaagcactcccaagcagctggtccatgccgggccctgggctggggagggaggctcaagcgtcttcttgtccaagccaaccccaacatcccagaccatgccaggccacgccaaccccaggggactgaccccaagtggccaccagcgatttgttgggagaactggagggtgctggctgtcctggggctggggcaggaccatcaggaagctgagcagggctggaaccaggatccccaggtggaacctgggaagggttgggagagaggccacgccttgtctcccctccgcccatctgacgggattggccgccccagccccgtcccaggtggtggtgatccgtcaagagcgggcggggcagaccagcgtctcgctgctgtggcaggagcccgagcagccgaatggcatcatcctggagtatgagatcaagtactacgagaaggtaccacgggcaggacggagtgggaggggctgggccagcagggcagggcccactgaccaccgtcccgtggcaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccgtgagtgcagggagggggcgtgggcgcggagcagcccaggtgccaggaccctggggtcggggggtggccgaggagagagctagtgcaggctgagccagtgccaatgcaggatttctgctctccttgccctaccaagtggggttgtcggagttttttatttaattgagacagagtttcactctgccacccaggctggagtgcagtggtgcaatctcagctcactgcaacctccacctcccaggttcaagcaattctcctgcctctgcctcctcagtagctgggactacaggcacctgccaccacacccggctaatttttgtatttttagtagagacggggtttcaccatcttggccaggctggtctcgaacacctgaccttgtgatccacccgcctcagcctcccaaagtgctgggattacaggcatgagccactgctgccagcctaatttttttgtgtatttaatagaaatggggtttcaccatgttgaccaggctggtcttgaactcctgacctcaggtgatctcccaccttggcctcccaaagtgctgggattacaggcatggaccactgcacccggcctctgtcagcatttgcacagatgaaaaaccgaggttaggagaaggacggtcgctcgcctgaggcggcagagatggtgacagccccccacacaccatggctggtactgagatgagtgtcagggtctgggaccagcagcatcggtctcacctggggacttaccaaaaatgcgaattcccagtcctcaccccagcccttcagaaactctgtgggtgggcccagccatttgggttttaacaagtcctcggtgatccccaggcactgtcacatttgggaccctctgacttcgaggctgtccctttcactctcctcctgccccaatctccagccggagtcagggtctcctgtatgtgcacccactgcgtggtggaggtagggcagagctagtgaccgcccacctggcgctccctgggcgtctgagtgcctccagtgcttgtaggcctggcaccccctggagaccacccagatgggaatcctgagccctccatcccatgtactgtgtggcctcaagtcaattcctcgagttctctgagcctctttccatctgaaaactgaagatagtgctggggtctctctggaagggacgtggggagggtttactggggcttgaaggtacagctctcagcacactccgtgttgtcactgtcaggataacagggaggacaggcatttattggctcagaggacacgcgactcttctccggtaccacagccacaagaagcagcggcaccagcattaggaagccgggcatccaggtctcacgaacttgaagaggaagcttagtagagggtggggtgggaacagaggaggaactggcctgcgccctgactctgggctggctcatggctctgggctccccactggccccagggtcacagccaggcaggctcagaggtctgccagacccctgggcccaaggccagggctgagagcctggtcccccaaccctggctttcccctgcagggccccgctatgacaccaggaccattgtctggatctgcctgacgctcatcacgggcctggtggtgcttctgctcctgctcatctgcaagaagaggtgggtggtctggcccagccacacccagcccctcctctcaagcaccgtacctcctgcctgcccccagccccaccgagccggtggtccccgtgtgcctggggctggctcacttacaaacacaccacctcatttaacctagtgacatgccagtgatgtagagattctgacctcactttgcaggtgagtaaattggggatcagagaggttaggcttcttgccagaatcacacagctgataaatgccagagctaggacatgagcctaggtctgtcaaactcaagcccatactctcagttactttgtcctctcccactccattttggagggaggtggagacaggatagtgtgtgggcttgggatcccagacaatgagaactgtaaggatcatctaactgatggagaaatggagacccagggaagagaaggggctggccaaggtcatccatgtagttggccacagaagcctcatctcccaatgcccccaccaagggtggtttcatataacatggggctaacagcattgtagactttgccaagagggtcaggtggacttgagggcattttgaggatcccacagtgcttgtgaccatcatggcggtcacagtttagctgggttgagagcctggagtcagggactctcccctgcagactttgtaaggagcaggagctgacctgtcaggggaaggggcatgaagagagaagccatgactcgttccctggttggggtcagatcccgggctagggatggcctggcctcaggcagggcggtgccctcctctgcaggcactgtggctacagcaaggccttccaggactcggacgaggagaagatgcactatcagaatggacagggtgagtgcaggggcccggtggtctggggcagagggaaggccacagggggacccagtgctggactgggggtggcacagatgggaaggaggaaggtgcccagtgaaaaaaccagagcccaagaggcagattccagggtgtcacagagacctggtgccccagagggcagcgccgttcatgcctcctggactctcagaccccattcaggatgctagagatcctctccccagggaagggcacacatttgtatgatttcggggtgggagtgcatatactcttggacaagaatccctactacggagagattttcaggatcctgtagagatcccagacaacaaggcgaatctggagatgcctccctccacgccccactcctgtgcccgtggcagacagcatcaagcatggtgctgattcccaccaggcctgggtgcagcctcagactcctccttaactactttttatttttattttattttattattttttattttttattattttttttttctgagacagagtctcactctgttgccaaggctggagtgcagtggctcaatctcagctcactgcaacctctgcctctggagttcaagcaattctcctgcctcagcctcccaagtagctcagattacaagcattcaccatgcactactaatttttgtatttttagtagaacgaggtttcaccatgttgtccaggctggtctcgaactcttgacctcaagtgatccgcccgcctcggcctcctaaaaagctgggattataggcatgagccatcacgcccagccagaaactattttcaatgaatcaaagttgacccttgtggcaaaaacttatttttgctacatccctactccagaacaatttagaaagatctcaaggactgtaaaagtgaccccagaaaatgacagacatgcccagaactcactggagactccacagccccatagaaaccccagagcgactccagagaccccactttcacttgggaaatacttatggggtgcgtgttgtttgctaccacatccagagactcccagagacacccctcaccccaccccagacccatcccaggcccagggaatgtcaggaaaaagcaatctctcctgggccccactgaaggccctcctcccgcccctcagcacccccacctgtcttcctgcctctgcatcaccccccgggaaagctcccagagccccagttctatgcggaaccccacacctacgaggagccaggccgggcgggccgcagtttcactcgggagatcgaggcctctaggatccacatcgagaaaatcatcggctctggtgagtctcaggggttgtgagggcggggccagcatggggcaaggtgggggcacccagggcaaggtgggggcacccagggcagagggagcgtgtgacccaggggtctggcaagcccagggggtccaagggcctgggaggctgggggagtctgagggtcccactgccctccctccacacctgcccctctcggggcctgcaggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggtaggtgccgggcaaagacagcctccccctgcagtgcccctcctgcctggagaggcctctgggtccatcccctcatccatcctgctctgccccacctgaccctgtcctcctggttcaggtccctgaatgactcggggtgcccagagcctgggaccccagtggaaacccaaggcaccctggggtttccagtgctggcacaggtcctgagatggtggtatgctcctggggtctctgatcagcagccctgagccccaaaccaagagccaccctctccctactgcccgcccaggccgcctggcaatgattgtgactgagtacatggagaacggctctctggacaccttcctgagggtgcgtgtcccacccctgcctcttgcatgggcttggggagggaggtccagtctgggtgctgggagatagtgcaaagccctctaagccccctccctggcttggacaccacaggccgggggacaggaggcaggtatagggaggaggtcttcgagttcagccagtcgaactgcctttcggcccccattgcatgaaagtccctctgctccatgggatcctgctgccctgcacacaggctgaggggggtgcctctgtgggaatccaggccccacccagctggggggcatgctggctgtggtggagacggctggattcccagctcctgcccacagtttctttgctgggtgctcttaggcacagagcttaacctctctgggcctccatctctcgttccacaaaatgggtaagcagtcattgctgccccacgtacctcgcagggttgctgtgagggtaaatgagaccaggagaataacccttaactgcaaagtgcttcagaagtagtggcgcacttggcaaattgcaaagcaccgtctcaactcgagagcatcctacagatgggaggtgttcctgttcacggaccaggcgcctcgccgggctttcctgaagtccaagccatgtccccctgcagacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacggtgcgtcgcccacactccttccggctagactggggagtggggagatggcgccggtggcacccagggcccaacaattctgcaagtagctgaatgaagttggcagtttcggggtggccctcaacctggggcacatcctgtttctcctcttcacgccagtgccttcctctgggaaatgggaacagccttgcctgcctttcctctgtcaccaggtggccaggggagaccccagggctggtccccacagtcactcaccaggagacttcaggagggttggaatctccccgaattgtacccagactccacatctgtctctaaagtttgcctaaaacccagctgttttcaaacacattccatggggatttggacctctctagaggtgccttaggggcagccttaaaggcaggagctgagtgcatgggggccagttttcaccctggccccaataggagccctcccttagcctctgtcccacagcctctgggtaaggtttcgcatggagaaaggatcctgtgacaacaaaagaaagaaggaaggaaaggaaggagggagtggagagagggagggagggaggaagaagggaaggaaggaagggagggagggaaggaaggaaaggagggagggaggaaggagggaaggaaggaaaggagggagggaggaaggagggaaggaagggagggagggaaggaaggagggagggaggaaggagggaaagaagggagagagggaggaagggggagggaaaagaaaggagggaaggaaggagaaagaagaaaggaagggaggggagggaagaggagaggaggggagggaagggaggaagggaaggagggagggagtgggggaggaaggaaggaagggagggaaggagagaagggacgagggagggagtgggggagggagggagggagggaggaaggaaggacaagaaggaaggagagaaggaggaaaggagggacggagggaaggaaggagggaagggagagaaggagggagggagtggaggaggaaggaaggggggatggagggaggaaggaagggagggagggaggaaggagagaaggaggaaggaaggagggaaggagagaaggaaggaggagggagggagggaaggagggaggcaggaaggaaggaaagaaggagggaaggaaaggagggagggaggaaggtgggagggaaagaagaaaggagggaaggaaggacagaaggaggaaggaagaagggaaggaaggaagggatgaggaaaggaaggaagggaagaggaaaagaagggaggaaggaagaagggaagggaggagaaaggagaaggaagtgggggaagagaaggaagaggaagagttagaaaacgactaggctgtggcccctgagcccccttggcttgtggctggtattggccgagcatctgcttgtaccaggcgtctcactccctccttccttcgtctccacagcggctcttgtgaggcctccctcaggacaggtgctctgggacggtgggggctgtgttgtccctctggactggaaaacaggaccccagtgtttagctctctgactcagacggctcgggggacaccctgccaggcctgggcagcccctcaactcttgtgtgtccgtcgcagggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtgagtgccaggccctggcagggccgcgggcggtggagcctcagggtgcagggagggacggctgagcccagcgctgatcccctgcaggtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgccttgtgcccaccccagctccttgaggcccagctgcctcccagtattgccccagatctgtccctgggacagtttggccctgacactaggaccaggcccagcctgggcccccggcccctgccctgccgaaccccttcctcagcctgcttcttctgggggtccagcctcccgaaccctctggccacttaccaagagcccctgtgcctcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccagtgagtgatgggtggggctggggccccatgcgtgtgggggcagggggggggacccctgccggggaggctacaggtccagatccatggccctggctgcgtgcgcggctcccagcctcccaggcccagctggccagcagcacccttccttcacagggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccgagcccaccccaggtcatgccagcggcagaggacgtgaggggctggcagcaggcagggcggccccaggcctctgccctcctctcgggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacgcctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacgccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatctttgcctgcgtcccccattttttccccatctctgaaagcttgacatctcctgttggggaagggccagcctcatactgagcacctactgtttgcatcccattcatttttctcccctctggttttctcatctgtctggggaggtaggattagt

SEQ ID NO: 16492 - DNA, 47781 bp, Human
  misc_feature (1)...(47781): n = A,T,C or G
gcctcactctgtcacttaggctggagtgcggtggcacgatcacagttcactgcagtccccacctcccaagcttaggtgatcctcctactgcagcctcccaagtagttggggccacaggtatgcaccaccacgacaggcaagctaatttttttgtattttttgtagagactgggttttgccgtgttgcccaggctggccttgaactcctgacctcaagtgatctgcccgtctcctgcctcagcctcctgagtagctgggattacaggaatgcaccaccacgcccggttaatttttgtatttttagtagagacggggtttctccatgttggtcaggctggtcttgaactcctgacctcaagtgatccgcctgccttggctcccaaagtgctggaaatacaggcgtgagccacggtgcctggcctctcctcacctgcttaattctttactcaaatgtcacctttttactgtgaggtttacttttacctttggaggtttggagtagaggagggatactatctgtctaaaaagaaaaacaacatttagaaatataacagtatgggccgggcatggtggctcaggcctgtaatcccaggactgtgggaggccaagatgggcggatcacttgaggtcaggagttcgagaccagcctggctaacatggtgaaaccccgccccccacccgtctctactaaaaatacaaaaattttcccagggtggtggcgggtgcctgtaataacagctacttggggggctgaggcaggagaatcacttcagcctgggaggaggaggctgcagtgagccgagattgcgccactgcattccagcctgggcgacagagtcagactctgtctcaaaaaaaaaaaagaacggtatgagcaaagagtgagtaaggcagttatcagatgtctactttgccaggaatcaggctacagcaaataaaggtttatacataatattgataataaatgcccagctcttcccctgtaaaactccaatactctaagatttttttcatgaacaccgccccccgctgctccgacccctgcttttttatttatttatttatttatttggtagagatgaggtctcactatgttgaccaggctggtctcgaactcccagctcaagcgatcctcctgcttctgcttcctaaagtgctgggattacaccgcgctcggtcctgaacacacattttgtttgtttgtttgtttgtttacaaaacccctggagaacccgcgtattctaacctgggctggtttttgtatttttgcaaaataacaccccacacattctcgtatcagcgtgcagatttttttgcacccagtttggttgtttgcggccataagcttttctttaagcctttccaacccgtccttctagagaaagtgtcttcataaggaagtcacactgctcacgcctgtaatcccaacactttgggaggccgaggcgggtggatcactaggtccggagatcgagaccatcctggaaaacacagtgaaaccccgtctctactaaaaatacaaaaaattagccgggcgtagtggtgggtgcctgtagtcccagctactccgaaggctgaggcaggagaatggcgtgaacccgggaggcggaatttgcagtgggccgagatcgcgccactgcactccagcctgggcgacagagtgagactccgtctcaaaaaaaaaaaaaaaataaataaataaaaaataaataaaaggaagtgacactggataattaagagacacaccattgcgcctttaacacatattcacacccagcactgtcacatccatcgtgccttgaggacaggcataaatttacggccttcctcctgcgctcccggcctgctcctagcctttgactagagcctgcgcagcatcccagtcccaggctagggcccaccggtgccgcgcagcctcctggaagctgtggggagtagcgttcctccgctccagaactacaactcccagcaggccttgctcctctccacctccctcgcagcgcatggcctgccgggagggggcaggtagccggcgggcccggtccaatgggtgccggcttccgaggagagggcggaggagaggaggaaggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcaggtgagagcagcaggcggcgttcgctcgggccagaccccggccgcaggcctggtcggtgctgcggcagtgcccactcccgcgccagcgcccactcccgcgccagcctttggggcctgtgggaggagggccttgctgggggccccagggctctccgggctctgccgcacccgccctcccggggcagcgttgcatcaaggcggagaatccggggcccggccaggggcggagccggcgcggcgggcctggctagcccggcgggtcccggggacaggagagggaaggatggggccggcgggcggaactggagtccgctgggaccgggcgcggcctcgtccgcgtgccgctgcctccaagggcacctgggggacgcgcggggcactcgggtctcgctgggctcggtgggctggctgttcccatcactgttggctttcgtgagacgggtgttttatttccctccttgccttgcccagggactgcggagttagttttggaatcgctctgttgaggctgagagacgctacggtgcgtgagcgccagtgttttcctgcagtataattccaccaggtttcgagaacgccgaagcagcattttaaaaaaagaaaaacaaaacgtgtatctagagttctgcgggtgttgggaaggaatatccgatttttctgcgtaggctgtgctttttgtcttccacagttttgtgatcgtgacctaaattgggcatcagtttctctggtcttctcatagctaactcatttttttttgaatgcagaaatgttggcaaaataactgttatttctagagtgacagaggagaagtataattttccttttctctgctacttcgattagagttcagagaaacggattttagaaattagtatattgatattaagtgctttcatttcttaatagtatcttttctattgagaaggagcggtttccccatcattttccaggaggtacatagtatagggtataagtgctatcagaaggaacttactgttcaaagtattagtggctatccaaacactggaaactatagacaccctgtactcgtttgtttgtttgtttgtttttttggcttttaaatagttgaagcaatagaaattgttttagaaacacatttccttggtctgcgataggattgggaaagattctgctcaatcttgcctacgtattctagtatttgtaacaatatttgtaatgtttggagactcagaagcatcaaacaaattacgaggattattttttattgaacataattttgttcagtctgggacatatagtaagtgctctgtaaatattttgagtaaatattgctcactctaaccacaatgttttaaaacactgggacttttatcatcaaaactaacctgtttttgtaaaaagttagagataatataaattaagtctttgatagtaagtgattcagaagtgtcttctagctgcacactagaaactttccacatacttttaaaagagagtctcagtgctttttaagcatgaggaagtaaaagaattagggatatagtgtgtcagcataaatagtttaaaatcaataagttgtttttttctttttacacaaaatagagtttattttggtcagtaaacctgttggcaaaatacagagtggcaggagagaaaagtaaagatcccatccttctgaaagccattaacatgtgcaaaaaccatcctagtactgacagttatatgctatatttgcatgttggtgtttgaaatttctcaagaggtcagtttttctacttgatttaatgagggttatttccatctaagttcttattagctgataatcagtcttttactcaagtacagaagaaatacagaatagaaattatccgaggtaggcagatcacttgattccaggagttcaagaccagcctgggcaacgtggggaaactccatctttacgaaaaatacgaaaattagctgggcatggtggtgcgaacctgtagtcccagctactctgcaggctgaggtgggaggatcacctgagcctgggaggttgaggctgtggtgcgtgcaggagtgcatgtcactgcaccccagcagaaagagagagaatagaaactattttctccccacaccgccccccccgcccctattttctccccacaccgcccccccgcccccgccttttttgtagtgtgttggggaaacaagaatctcttcttggtttgaatactagtataccattactttgtgatgtctgccatttttactctttggtgttgtgtaacatatatgtatacctcacatttatatttaatgaagtaattgtagtgagtgagttccagacatataagtgttctgtacttagttctgcctagtatacctatcggcagtaattgtgtcttcagaatacaggtataaattagccaggtgctatggtgtgtagtgtgtgccggtagtcccagctacttgggaagattgcctgagtccaggagtttgaggctgcagtgagctatgattctgcgatggcactccagcctgggcgacagagtgagaccctgattcttccaaaaaaaaattaaaaaacaacttcaagtgtagtctctatcctacatattatccataccttaaatggcttcagtttctatcttgttgaactttttggaacagtgattctcagacttgagtgtgtattaagaatcactttggttttttttttttgagaccgagtttcgctcttgttgcccaggctagagtgcagtgccatgatcttggttcactgcaacctctgcctcccggcttcaagtgattctcctgcctcagcctcccacatagctgggattacaggcatgcaccaccacgcccggctaattttgtatttttagtagagacagagtttctccatgttggtcaggctggtatccaactcccgacctcaggtgatccacccgtctcggcctcccaaagtgctgggattacaggtgtgaaccaccccgcctggcctaagaatcactttgaaactaagtttcctggatcctgtctccagagattttgattttataagcctgggttgggtgagggaccataggtgattctgatacagatggttcctagatcctaatttgaaaaacatattagtgaatcattggattttaaaatgcatgatactggaaaaagcaggaaaattaggggaggttgaatctatggcatactaccatccagtaccatgctgactttggtggcattcttgctttaatatatcacttcccaggcaaccattgctgacccctaaatgttttaaactttggttttatgaaatgcccaagtaacactcatttgggggctagggacttggaggagtggaggtgagggaatcctgtttacagctatcagtcattcacatgttttatgtgttagctaaataaattgcttttattttttctagtagagaccatctgtgtgaaatgaacagacacagtggggagagagagaaggctgatgatacttttagaccatggtgtaactttgcaagtagaggagataagacttaaaacaacttttgtgactcaacttgggaaatttaatcctatttcttaaattaagaattggaaaggggagccctccaggtatgtaatctaaactaccacccaatataggtatccgaatacagatgacattaacctgagactctggcttagtgttcctagtaatgtactttacacttttccttttatttcagtgatttcagcattctatcttcagtaattcagacaaatgtaaaaggaaaaacaatttggattttttatttttatttttttagggtctggctctttcacccaggctggagtgcagtggcataatccatagctcactgtaacctcaaattcctgggctcaagcagtcctcttgcctcagcctcctgagtagctgggactacaggcacgcatctggctaatttttttttttaaatttaaaatcgctgccttactatgttgccaaggctggtctcaaactcctgggctcaaatgatcctcttgccttggcctcccaaagtgctaggagtataggtgtgagccactgcacctagcctaaaaataatttggattttattttattttattatttatttttttagagatggagtcttgctctgttgtccaggctggagtgcagtggtgcgatctcaactcactgcaacctccgcttcccgagttcaagtgattctcctgcctcagcctcctgagtagctgggattacaggtgcatgccaccacgcccagctaatttttgtatttttagtagagatggggtttcactgtgttggtcaggctggtctcgaactcctgacctcatgatccacttgccttggcctcccaaagtgctggaattacagacatgagccactgtgctcggcctaatttttgtatttttagtagagacagcattttacaacgttggccagactggtctcaaactcctgacctcaaatgatctgcctgcctcagcctcctgctgggataacaggtatgagccaccatgcccggccagtaatttggattttaatttctaatttgcaaatcaacttttaaaaatttaacattaaaaatactgaaatattcatgtaacacaaaattcacccttataaagtatacacaactcagcagcgtttagtatgttcacaaagttgtaccaccatagtgtaattccaaaatattttcattacctgaaaaagaaaactcctgcccataagcagtcacccccgttttgtcctcccccagcttctgacaggttttgattttataagccccacgtgggtgagggtccatcggtgactctgatacagatggttcctagatcctaatttgaaaaatatattagtgaatcattggattttaaaatgcatgatactggaaaaagcaggtatcactggcaaccactaatctactttttgtctgtatggatttgcctatttgggatatttcacattagtggaatcctataatatgtgatttgatcttttgtgccaggcatctgttgctcaacataattctttttttttttcttttttgagacagagttttgctctgttgctcaggctggagtgcaatggcacaatctcagctcactgcaacccttcaccttccgggttcaggtgattcttctgcctcagcccggattacaggcgcgtgctaccgcacccagctaatttttttgtatttttagtagagacgaggttttgccatgttggccaggctggtctcgaactcctgacctcaagtgatctgcctgcctcagcttcccaaagtgctgggattataggcatgagccactcaacataatgttttttaggttcatccattatgtagcatggcagaataataaatattacattgtatagatacagcacagtttattcatcaattgatgaatttttgggttgtttctattttttggctattatgaataaataatgctctgcgaacattcgtttacaagtttttgtgtgaatgtgtattttttttttttttttgagatggagtctcgctctgtcacacaggctggaatgcagtggcgtgatcttggctcaccgcaagctccgcctcccgggtttacgccgttctcctgcctcagcctcccgagtagctgggactgcaggtgcccgctaccacgcccagctaattttttgtttttagtagagacagggtttcaccgtgttagccaggatggtctcgatctcctcacctcgtgatccacccgcctcggcctcccaaagtgctgggattacaggcgtgagccaccgcgcccggtcagtgaatgtgtatttttgattctcttgggtatatatctaagcgtagacttgctgattcatatgataattcttacgtttaactttctgaaaaactaccaaagtgttttccatagtggctgcacctttttttttttttttttttgagacagggtctcactttctcgcccagactggagtgctgtggcgctatcttggcttaccgcaacctctgcctcccaggctcaaggcgttctcctgcttcagcatcctgagtagctgggattacaggtgcccgccactactgcccggctactttttgtatttttagtagaggcgagggtttccttatattggtcaggctggtctcgaactcctgacctcaaatgatccacccacctcggcctcccaaagtgctgggattacaggcgtgagctgctgcgcccagccgtggctgcaccatttcacatcccctccagggttcaggtttctgcacatccttatcaacacttgttgttatcttttttttttaagcgctaaatcattctggaattctttatttgaaaaacagcactttttgacacctatgccatttccttctcttatggacaacttttttcatagtttgatgtccctctctcttttttttctccatgagcactgctgtctacattttagcatttattgactataatttaattcctgcttatgcattgttttcttgtgttcttagataaatttatgtttttctctttttttgtatagattatgagctgctgcttttttttaacttaacaaaattgaggtgaaatttgcagaacataaaattagccttttttttttttttttttttttgagatggagttttgctcttgttgcccaggctggagtgcaatggcgcgatctcggctcacagcaacctccacctcccgggttcaagtgattctcctgcctcagcctctcaagtagctgggattacaagcatgtgccatgcctggctaattttgtatttttagtagagacagggtttctccatgttggtcaggctagtctcaaactcatgacctcaggtgatccgtccacctcgacctcccaaagtgctgggattacaggtgtgagccactgtgcccagccaaaattagcccttttataaaatgtataattcagtgtcatttagtgcattcataatgacatctctgtctaggtccaaaacaatttcatcacgaaagaaaactactattgagctgtcactccctcttctttcttttccatttaatggctgagtaatattctgttatatgtataaaccacattggtttattcaatcacctattgatgagcaattgggttgtttctgccttttagctgttgtgaatagtgctgctgtgaatattggtgtacaagtatttgagtacctgttatcagttattttggtatatacctaggagtaaaattactgggttctatggtaattttgtttaactttttgagcaaccacttttccacagcagctacaccattttaaaattcccaccagcaatgtttgaagggtgcagtttttctgtatctttgtcaacatttgttattatctgtttttgattatagtcatcctaatgggtgtgaagttttgttttgcatttccctaatgactaatggtgttgaacatcttttcatgtgtttgttggggttgtcttattgttgaggttgtaagagttcttttttttctttttttttttttttttttgagatggagtctcgctctgttgcccaggtggccaggctggtcttgaactcctgacctcaggtgatccgcctgccttggcctcccaaagtgctggcattataggcatgagccaccacacccggccttgtctttttgcttccttgttagtgtccttcaatacacaaaaggttttacttttggttaaggctaatttatctttttttttccttttattgctttatggtgtcatatctaaggcattgacaaatccaaagccgtgaagatttttttttattttttaatgttttttcccctaattattttatagttttggcttgtatatttaggcttttgatccattttgagtacatcttggtatggtatgaggtaggggttcatttcattttttttgcacgtgcttctccagttgacctagtaccatttgttggagagactgttctttccccattgaatagtcttggcattgttgaaaatcagttgagcaaagattttgttgttgttgttgagacagggtctcactctgtcacccaggctggagtgcaatgatgcagtcttgggtcactacagcctccacctcctgagttcaagcgattcttctgcctcatcctcccaagtagctgagactacagtcacctgccatcacgccgggctattttttttggtatttttttttagtagatacggggttttgccatgttggccaggctggtcttgaactcctgacctcaggtgatccatccacctcggcctcccaaagtgctgggaatacaggcatgagccaccatgcctggccagccaaagatttattatatgggtttatttctggattctcagttctattctgctttgattactgtagctttggagtatatttaaaatttgagaagtgtaactttaccagcattgtttttctttttcaaaattgttttggttgtttggggtcccttgtcattcaatatgaattttattttatattattttattttgagaggtagtcttactctgtcgcccaggctggagtgcagtggcgtgatctcgtttcacttgcagcctctgcctcctgggttcaagcgatccaaccacctcaggctgcaagtagctgagattacaggtgcccaccaccatgcctggctaatatttgtttttttagtagagatggggtttcaccacgttggcaagattgatctcaaactcctaacctcaggtgatctgcccaccttggcctcccaaaatgctgggattacaggcgtgagccactgtgtgggccccgtatgaattttagatttggcttctccatttctgtaaacaagacagttgggattttgatggggattgtgttgcctctataggttgcttcaggttttattggcatcttaaccattttaagttagaatttttgatggggaggttttttcttttagcactttatcttactgcctctggctcctatggtttcttttctcttttctttctttgaaaacaagtttattaaagtaaaggaataaaagaatggctactccataggcagagctgctgtggcccctatggtttctgatgagaagtctgttgtatctgttgttagtcttactgaggatcccttgttcatgactcttagcttctctcttgctgcttttagcatttgtctttgtctttcaacagtttgattataatttatctcaatgtgtgtatttctttgtgtttatcctgctttgagttcatcgagcttcttggatgtgtagattcatatcactttttcatgcttttatggaagaagtggggattttcacagacgataattctgccttatcagatatctgaatctctctcttagtgatctagaaagcactggacctatagttttataaccaagaaaaaattccttcctaaggactgttaggtctgcagtattttagaaagtttggattttgggtattaagttcatataagaacactcttttaagccaagtgtggtggcctgtgcctgtagtcccttttacttgggagacctggtggcaaggctgcttgagcccaggaggttgagggctgtagttcactgtgattgtgctgtgaatagctgctgcactccagcctaagcaacatagtgagacctggtctcttaagaacaaaaaacaccccacatattaactacaaattatgaagtggtttaaacttcatatttatattttgtcattaggtagagggtttgagctatatggtagaaacattgtagtttagctattttattttattttatttttgaggcagagtttcgctctcgttgcccaggctggattgcaatggcgtgatcctggctgactgcaacttctgcctcctgagttcaagtgattctactgtctcagcttcccgagtagctgggattacaggcatgcgccaccacgcctggctaattttgtatttttagtagagacaaggtttctccatgttagtcagtctggtctcaacctcaggtgatctgcccgcctcaccctcccaaagtgctgggattacaggcatgagccactgggcccggcgtagtttagctgttttaaataccataagattaacatttctaaggacactcttagaaatattttatttaaataagtgaagcaaatatataaggaaaccttctgtaaatctaaaattatttcaaaataaaaagtaaaatattgagacatatatgtttactatattaatatcaaaataaagaattgagaggtctgccttacacaatgaaaaattaaaacttagaagttgaataagggatcagctttggttaatgtggtatgaatgaacattattaactcctcaaccccaactgatgctgattattagggaagagctgaaaatacaacaaaaccttttccatgaaaggccacatttcaaaatataaattcaaaacactaaaaatcccaatacagtgcagtttggaagaaactaaaactaaaagatgacactgagaccaggcacacaaatctttagctcctaaatataatacaggttattgaatcagctttgggagtttgtggagaaaaaaatctgaaggccttgtagtgccagtggagcccgattttcagaacaagctagctgtgatttttgccactttagaactcttgtagctactcgactttctgggaagaacccagacatgggatgtttaaatcaccaggtgggggaaaaagcactgatagaaccaattgttgaagaagccagtaccatttatagtagtgaatctagatgagaggtaaaacattgggagcccacagatgtgtttcatttagtctgtgtgtgttgacacatacagtattaaaaataaatgaattagttgccaatgtttaaaaattggtagatttagttgaaaggcccagatttctggttttgccttaaaaaaatcagaaaatctgataacccttaacccatattcccagtggatttgaataatgcctgctttaggtgggtcagttaatatctagttagccacagctcctattgctcccagttgccttccctggttgccagttatcatcatatatgtgctgtctttctttatagtgtaaaataagcaatgaaatatttcctacttctacatctgcatcaaaagtgggaaagttgaagactactgggttataattcatccctgttacttgttacctaattatatctgggcaagttacataatttttctaaaactcagctaactcatatataaagtgagaattaaatagtaaccatctcatagagttgttagacttaaatgaggtaaatcacttggaatggtagtagcaatgtagtatgttcgattaatgttagccattactactgattaaaatggctgtacattttaagaaaaatgagcattttggggcagatgtatagaaatgttcttattttcatgtacaaaatgtcagaatacaatctgatggcattaaaaaaatcactttactgaagtatggttgacattctgatgtcattttgaccaaagtctggattgattttattcattgcatgtgtgcgcagttgagtttgtaacttctgtattagtttgctagggctgccataacaaaatgtcacagactgggtagcttaaaaagcagaagtttattttctcacagttctggaggctagaagtccaagatcaaagtgtcagcaggtttggtttcttttgaggcctttttccttggctcgtagatggctgccttcttgctgtgtccgtggtgtctctgtgtctaaatttcctcttcttgtaagaatgtcagtcagtttggattatgggcccagcaccccagtagccttgttttttttagatggagtctcgctctgtcgccaggctggagtgcagaggcgcgatctcggctcactgtaacctctgcctccctggttcaagcgattctcctgcctcagcctcccaagtagctgggactataggcacgtgccaccacacccagctaatttttgtatttttagtagagacggggttgggttttcaccatgttggccaggatggtctcaatctcttgacctcgtgatccacccgccttggcctcctgaagtgctgggattacaggtatgagccaccgtgcccggctggacttgttttaacttaatcgcctctttaaaggccctgtctgcaaatatagtcacattccgaggtactgggggttagggcttcaacatataaattttgggaagacacaattaagtctgttacaacctgtcctaaaaaggcagatcaaaaacatatgttacggaatttattagagataagagattgaaggtgagtgctaagagagccaaaagcctgatcatagatgattgattaagagcacttggagcagatgaggagagaaacgataatcctaacagataaaagacaaaagttccccagagctgaagtacgacatcttcaggtctcaattgctgcacataaatattgagagaagagacataccctggttaaatttctgaaattaaaagaatactacaagcttctaaattgaaataggagggaggaaaaaaaaaagctttcttaaacgggaaagagaatcagactggcattagattccaatctgtcacagtaaatgttactgcatggagaaatgtttaatagagttcttagggaaattgtgattataaaattctgtattcattcatactataaccattttctctttttttctttttgggtggtgatatatattttaattatttaaaattttgctcattccattctatagaataagatttacatttaagcaaaattaattaaaatctaagcagagagatcaagttaagcacaggctccaggaagtcctgctgggatctcaggaatagcgacaacatgttaaaagttttagtttgaatgtctggaatttgtttgtttgtttgtttgttttggtgcattctagagtctccaagagtcagtcaccatgagtacccgtgaggtagatgatacttattttaacagcacctaaactggggtttaggagctatattttccaagaagtgactcagtctaattctgaaatgacaaaagcagttcatatcattttattcacacttgaactccactggagtcagggatgaaatgtcatcttctattccaagaatgaagtcttcagataatgtccaggtgcttcagaactaactagtcatcataagaacacagagtccataatttctccaatgtatagttttttgtggtttctagaagcatcaaatgaatcacagtgctaccaaactccacacagaactagtcacagtgtccttcctatccatcttaacattaggctcatttttacatttcaggtatttgtacattttcatagtataatagggatatatcaggtggaagttccactcactatcagtcacaaagtagctgtaatctgtatatatgtttttacacagtcatgtgaaatttatttatatacacacatataatcccagtttgttcacttatactgctatataatggtccattataggaatatatcctgttgaaatttgtgtgttccccagtgtttgctatagctgtttttgtaaacagtggtactgcggatattcatataaatgtctcatgtttgagaatttctctaacgaatcaaggagtggaattgccagactgtagggtatatttattggatattgctattgcttctcaggatggctgtaatttacattcccatcaacagagtgaagtttatttatatctgtactttctatagtcacattttaaatttatggtacctcattgtggtttctattgcatcctcctgattactagtgagtgtgagcatcttatcatgtttcttggctctttgaggttttgttttgtgagtttttgttgatatctctgcacattattttgttaggtatttttaagaatttgatttgtgggagttatttatacattttggttaccagttacttatggatcacaaatgttttccctgaattttttctgtgaggaaaagaagttttaattttattgtggttgaattatcttttcttctgtggttttgtacattttgtatattgtttaagaagtcattctcctttattttgttttttaacagctttactgagatacactctataccataacatacccatttacaatgtgtaattcagtgttttttttagcatatttatagagtcgcacaaccatcaccttaaacttttcttttttcttttctttttaagacagggtctcactctcttgcccaggctggagtgcagtggcatgaccatggctcactgcagcctcaatcccctgggctcaagtgatccatctgtctaagcctcccgagcagctggtactacaggcatgtgcaaccttgcctggctaatttttttattttttgtaaagatgaggtttcaccatgttgcccaggatggtcttgaactccttggcctcaagtgatctgcctaccttggcctcccacattgctggggttacaggcatgtgccacctcgcctggcctttccatcacctttaaactaattttagaatataccatcattctagaaagaaacctggtatccattagtagtcactccccattcttcttcactctgtccctaaacagccacataatctactttctagctatagatttgcctattttggacatttctctttttttgagatggagtctcgccctgttgcccaggctggagtgcagtggcacagtcttggctcactacaacctccgcctcctgggttcaagcagttctgctgcctcagcctatcctgagtagctgggactacaggtgcgtgccaccttgcccgtgtaatttttgtatttttagttgagatggggtttcaccatgttggccaggttggtctcgaactcctgaccttgtgatccgcctgccttggcctcccaaagtgctgggattacaggcgtgagccaccgcgcccggccatattttggacatttcatataaacagggtcaaataatatgtggtcttttgtgactgactaactttaacttagcagaataatgtttttagattcatccatgttggagcgtgcatcggtaccttattcctttttatgactgaagtataaaataacttttataagactaaacattagtcttgatacctctagtggattaaatatccatattagggatcctgggaagatgacagcagtggtagaatagtttcctaaatatctatatgactttcccctaaaacagaacaaataggataggaaaaccaaaaacacatagaaaatgtgtacaagaaaattagttgactatgtttctctacaaacgctcaaataccagcagattgggaacaaaccattgttatccatactggaagaagcagaaggaagcagtggaacttctgatggagcggagaattgtaaataacccaaaggcaatcactggaaagctttttaaagggccgattttagaataccagctgaaatgggaatttgggaagggtattgcacacatcgataatgggtgagtgaaagggatcagttgtaaagtctgaagggactagcgctccttcatgaaactttaaaaactaaccaaagctcccttccaggcccactcctcacaagaagaaggaaccgaggatacaattgagtatcctctgaagaatacagaccaaggaaagagaaggtccagataaaagcaggggaggtaaacagggccaagatacctcagaaagcaagaaactatatttttgaatactatatgaaaacaacaagagggatttttagagtataaaggcagagtagctattcagagccaagcctctttcaaaagtcaacagtatgaaatgattgttgtcaaatgtcatgcaaatttttgaagaaaaacaagaccccttagacaaggaaatgaaagcacaccagaaagacatacttagaaaacaaacaaaaactgtgagatattaagacaaaaggcaagacagaagacactacaatgataagacatttcaaaaattaatttgcataagaaaaattaaaaaattaagtgatagtgaagtattataaataaaagaaaatggctggacatggtggctcacacctgtaatcccagcactttaggaggctgaggcaggaggattcgcttgagtccaggaatttgagaccagcctgggcaacatggggaaaccctgtctctacaaaaaatagaaaaattagctggatgtgatggtgtatgcgtgtagtcccagctactcgggagggtgaggtgggaggatcacctgagcctgggaaggttgaggctgcagtggactgtgctggtgccaccgcacaccagcctgggcaacagagtgagaccttgtcttggataaattaagtgaatgaatgaatgaaatgaaacaaaatttattttagaaatgaagacaaattagaaggaacacaagagcaagtaaacgtaacagataataccttatgagggaaagaagctgaaaaggagaaagacattaaaaataaagagatgtaaaaagaattttgtagaaattgacacgttggaaacaagtaaagaaaatccaacatatgtatattaggtgtccccaaagaagaaaactatagcaagggaacagaatgggtactaaaaattacaatacaagacaattttaatgaaataaaagtagatggggaactaaattttggaagagtacagcacatacctaagaaagtgacacggtagaccaatactgagacatagtctagaaaaattattggactttaaaggaaaaataaaaatcctcagacatacaggcagaagtcacaaagtctcttacctttataagtaaaggaaaatcagggccaggtgtggtagctcatacctgtagtcccaacacttttgggaggccaaggtgggggtatcgcttgagcccaggagtttgagaccagcctgggcaatatagtgagaccctgtctacacacacacacaaacacacacacacacacacacacacacacacacaatatagtgagaccctgtctacacacgcatgcatgcacacgctgggtgtggtggtgtgagcttgtagtccaagttacttggaaggctgagaggagaatctattgagcccaggaattggaggctgcagtgagctgtgattgcaccactgcactccagcctgggcaacagagctagacagtgtctctaaaaaaaaaaaagaaaaataatcagattactgtcttttttttttaaagacaggtttgttattgttgtccaatggcgtgcaatggcgtgatctcggctcactgcaacctccgcctcccgggttcaagtgattatcctacctcagcctcctgggtagctggggattgcaggcatctgccaccacgcccggnnnnnnnnnnnnnnnnnnnntgatctgcccacctcggcctcccaaagtgctgggattacaggcgtgagccaccacaaccgggctggtgtacactttcttatcttaaatatggaatttcattgtctcctttctcctatgacagtagggaggccaaggtgggcggatcactttgaggtcaggagtttgagaccagcctggccaacacggtgaaaccccgtctctactaaaaatacaaaaattagccaggtgtggtggcatgtacctgtaatcccagctacttgggaggctgaggcaagagagtcgcttgaaccagtgagatggaggctgcagtgagccacgattatgccattgcactccagcctaggtgatagagcgagactctctaaaaaaatataaaaaataaaagtcacaaacaatatgctagaatttgaagaatatttttcccattagcccttcctggggaatctactagagaatgggtgtcagaatcagaatgactagagacacattaaagactggtgatttgtattacacgtaactaagaccaaatgagggtttgaaagaagatatgatctgtaaaggggtgggaaggagaatggagggattatatgcaaaacatttaaaaaactactttcagtaataatgttcgtggtggtagtattggtgttattattttgagaatctgtgtgtaacatgaaataaaaagcaaacaagtaattgtgttattctaattctgtcacaaactgtcattgagaaccacagctcttggtgtggaagaaagaagatagagatgactgattagaggaatgtatgtttatgttaggggtgggtgagggttgcaagtgttggtagctgaaatagagaaaaaagctaatgtttcaactcaaggagcttttttaaagaacagataaaccctcctttcaccaggagaaaaaaaaatcccaggaagaagaaattagcaatattaaaaaaaatcaattacaaagcaaaatcagcaaaatatttggccaataaaatcaatttaatagtcatttggaaagtctcataaaaaaagaacgtaaaatattagaaataagaaaaatgaacattctaagaatattatgagtagttatgcctataaatttgaaaatcagagaatttgattttttttttttatggacacattttgtcagacatataaagaactggaaatgtctatatgttgttaaaattatttcagagtacagtatcagagtacaggaatgaaatgatggaaagcaccctgttttacttaatgagaggggctaccctggatatcacaactgcagtttcgcagacatgtcttatattcctcaatttaactctccagatccattcagcatttgtgttttccatcataggggacctttctggacaacatgaatgagcccctatgtcgtctgtcttctgatttggatgtggaaatgaggagccctggcagggaattggaggaaagaggagaaaaaaagtcccggtcttgattcccccatctcatacattctgtatgtaggagccttgggctggctggctgtgtcactcttagtcctcctggtccttccttttaggcttcggggtgatgagagctgttctcttgttactagcctgggttactgcattatcccttgtgatttcctataagcctcacccacagctttgtaaatagtccttatgtaaataaaccctctttaaattaatctaatttgagtgggccatctgcttcctgcagaccctgtctgacataactgatgaaattaggacttttgcatttgtagaaaataaatttttaaagtacaagttttgactaagaaaaaaatagagtacagaatatactgtatagaaaaataagtttattgcaaacttaagaaaaatggcaaatttagaaatttttaaaatgtataatagaggtttatatagtacttgattatttatcgcattagctgttagtattgatatttttgattatttagtaattggatattggtattgtatgtatgttaaatttcctgaatgtaagtggtgtggtggctggctcctggaatcctagctactcgggaggcagaggtggcctgagggtctcttgaggccagaagttagaggctgcagtgagctatgatcacgccattgcactccagcctgaatggtagaatgagaccccatctcttaaaaaaaaaaaaaatcctgaatgtgatcattgtattgtggttctatagaagaacggccttgttcttaggagatgcatgccacaatgtttagagtggagtatcatgatttctgtaactaactctcaaatgggacagcaaaaggaaaaaagtctttgtgtgtacatgtaaggagagagagacataaagtaaatgtgtcaaaatgttaataagtggtgaattatgttaagatatatgagtattcactgttaccgttcttgcaactttttttgtggcattgaaaatttcaaaataaaaagttggaaaatatttaaaacaacaaaaattgaaatacttattatggataaagaactttattataaactaataagaaatatataaaaggctagcatttgaataagcagatcactaaaggagaaatacagaaagccattaaagaaaaggatgcttgaccttaataataaaggaatgtaaatttaaatgagctgtcggtatccatctatcaaagtagcaaagattcaaaaaacaatgctttgggaggctgaggcgggcggatcacttgaggtcaggagtttgaaaccagcctggcccacatggtgaaaccctgtctctactaaaaatacaaaaccgctgggcgtggtgtcacacgcctgtaatctcagctacttgggaggctgaggcaggagaactgcttgaacctgggaggtagaggttgcagagagccaagatggtgccactgcactccagcagcctgggcgacagagcaagactccatctcaaaaaaaaaaaaaaaaaaaaaaaagcaatgatgtttaatactgatggagctgtagcaaattgaacaaactggtaactcttggaagtatagcttgattccctcttctttgcagtctggcagtatctatgaatgcttaaaatctgtatgctcattaataacggcaatttaacttaaatgaactaaatctagtgaggtaataagataagtgagtaaggttatatgtataagcacattcattgcagcattgttaaaaacagcaaaaaccaaaaaccatctaaatgcttatcagttcgggtttggttttatacatagtagaatactgttttagctatttcttttttttgagaaggagtcttgctctatgcccaggctggagtgtagtggtgtgacctcggcttactgcaacctccacctcccgggttcaagcaattctcctgcctcagcctcctgagtagctgggattacaggcgcgtgccaccacacccagctaatttttgtatttttagtagagacagggttttgccatgttggccaggctggtctcgaactcctgacctcagatgatctgcccgcctcagcctcccaaagtgctgggattaacacagaagtagttaatgtattgatatggaacaatatccctgattattacattaaaaataaaagcaggttaggccaggagcagtggttcatgcctgtaatcccagcacttgggagactgaggtgggaggattgcttgagcccaggagtttgagacaagcctaggcaacatggcaaagccccacctttacaaaatacaaaaattagccaggtatagtagcgcgtgcctgtagtctcagctactgggaaggctgatgtgggaggatcaccggatcctggggaggtcaaggctgcaataagctgtgatcacaccactgcactctagcctgggtaatagagtgacacactgtaataataataataaaaatagaaggttagagaaaaagatatgcattactgtcccatttacagtaaaacaactacatattataggcatgattttatatataccaatattgtgtaggttttgaaacctggttggtggagtatcaaaacaggtgggataattatgggaaaacagggctgttattttctggttttggcttaaaaacaaatagatcatgtaataggaaataaaattatctttcatttaaaaagtctgtggccgggcatggtggcttacacctgtaatcccagcactgggaggctgaggcaggtggatcacctgaggtcgggagttcgagaccagcctaatcaacatggagaaaccccgtctctactaaaaatacaaaaaattagccaggcgtggtggcacacgcctgtaatcccagctacttgggaggttgaggcaggagaatcgcttgaacccgggaggcggaggttgcggtgagccgagatcgtgccattgcactccagcctagccaacaagagcgaaactccgtctcaaaaaaaaaaaaaaatagtctctgcactaatttttcctttaaaataattctgtatgctggtttgttaatatagtttattgaattaacaaaaaatgtgttaagaaactcattttgctcttgtatatattctgttttcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggtaaatttcagatttgagataattattttacagctcttcatttttgatctattcttaaaaagatatgaattgattagataattagaaattagtgactgtagcataattagaagtcctgtgagaagtagtatgcatctttcttaatgtaaaaaaaagagtagtttttgttttgttttgtttttgagacggaggtcttactctgtcgcccaggctggagtgcagtggtatgatcttggctcactgcaacctccacctactgggttcaagcaattctcctgcctcagcctcccaagtagctgggattacaggcacccactaccatgcccagctaatttttgtatttttggtagagacgggatttcgccatgttggccagggtggtcttgaactcctgaccttaggtgatctgcccgcctcggcctcccagagtgctgggattataggtgtgagccactgcgcctggccacactccactctttctagcagacactcttgcccttgcatctgcaggaacagaagtgtgtcccggccagtggagaactctccccggagctccaggagtgggcaccttactcgcctgggcattccagccggcacagcaaccccccgctataccctagcaggccgtctgtgggtgagtcagccagccaggggctggggctgagggtcggtgtaaactcgggatgcctagtctccagggagaggggaggcagcatttcagagagctgccatgtgttttcagccctgaggtccagagaactgggaaatgctgtcctgtctgggatggtttgtcttatagccatgacatgtcttagcttgtcaacatgctttctccccatagcaacctgggaaataggaagcatgaaagagacttcccccctttttacaaatggagacaggccaggagccacagccacattgtgaattggtggttaaaactcatctcccaagtccttttcccaaaagactgcgggctgcgtcctgggatacaggggnnnnnnnnnnnnnnnnnnnngagctgagatcacgccactgcactccagcctaggcgacagagtgagactccgtctcaaaaaaaaaaaaaaaaaaaaagaagaaaataggcattgtcctttataaccgttcttttttgattaaattgaaaatatattagggaatgctgtgtctatcagcagattttaagttgcttaccaaatatgtatcctatgttaattatacttatattaatgaggtttgaaatgttgaatgagagtaacgtatttaatcttcctatttggttcagtatttggctcagactttcttatttatagaactctgtaacatagctctaattattaaattacttttgcagcagagtaccatatctgtttcttatctgcagagatctgttttcaatgcagttttattctacttcttattctgatttaagatgggatgatagttttgacaaaattgaacttattttaatttctgtgtctgattttttcatttactgtaggagctgttggtggtgatgacttgaattttttttttaatggggaaaaaaaacctcatgagcatctgctatgactctagaatgttagtcactgaagcaaattagtgtagttgtagatgttgcaagtaatatttttagatagactgccagtggctatgtgggagccttttaattacattaggtagcttctgggtatgttattcatcactttgcatttctctaatacttattgaagttctgaaccttgaatttaatcatgttggattaatctggggttcaccttcaaatatatagaataacacttataaaatttcatccccactgatttcatcaaatttaccaaacatctgaaactaagaccttaagacactatatgatattaggtctttctctctctctcttttttttttttttaactttccattttcttctgtcaccttgagagggcccatgatatcctgtctctcagaaactatttgaattgtgggcagtgtttccttagataaaattgtgcttgttagaaaagggtgtacatttcagctatcgtagtgtcagctctttggtatctctttgtttttatgtccactatgttttgttgatgtctcctcttagtggttggtcagtaaatctgcctacctactgtttttttccaagcttagtgctgattttgtatatatatttgcttaaaatgacaactcaactaccccaaacacaatatagattatataaatttgagtactagatttcacgtgttttattctagcatagacagttcgttagtttttcatcaaagcttctttatccttagaataaacaattctagcatatcataaatcattctaacccagagaaaattagaaaccatgaagcagataaacaatatagttagctagaagagtgtgaactacctgacagcctgataataagagaggagaaagggaagaaacataaactttcaaaaaaaaaaaaaaaaaagaaatcagttactaacattttgtgtagggattttatttagccagtgaaggcttagttacatgacaaagacctaggttaccaatagtagattcagagtagtacattctaagatgacatggagaagtataatccatcttagatgtagcttcatcaaaactggctaaagtaaaatattttagtgtttaatatgtataattcaatcatcaggacatttatttagcataggattcttcattctgtcaactgtgggataactgaggtgtcagtatgtagatttatggtcatctcagcttgccccctacttctgcccatgtaaaagaattttctgttaaatttttattaaaaacaatactaaactatgttttagagtagagtggtggttcagtttgaacagaactccacggttatctttcatatatttgtaagaaataaatcaagctttcctcagctttcctttgagacaaaatccaaaagtagcatgctgattaaaggccaaaattgtgctatatatgatacttctgaacagtgtcagtagaaatttgaaaaaaaatgtgaaaaaaaaatttattttggggagaaaagttgttgaactaaagcaaaagttttttgttttctttttaaaaaatgcaaacataggccgggcgcggtggctcacgcctgtaatcctagcactttgggaggccgaggcgggtggatcacctgaggtcaggagttcgagaccagcctggccaacatggtgaaaccccatctctactaaaaatacaaaaataagctaggtgtggtggcgggtgcctgtaatcccagctaatcgggaggctgaggcaggagaatcgcttgaacccgggaggcggaggttgtagtgagccgagatcgagccattgcactccagcctgggcaacagagcaagactccgtcttaaaaaaaaaaaaaaaatgcaaacatacatgtttcgtagaataatgcttaaaatcttggtataatttgaaattttacccccatttcattaagtaacctatttgtaaaagcaatcagttgccccccaaaaagcagtaaaattacacattagaattaaaggaaaaagataggattaatttttctgcatagggtgctgtgatacacgtagtagtctccctttggactgagtccacgaaggtcaagagttaactttctgcagtgttctattaaatccaatgtatgtttcaaataaaatacccttatatagtccagtcttagctaatggggcaaatacttgcatatacttaccaacttttaaggttttgaaagatgtatttagtatattttgtagatttttaaaaatcaggcaatttatcttttcctgtagtaggttatcagatatctcaggcaaagtttttttttttttttttttttttaaggcagagtcttgctctgttgcccaggctggtgtgcagtggcacaatgatctcagctcactgaaacctcctgggttcaagcaattctcctgcctcagcctcctgagtagctgggattacaggcgtgtgccactacgcccagctaatttttgtatttttagtagagacggggttttgccatgttggccaggctggtcttgaactcctgacctcaggtgatccgtctgcctcggcttctcaaagtgctgagattagaagtgtgagccccacacttggcccaaatttttgaatagtgaattaattgtgcttcatttgtgtcagaattagaaataatggtcacataacttttttattaattttaaaaatttaatttttattttttagactagtcaagtgcagtagtaaggcgggaaagagtagaacaaggagttccatctgtaactgactgaacagtcaattgagataactaccttcagacaagccagatataactaattatattggaaaggttgtttcctaaaaatgttaaaaataagttatggcaagcaatatgctttgtttctatgacttaaaaatattatatacatccctctaattctagttgtattttgcactgcgcagtgggattcttaatttttcttcttagccactaactttactttcgtcagtaaattttgaataattgaatgctatgtgcatttgaaatgtgatcaggtttctgcacatttgaatttttaataaggtttaaaattttagggataagcactaaacttattctgtgctgtttctctttaactacagaccctgctacatggaaaaactcaagacacctttctaaaggtttcctttatccatttgcttttgaccctttttttctcttatgcctgcatgtgtgcttatgtactattacaggctgtgtgtatttttttttcttccatttttatttgcccatccacattgattgcaggttttagtggttcttgttattttttttggcattgcatcaaaatgcaagcttttttggtggtgaatgtaatttattttatttttatttttgaagacatgcttgtgaagccaagcctttttaaatataataagataaattagaaacagctctttggtatgtagtacttgcattttgtgagttctgttcacctagattactccagtcctccaatgagacttcttggaagaaggtactaagctacaagtaggtgagcattttatctgcaaaaaggatccggttttatttacctttattccaccaaaggaccgactcactcttctgtttgtctgaatatcttatgatcatttttatttagacctcaggaggctgatatgcattattcaatacacttattaagatattttaaccttctctaaatttgacaaaagcaaaacagctgtgtttggaggagataaagttagattatctttccacaattaaacagttctagtttttctgggaaaaacagactatatcttgctctccaagttttagactacttcacacagtgcaacagtgaatctattttccttctttcagcaagtacaagaggaacagacctatgactggaaactaatggagagtggcaactccttacgctgcatataccagggttcttgtttttccttttcttccattttatttctttcctgcctccagttccaagggaaaacagtcttgaccctgggggaaaatcaccttgaaagtgtgtgtaaattacaaagcagctagctctataataatgagagagctctttaaaggaacagcaagttgtggctctacaggtaaccaacaggaaaccaaatttttaaaaagaactgaagaattagctgtttcattgacacattgtaaaatttttccttgagtcatatgtgtacatctgttacatatgttttttgcactactcagtgggattcttaatttttcttcttagctactaactttattttcgtcagaaaactgcttttatatgtaagattttcaaaactaaagaatattccttttactgtaatataactacacaaaaaaatatgaagagaaataaacaattttatttgcaaaatctagatttcaactagtgggaagacctgtgagcagctctgcctgaagttggtcatgtttttgaaatacaccatacaatttttaaaatataatttagcagaaaatacaattttagaaaaatataatttagcagaccttaaaatacttgttaacttgtacttaatggcaaaattaaatacaagttaagaagtgttttattatgttgcctttttgaattcctaaagataaaaagtagtttccatagtttccaataaatgagtttttcttttttccaggggtggaagcagaagaatggggtaaatttcttcacaccaaaaataaggtaatcacacatgcatataatgaagaaataatgttgaaaaaaatatattgtatgaatacttgataatttagtttctaatcattggcaattacgttattttaaagtaactataactattccttataaaataaatcttagtaacatttctaaccacaattgtttattggaaaacacttgaaattgaggccgattttctctgtgatttggtgattcttaattgttgtgggatcaggaagctttgaaaagttcgtaatggccaggcatagtggctaatgcaagtaatcccagtacttagggaggctaaagtgggtgggtcacttgagcccaggagttcgagtccagcctaggcaatatagggggaccctgtctctataaaaactaaaaaaaattagccccgcgtggtggcatgcacctgtagtcctagctacttggaaggctgagtcgggaggatggcttgaggatgtgaggttgaggctgcagtgagccgtgattgtgccactgtactccagtctgggtgacagagtcagaccctctctcaaagaaaaaaaaaaagccaaacagaaaaaaactcataaaaaaactataaatccttagctcagaaaatatgtatacattagaattttatttattttctgaagcaaatacatagacatccttgaagtatatggactccccctccagcttaagaacttttgatcttattttgaatattatgcttttttatttcaaaaatttttagctttacacggattttgatgaaattcgacaagaaattgaaaatgaaacagaaagaatttcaggaaataataaggtaggcatctttttagagctagaaggcataagcatcagtaaatatataattgaggtattctgtacataatatgtgaagggcattgtaaattcctactcttgatcttagccaaaaggccgagaagcgatggacattgtaaattcataatggactttgaaacaaatggagtattttcacagatatatagaactttgcttaaaatcccttttctttcttaaagctttcatataaatcaaatattttatttagatgtttattgttgttcctgtcatgtacatgccacattattatataattctacttagtattgctacaataagttatctttttctgatggattgattgtactctaactcaggaagcattgtttcacttatatatatatcttttgaggagttcttttcttacctgtgtatggctagatttgcttatgaaagcaaaaagagacaaattgggaatttttttttcttttttttagtgaaaatgaaaataatacattagcaactggttttcttattttctgagattgtgagaatgtgaagtaagttatgtatctaagatactgttaatcttgacactaggtactatcactgccttgcctgaatcctgctgtcttctgtcttctttattcctattatttttctctttatatttcaagagatatatattatctcttgagatttttatttcccttcctttttgttcttagctccattcttatattatccagaggcacatttaatcccacaagtgggccctagcctagtactaatattcaacaaatattgaatccttgtatctgccagttactatgctaaaagattatttcctgacagaaaggcatttttagagtcatgttaacctttatgactgttcaggatatttgttgctgttacagtgactgactgagctttgttcattgttgaactctaggctggttacctttgagctactgctactgttgccatactttcctgaatttctagtaaccatgttgtatagaacgggttgaaaaagtggccagaaactagattagcttatcgtcattcctctaattatatcagggatatttttggcttttggaatgttattgatcataacatcagtctgaattctctctcctacagtccccatttacttactgaactcagcaattggtggtaattttacacagtaccagaatttagagtgttgtgatgattcagaaatgtttttagttacactaaactgaatgtcattgaagattgagtctatacctacaagatgtttaatttatgttgaggatataatttacttacctagcagcttttcatccacagtgtctaaaagatgaaaagtcccccaaccccaaatctatgaaacatctcttctttcccaaatcacgtatgtaatgaagtaaatgatattttgatcttatataatttttatgtcaaaatatgtaaatgactgcatatgcctaacatatagccctgaaggatttaaaatgtctgtgagtttggagttgcaaaggtactgggcagagctttgtattggactgataggggaatgccatggcaataaagatcctgagaaatatacaacctaagtaggtatgccagatagtgacatttgttggctttggaacactggagtatttataatggaaaaatagcacagagtaatctaaaatagcaaatataattgtatagggaatgtggagtaaaggatattaaaaacttgctgggaaattagaattttcagtgggctaatgagggaaaacataaggtagttaaacaggtgatgagaggatatattaaaggctaaagaagggcatgtacaaagacagggtataaacatctcataagtgtctttttacatgtagttgattcaatcctaatacttgtagagggccagtggtgaagaggagggagcctacgcagtattcttagtctgcaggagagaaaatacacgttacctctcactatccaaattcttactagagattaaagagttagataaacttcttgagaaatctcttactgtacacattcttgccacttgatattcaaagatcaggaaccaggctgatttggacaacttgttatctacgccttactctctgaactcggaacctcataaatttggatagtgaggaatacattattcttttattcagcactaaatctattaaacatatttaaggaatggcatatgccagcctgggcaacattgtaatacccggtctctacaaaatataaacaagaaattatctggacatggtggtgcacaccttgtagtcccagctactcaggaggctaaggcaagagattgcttgagcccaggattttgaggctgcagtgagccatgattgcaccactgcactccagcctgtgtgacagagtgagaccttgtctcaaaaaaaaaaaaaaaagaaagcaaaggaaaaatttatgtttataatcaagagaaaagaatgtaaaataatacatggtatataatacatgtacatataacatgatacagggatagaagtaggattataacctgttaatatggctggctacctgacttcccatgtgtttcatcaggttttgattgttaaaaaaaagttttaggaatcatgatttaattcatttttaaaagcattaatgtctatgtacttgaaatgaagtttattacttcatagttcattgaaattttaatatattttaaaatttatttttagggagtaagccctgaaccaattcatcttaagattttttcacccaacgttgtcaatttgacacttgtggatttgccaggaatgaccaaggtaaggaaggaatagttgtagatttggtcaggttgttttcacttcgttgacatcccatatgagaataatcagcttctttttgcaatcactttgatctgttagcagcatttgataacgttgagccctcctttctccttgaaacactttctttacttggcttccaggataccacactctacaggtttatctccagtctcactggccactccttttcagtctcttttgctgtttcttctcatctccccaatgtctaaacagtaagtgccccagagctcagtttatggaactctcgttttctctaggtacactttccctttgatgatttcatcagattttatggctttaactacgtaaggctctgtatattgacggcattcaaatatctccagacttgtatatctagttgctattcgacatatacacttaaatgtctaatagacatttcaaactctaataccgaattcctgacctgttcctcaactagatttggtatttctatagtcttcccccatcgcaataaatggcaactcatgccatttattggcaactcataaaaaagctgagttgatttttaattgttagttccttggccatctctgtttggtgcagtggcttatcctgtaatcccagcactttgggagatcaaggtgggaggaattctttgagaccaggagtttgagaccagcctgggcaacatagggagaccacgtctctacaaaaaatacaaaaattagtcgggcatggtggtgcacacatgtagtcccagctgaggcaagaggattgcttgagcctaggaatttgaggctacggtgagctatgattgcatcactgcactccaacctggccaacagagtgagaccctgtctctaaataaataaataaatggcaactccattctaccaattgcttagccagagtttgtagtcatccttgacactaatttatcccacattccacttcctgccagcaaatcctcttggctcttcctacctttacagtatatccagaactcaatcgtgttttataaattcatatttactgtcctgatctagccactatcatgctacctggattactgcacaataatcaataataggtcgtccttgtgatctcatcttagtagacagtgatacgattaaagtgaaaattcgattgtgtcatttcttggctcaaaacttctccagttccttgtcattccttgacttaaaacctctcccatttcactaaaagcccaagttattacagaggtctaaaatatctacttgttacgtccctattcttctcctaactcctgttgcttcagcctcctgcccttattgttcactctctttggaatttcttcccccagatgtctgtatgttattgctcccttattggcttaatttctgctcattctcttaagtgtcagttgtctcagtgaagtttccctgattactctatttaaaaacataatccaatttaaaacattaaaatcataatcctaatggccaggtgcagagtggcttatgcttgtagttctagcactttgggaggctgaggcaggaggatcatttgagcccaggagtttgaagatacagtgagctatgatcgcaccactgcactccagcctatgtgatagagtgagaccctgtctcaaaaaaaaaaaaaaaaaaaaaaaaaaaaagaaaaaaatcatctctaatcattccctagcctgctgttctgccttattttcccacagcccttaccaccatctgtatactatatatatgtttttgtttattatatgcgtgttattactaaaacataagttctacgaaggcagaaagtttggtctttttaaaattcactactgtaacataatctgacatgacctgaaatcacgttcagaaaagtgcctaaaatagagtaggctgccagtaaacacttggtaattgaatgaatgagtgaatgaatttgtatctagccaatcaacattgaccagttcttaacatgggactgtattaaatcaacttttgatatttgcaagagttacactttgagacttgacacattaccagattcataaataccattgtagtatattagtaatgtctttatttttattttaactatttttaaatggatatacctatattctatcgattaaatgtgggtaaaaaagctgagttgatttttaattattagttccttgctcatctctgtttggtttaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtaaggacagatgttaatttaatgagatgcttattttacaatggtaaatctacccttgagaaaggaatttttctctttaaaaacagtatctctggttttgaatacaaatttaaaagataatgctttcctatttttgtttataaaaatagaaattctgatggaaaataaggttattaagttgctatacagactaggcgaaaatattttacaactttatttgtaatggttacctaataatttaaaaataatacggtggctttgcaaaaaggatttcttgttttgtgacctaggtatttgaatagttgacttttaagaataaataacatagccaggtgtggtcacatgtgcctgccgtcccagctactcagaaggctgagatgggagcattgcgtgaggccaggagttcaaagtcagcccgggcaacatagactctgtctgttaaaaaaaaccaaaacacagtaggtaatcattgtagattattatggtacagtagagaattatggtatctacattctgcagaggtagataatatttagacatgctcaaggcacaggggatttttagaaatgaaggtaaaatcctttcatgaagcattttagccccaaggattagttcatactgtgggtcactgatgcttgactaatgatgtagtgcacatctcatagtatatataaaatgctagcttgtaagagagtggttactattgttgctaacaaatgtatgcatggcctcatatagaaaccatttttttcaccttactattcagagggtctgaaggttgtgtcatgtttttctttccctgctttgaagaataatttcaaataaaaatttgataggaaatagtgctaagactgccaatctgccaataaaaattcccataagcagggtcactttaacaattttttttttttttttttttgagatggagtcttgctctatctcccaggctggagtgcagtggcgcgatctcggttcactgcaagctctgcctcccgggttcacgccattctcctgcctcagcctcctgagtagctgggactacaggcgcctgccaccacgcctggctaattttttgtatttttagtagagacggggtttcaccgtgttagccaggatggtctcgatctcctgacctcgtgatccgcccgcctcggcctcccagagtgctgggattacaggtgtgagccaccgtgcttggccccaatattttatatttcaagtttttaagaaactcttttttaccacttgagtaaataatgttcatttcagttaaattaaaagataaactatatcaaagagtttatttacattttatttttattatttaaagtagactgggctcagtggctcatgcccgtaataccaagcactttgggaggccaaggtgggtggatcacttgagctcaggagttcgagaccagcctgggcagcaaagtgagagccccatctctattaaaaaaaaaaaaccacaaaaaacaattagctgggtatggtggcactgggctgtggtcctagctacttgggatgctgaggtgggaggatggcttgagcccgggaggcagaggttgcagtgagccgagatcatgccattgcactcttgcctgggctcagagccagaccttcgtaaaaaacaaacaaaaacctgttaagcattttatatgtataaactctattttaaactgacccttgagccatagatattgtcatatttttaatctaatcttttttttttttttttggatgtagggtctcactctgttgcccaggcctggagtgcagtggcacaatcatgcctcactgcaaacttgcagtcctgggctcaagtgatcttcccacctcagtctcccaaagtgttgggattgcaagagtgagccactgcacctggtttgattactaatcataatctagtaatacatcataaggaaataatccagcccagtattatttatagtataaaaaattagaaacaacttaatatggccagcagttggaaagattaagtaaattataataataaaatatgaaataattaaaaaggatgattttgtagatttgtagcagtacagaaaaatgcttgtaggctgggcatggtggctcacacttgtaatcccagcactttgggaggctgaggtgagcggatcgcttgagaccagaagttccagagcagcctgaccaacatggtgaaaccccatctctctaaaaatacaaaaattagccaggcatggtggtgcatgcctgtagtcccagctactggggaggctgagacatgagaatcacttgaactgtggaggcgaaggttacaatgagccgagattgtgccactgcatttcagcctggacaacagagtaggacagtctcaaaaaaaaagaaaaatgcttgtaactgaaaaataccataggtaaaattgtacactatgcagagcagttggaactctcacacgttgctggtgggagtggtgtagtcattttgggaaacagtctggcagtttcttataaagttaaattagcagtcccgttcctaggtgtttaaccatgttaagtgagaaccagtgttcatataaaaaactatatgcaaatgtctacagcagctttattcataattttcaaaaactagaaacaactcacatattcctcagatggggagtgaaactaaagtatggtacattccatacaatgggacactactctgcaataaaaaggaatggactattaatatacaagaacacggatgaatctcaaatgcattatgctaaatgaaagaagccagactcaaaaggttatgtactatctgatttcgtttatataacactctagaaaaggcaaaactaggaatggaaaactggtttgattggttagcataagaaaatttggtgggggggggtggcaatgtcttgagttggttgtgacatatctcttggcatttgtcaaaactcttagaactgtacaccaaaaaagagtaaatatttttattttttgtttattgagacagggtctcattctgttgcccagggtggagtgcagtggtgcaatcacggctcactgcagccttgacctgggctcaggtgattctcccacctcagcctcacctgtagctaggactaccacaccctgctacgttttctattttttgtagagacagagtttcaccactttgcccagactggtctcgaactcctgggctcaagcaatctgtctgccttggccttccaaagtgttaggattacaggcatgggccatatcacctggatgtaaattttatacagatttttgaaatgcttacaaaatagccctaagagtcaacaaaaaattacatgtgaaaaaaatctattttatatatatactatatatagagtatatatacactatatatagtatatatatatatatatatatagtaactgaaaataccataggtatttcactacccatctgagaaatatgtgagttgtttctagtttttgaaaattatgaataaagctgctgtagatatttgcatatagttttttatatgaacactggttctcacttaacatggttaaacacctaggaatggggctgctaatttaactttataagaaactgccagtctgtttcccaaaatgactacaccactcccacgagcaacgtgtgagagttccaactgtctgcatagtgaaatattttacctatggtatttttcagttacaaatatatatacataggtatatatatatattttatatatatattttatatatttatatatattttatatatatacctatgtatatatatttgtaactgaaatatatatactataaaatatatatagtatatactatatatatttatatatactataaaatatatagtatatattatatatattttatatatagtatatatagtatatatatactatatattatatatacactatatattttatatatactatatattatatatacactatatattttatatatactatatattatatatagtatatataatatatatactatatataatatatagtatatataatatataatatatattttaaatatatactatatatattttaaatatatactatatatattttaaatatatagtatatatattatatatatatagtatatatatatattttagacggagtcctgctctgcatagtgtacaattttacctatggcatttttcagttccaaatatatatacctaggtagatatatatataaaaaatacatatacctaggtagatatatatataaaaaatacatatacctaggtagatatatatataaaaaatacatatacctaggtagatatatatataaaaaatacatatacctaggtagatatatatataaaaaatacatatacctaggtagatatatatataaaaaatatatatacctaggtagatatatatatttgtaactgaaatatatatactataaaatatatatagtatatactatatatattttataaatatactatatatagtatatactatatatatttatatatactatatatagtatatatataaaatatagtatatattttatatatatataaaatatagtatatatagtatatatattatatatagtatatatagtatgtatagtatatataatatatatagtatatatattatagaatatatactatacatactatatatactatacatattttatatatatactatacatattttatatatatactatatatattttatatataatatagtatatatattttatatgtatagtatatatatatattttagatggagtcctgctctgtcacccaggccgaagtgcaatggcacgatctcagctcactgcaacctctgcctctcgggttcaagcaattctcctgcttcagcctcccgagcagctgggattacaggcgtctgccactgtgcctggctaatttttgtatttttagtagagatggggttttaccatgttagtcaggctggtctcaaactcctgatctcaggtgatccacccgccttggccttccaaactgctagaattacaggtgtgagccaccgtgcccggcaaaaatgttttaaaaaattatacacaatgtttaacattatttttaaaaaagcactggtaagtaaggcattaccaaaatgatgacagaggtaatactaagtgggattgtagatgagggttttcctttattaacactaaatagttgtatttaatggatcattttctttcttttctttgcccttttttctttttgcatttaccaggtcgcagaaccctagctgtaatcactaaacttgatctcatggatgcgggtactgatgccatggatgtattgatgggaagggttattccagtcaaacttggaataattggagtagttaacaggttagcagttagaatgggataagaattgggataagcattcttagaatgggataagcattctcacttcagagcaagtctgaatttctaaaatctgtttgaaatgtgatgctgtactatattttttctcccttttattatgatcttggtattgctaaagaatccgttgccctaaagggagaaaagagagagaatttttttttttttttgaaatagggtctctctctgttgcctaggctggaatgcagtggcgtgattgtggctcattgtagcatcaacctctgggctcaagtgatcctttcacttcagcctttcaagtagctgagactataggtgtgtatcaccacacctggctaattttaaatttttttgtagtgacaaggtcttgccatgttgcccaggcttgtctcgacttcctgggctcaagcaatcctccaaccttggtttcccaggtgctgggattacaggcatgagccactgtgcctgccccatagacatttttactggaaaatgtttctaaagtaagcaataccacaaaatggaagaaatgttgtaatagccaggctttaagaattcttgcctatcatgttaagctatgtatgaggaggtactgggtaagggaaaaattatctaatgtgcacccaatcgagaaagagtttaaggtggcaggattttaatagattggttttaatccctggcattagtgatgcttctgtgtaattgccaggatgtgacttggagaaattttattaaaggtatcctaatttataaatagttggtattaaaaactgggaaaaggaaactagtattgagtgtctaattaaaggtgacaagattttaatagattggtttaatccctagcattagtgattctgtgtaattgccaggatgtgacttggagaaattttattaaaggtatcctaattataaatagttggtattaaaaatcgggaaaaggaaattattattgagtgtctaattacgttttagacactctactgtgagcaatttgcaaatggtatctcttggaatcctcacagcatcccctgaggtaggtgttgatgtctattttataatcagaaacctcaggttatacatttaaccaaaagtcacgtgggtagtgaaagagctggattcggatgaatatctcttttagtccaaagccttcatatggtaggaaacactgaaattatcatgaaatctgagttatagtcctagttcttacataaactagatacaacgtaggtttaaatgacacctaatgtctttgggtctcaagcctttagaaaatgaaaatgtttttactgcctgatacataagatccattccagttgtctgcttctattttaatgtccttccattccaaccctactgtcattctcccatccccactgtcattctcccatccccactcccaattccagctgtctcctttttcaggtaaggaggtggcctaacactgttcgttgtttgtagatgattgttcttcaagttaacttaattatttttgggagaaattagttccctgtccatggataaaatatacagttgactaagatactcttatatttttatacctgtctatacctgttacttattgtttttgtctatagttaatggtaataatgaggcctactctatttaggcactagttacttacaattcacttagttcaagtcttggctatgccagttagtgtgtgacctggggtaagttagtttttgtgagcctcagttccttgctatacaatggggtaataatacctgccacataaaattattgtgagaattaaataaaacagtccctgtcaggtattagagaacaatgcctggtgctgtcatcatctaaggtaggaagaggacaacagttaagctgaatagtttcgttattttttcaacctcaggagccagctagatattaacaacaagaagagtgtaactgattcaatccgtgatgagtatgcttttcttcaaaagaaatatccatctctggccaatagaaatggaacaaagtatcttgctaggactctaaacaggtaatttttttaccttttggaaatgagatgtgtttgtttttaccaattggtgtctgagagggttcattttcagttccttacattttcatactgttcctaacagcttcacttatggtttcttatatagtaggttcctgaagagtagatgtctctgtttttattggggtggttgacattacatcatcacgtagtctagaatgaatgtacaagtgattttaaaatgttttaattacgaaaattttgacagttaatttagttttgtggctagaactagagatgacttcatttccactttgcatttcaggaactgattaaaatttgtaattttcacattatctattcttaccttagaatgtgttttatttaccaggaaagggagatggaaaaacaaagaaatagaatgtcttttatttctattcactgtagaaataactatacgttggattctgaatacccactgatgtgtggggactagaagccctttctagatgatttataaatgactgaagtggaagccattttctcttacttttatcttattccctaaagactgatagacttggatcttaataaggttgattttcactttgctgggtaccaattgtaaatgacaagtcaatgaaaccaaaattatataggaagaattgattgggtggcttattttctctgtggtaattgcagtaatatgaaaataatttgcattttttccttgcttttattatttaggaaaaaccaatcaaaattgtttttttccttttcacacacagttaatcagtatagcacagaatgcttttgagagcagatatatggggagttttccccatacatcaagcaaggaattctccaggggattctagctgaatgtcctttaattcaatgctaacactgtttacctggagatagtgtcagcgcccacaggttgagggttcagtcccacaagactgcccccaagtcagatgccagttgtaagcacaggttgtagcctgtgtttctgactgacaggctataagtcagggtacccatgatccccttttcatgtttgatgaatttgttagagtggctcacagaggtcagggaaacactacttagcatatacccacttactgtaaagcatattacaaaggatatagataaatagccagatgaagagatgcacagggctgggcatgtgggaaggaatgtggagcttccgtgccctctctgggcacaccacactccaggaaccttcatgtgttcaactctctgaagactccatgaactgtgtccttttgagtttttatggaagcttcattggccattggtgatcagctcaatgtttggcctctctcctctcttctgaggctgttctggtgaccagctcccatcctgaagctatctagggacccccagccaccagtcatctcattagcatgcagagacactctaaacacccttaatgctcttggagagtccaaggattttaggagctgactgccaggaaatgaagacaaagaccaaatatatatttcacagtatcacatttgccaggacaaattatttgataggttttccccattgtaaaaatttgacttgtttagggctttagaatacacaattttacttttaaatccttcctttctaaccttttttaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctgtaagtaagaaatttttctgtagatttggttacctagattgctaggtcacttttccttttgtgaagatgacttcagctcagattatctgattaagatttattttctataaaacaaaaatataactttgtagagataataggatgatgtctggttgtgtgaaaatatgctttgtaaatgatataaagcaaagtaaaattgtcacatatttttaaatattttaatattttataagtatttacttatttttataagtatttaataagtattaaatattttaataagtatttaaaaataatttagcttttaaagtgtttgtttctttagtacacacagtataattgctcacaaaaattagaaaatgcagataagtaaaaataaaacataaaaacaaaattacatgttggtgtgcacctgtagtcccagctactcagaaggctgaggtaggagaattccttgagctcaggagttcaagtccagcctgggcaacatattgaaattccatccttttttttttttaattgaatccaaattttattaaggatttcaagttacatacttcagatttctagaatggaatggaataattttggaactggaaaaatggcataaacactgatatcccttgaaacttcaattttataaagaaaattcttctgcaaaccacatccccattatataacaagaccaggtattatcgacaccttcactttggcaataactatttcctaaaagaatgaaaaagattattttgctacctcagttcgttaaaaatgggattctggccaggcacagtggctcatgcctgtaatcccagcactttgggaggctgaggcgggtgaatcacctgacatcagttcaagaccagcctggctaacatggtgaaaccccatctctactaaaaatacaaaaactagccgggcgtggtggtgggcagctgtaatcccagctacttgggaggctgaggcaggagaattgcttgaacccgtgaggcggaggttgtggtgagccgagatggtgccactgcactccagcctgggcaacagagcaagactctgtctcaaaaaaaaaaaaaaaaaaaaacagggattctatctttaaagttcagaaaaagctgcatttagatgaactacggctaccaaaacaaacaaaaaaacagagtgtctaatcaaagcaaaggaaatgattttgaaaatagaacaaagctattataattggttaaggatttccagtagtaagttaaaatctcaggagaggaatggatagcattacaaacaatgtgttcacattccaagacctgaacactaacttctcaaaaaggaagttttcatcacctctaaaaatgaattcaatgtaattttgttaagagcaggaaatctagaccttcctctaatgacaatccaatagtccaccctcgccatcgtcaaaagaaagttgcctcaaaattaacagtaattagcctgaggtattgtaaatgtggcactacagtctgaaatttaatggcatcttttgtcaaaaatagtcttatctctactttaatctcatgactacaatactatgtgctatccctgtagtatttactactatgcagtcatacagaaaaaaattgttggaccttgtgaaatagtgcatccatctacttctataaaaataggagccacattggccaggcgcagtggctcacgcctgtaatcccagcactttgggaggctgaggcaggcagattacgaggtcgagagatcaagaccatcctggccaatatggtgaaaccccatctctactaaaaatacaaaaattagctgggcgtggtggcacgtgcctgtaatcccagctacttaggaggctgaggcaggagaatcgcttgaacccaggtggtggaggttgcagtgagctgagatcgcaccactgcactccagcctgggcaacagagagagactctatctccaaaaaaaaaaaaaaaaaatatatatatatatatatatatatataaattatattaatta

SEQ ID NO: 16493 - DNA, 47781 bp, Human; identical to SEQ ID NO: 16492
  misc_feature (1)...(47781): n = A,T,C or G

SEQ ID NO: 16494 - DNA, 47781 bp, Human; identical to SEQ ID NO: 16492
  misc_feature (1)...(47781): n = A,T,C or G

SEQ ID NO: 16495 - DNA, 17420 bp, Human
ccaggccctaggacccaactgtggtgccagcagtttgtagaacaggaagagaagtcaaagcagggaccagacccagttacaagaatgagggcacaagggctaggaatgggggaacaagagcatggttgttgtagccagaaaacgtaccaggggtagtctaaccaatggtacaagttgttgccaagcatgatccagtgttggtctcaggaggcctaattatctcctaattcaggttaatattagtccaaggaatggatggtggcattgagcatgcaagtgggacccaagttgcctcagtgatggtacagagtgggaattgaatctgaaatcattttggcaacaaaactcatgttttcctcactgcactcatcatgctacttctccaagaaagagacacataccctagctctagggatacgatcaatctgttcactaaatcataagctccttgaaagcagaaaatgtttcaagtgccgagcagggcatggcacatgctcagtgataatttgttgaatacataaagaaaggcaaagatggatgaagaaaaggagacatagtctgggttgggtggggtattccatcaggctttcccagagtttcagtgaaatactccaaacattctatacaatttgttgcttttattccatcatatccaagcaaactgctgatttaaaacaatgactcctggtttcttcatactggaaatgaaggatagatgttatatgaatttgaccactagtcattatttccctgtgttgtggattatattgacatctggttaatacctcgtgagtagttcatgtggattagatgagcagcatcagtctctgtgaaggtgggcataaggtccaagaccctctgtagcagagaaagaaaactgatgaatcataaaagcatctggcttgcagtctggtaataaaaacggtatatatatatatattatttttttatctttcatactcctgttgttgcatttttaaaaaactggctcttagatgtccagaattgtatccatcatattcttgaggttcatgacacatcctcacaattggctcatatactgactcaaatattgttgactcataaaaattcaggttttgccttctcctgagaaactgaaggatccagcaacactgggtctgtttccctgcagggaaaccattagcagctgctcagagtgctgtccctctttatactgatctctgttgtctcctgaccaagaggcttcatgtcagttgatgtacatcattgggcatgaactgttacttttctaataaaatagagatagctgttttattgcatctacaccatccatttacattacctgcctggcaagcgtcatctgagtttgagaactctgctctgctgggcaacccttttgacatccctaataatagctaccattcactgagcccttattatatgcgagcacgaaactaacaatttttgacccattatctctttgatctctataaagctctatgaggtaagtctgagctgtcatctccattttacaagcatggaaactgacctcacagaggcaggtaatttgtgcaagattacaaaacttctaagtggtgacactgagattcaaactttgaattcaaaccttggattcaaagcctaaatccaaagctatggtttaaactttttttaaaaattacgctgcttcccagccaataatcttttaataatagaattgctgctaccatatggggtttctcccccatattcagtccctgtggtactgaataccaggaagaccctcttcctggtattcagtgccaacctggtgctgttgctttgttggagagggaggccaggtcgttctggggtcactgtgactctcataaattactgatcctggcactggggtgtgtgtgtgtgtgtgtgtgtgtgtgtgtgtgtgtgtgtgtgtgtgtgtatgtgtagctgggctgtcccagcgctatccacagggaagctcctataaagggctgcatctctggactcacagctatcagaccattgagatgtggaagctgttgctgtgggttggtgagtgtggcaggtcccagcagtgtcactcagtccaggaagtgccaggctttatgagttcgtcatctctctggtgcctgagagagcagcctgagactcagggaagcctagattaggtagagatgggatgggccatagttaatggtcagaggtcagagggacccagggagaagtggtcagagcagtggttctcaaacctggtggcccattagaaattttaaatgcctgagttccaccttggaccagttctgttagaatctctgcatgaccagccaggatatcagtacttcttaatttgcagccagggttcagaaccactggcctcgagctttttctgggacttctaacacttgtcattgtccctgggcaaagcatgagcatatacacatgtttatcaaaaagaaaaggaacttatatctagctccactggtccaactttagaaactaggaaacgagtaaatggtgtgtgtgtccccatttgtgtgtctgcatctgcataaggtggtgtgttggtgggcacccttgctaatcagagggtgtgctgtgccataccactctggtgagggtatgaatctctgtgtgactccttcctttgtttctcacagggctggttcttgtgctgaaacaccacgatggtaaggaaactgtgttttcccttccagagccagggagagtctctggctgagaagtcctccacattgagtgtcccctgcagcccaccttgccctggcttctctgacagggattattgatccaacacagtttctcagaggatttttggtcacctgctgtttgtgtcgctgactgtgtgccttggtccagacttgagaatctgttctgaccaggatttcacaaggcattgttttcttcctgagacctcagcagtgggggaggaatagaacctcagtgtagttctgaggtgtacttcagggccagggagagaggatgtgaaaatgtggcctggtctcttgggctgcgttcacattgctttctggaagctgagctccatcccctcccttggtttttgccaactaatgtgtgctctcccttaccaggtgctgcccataaactcgtgtgttatttcaccaactgggcacacagtcggccaggccctgcctcgatcttgccccatgacctggacccctttctctgcacccacctgatatttgcctttgcctcaatgaacaacaatcagattgttgctaaggatctccaggatgagaaaattctctacccagagttcaacaaactaaaggagaggtgtgttcatattggatgtgggggttgtattttcagatttcacaggtataagataacagtctatttctcctgttactcttcaactttcttctatttcttccagtcctaccttcctctcaaataggggtccagagcacccccaacttgagaactccttgtcacagacaccttgagctctttcctgcctccttacttttgtagttgctgttgtctctgcctggaatgtgcttctctctcttctctgcctggcaaaacccaactcagcctttgaacctagttgtgaggattttagttattaatgctgttaaagtgggcctacacatcccaaatgctcaacaaatgctcatgtttttattaccgtttgttaccggtgagctactccagggaaggggcagtgtctgctgtgttgttgtatccccagtggctaggtcagtgtctcacacagggttggtgctcagtaagtgtttgcttacattttcctctctccggaactcctgggatctctctgtgcccaaaggaaggcttgttactgcattaatggttatagatgggcagagtaaaagttctatgctactagattataaactccctgaaagtggggagcttatctgtgttgttctttgttctaaagtgcctaaagcagtaaatggcacatagacattgctcaataaatatttgttgaataggaaaaagagaaacattttagactgctctttttttggaagcatcatagggacatgcgcgagtttggcagactttgtgcagccttggagttgttgggctgtgatggcccttgggttgattgttctctctgtctttcctcctctctcctgtgctcatcatctctctccttctatcaccttcccccttttcctttccttacctcccatctctcctgtttcctgttttcttccaatgagcaaaataaaagaatgtggcagcagctgcccaccggagtgaagaacccagctcatcaaccctctctctcacatcataggaacagagagctgaaaacactactgtccatcggcgggtggaactttggcacctcaaggtgagactttgctgttattctcttctccctgggagggtggagcaggctggttagacgtgaagacagagggggaaggcagcttggccatgcggacagcaaagctagcgcaaatacttccccaactcatgaatcttagacccctgcactcaagggatatcctggcctcttctccatggtgggtcaggggagacaaggaagttctagcaggtggtgagaaagaggctgggggaaaattagggacaaaatgaggcactcataattgtttcctcaacctttcataagaggcaagggttttgtctccaaggggaggaatcaggtgcaggatgagaataactcccaaacctcacaggtttcttcactttattagtggatccagggatatcaacctcaaagggttggaacagaggaaaggaaataacaaaatgctaagcttagtgctgggacatagtacatgttcagtatgtagcagctgctcttgttagcacttcaatctccatgagacaacgtggagattacaaactgccttcatattttctgaagaaacatttcccctatttcatggctgaggcctgggttagaggccgtacttgccttgttgccttaaaggcatgagatacacgagagggaggcctggtgggctgggagtgtgtgaggatgcactttacaagatggaggaaagattcagggcaggggggtgagaactagctctgcccagcccaggattcacctcttcccatctctgaacactccctgtgctccagatgctgggctagggctgtacacgcattatcccgtgaacacttgcaggaagctttacaaagtggttgtattcaaaattggtagagcagaaagcacaagtcacagttattaaggaacttgccagatttgtcacaggtattcctcagagattgcccagcaaggaggtgggaaactgaccatggaacccagatctatttatgagtctggttaattttttaatcatggctcatctcaggattaccccagagttgcttaaagttcaggtccaataagttagaatttttccaaagtgtcatcactacggaagagaaaacaagtaaaatagaaaaatatcaaacaaaaaacgaacaaaagaacacaggatcaggatcccgttatcagaacacaggcctcttgtgccaagttatacagcccaggcccagattaactcatagatgtttctggacatgctggcccttgactcatgttctctcccctaatccagtcaggtagaaaatgtcagtgctaggacaggttgtgggaattgagtagttacctatgaggagacagcacagagaggggcagtgccttgccagtgggcataccatgttttgggggcagagctggactgagccatttctccacaccccaggctgcatgcttggttctgtgcctgctgttccctgtgccgtctggccttggggcagtacatggttttcaacttcttttagctgcctgaattccctactcctgggtattgagctcctggtgctgggagaggcatataagaaggtgggagagttttggaaatctgccttcctttcctccagccacatctgccaggcccaccacagggaaccaagcttgcaaggggccttgtaggaggttgtgattctgtggatagagttctttgccttacccctggtctccctacagattcaccactatgttgtccacatttgccaaccgtgaaaagtttattgcttcagttatatcccttctgaggacacatgactttgatggtcttgaccttttcttcttatatcctggactaagaggcagccccatgcatgaccggtggacttttctcttcttaattgaagtaagtctggtctagaagcgccagaatccagaaatgattctacttttatatatctaggcttatggcaggagaagagcataagtccagggccaggggcagaagagggtgacagaatgttcttttactgtgaacccctggagggtaatacctgtaactccctgaggttgctcttttcgctgcacctggggcttgctccagtcctccagcctaagggatgccttctctctgcagctccctgcactcccttaggcagtgtctgtctgaattctgtgcttctgagcctgcttgccacccctcaattgattaaatcattaaccacatcagccctcatctgcctgtctcatgagcctgtggcatggcccatgtccaactcaccttcgtgtcccagagcctggctcaggagctcagtaaatgcttcctagatgacactccccccaggccccgcctctctgtttgtccagttctctgtgtctttctgtctttcctcttaggagctcctgtttgccttccggaaggaggcactgctcaccatgcgcccgaggctgctgctgtctgctgctgtttctggggtcccacacatcgtccaaacatcctatgatgtgcgctttctaggaaggtgagtggatattgctttggtggggcaggacattggtgggaagcaggtgtcttgagctcagaaccccagagcttcccaagcactgtttttgagctcaccgtgtgcctgccctgacgtcagtgcaagtttggggctggactgaggagcatgggtggggagaagggctagttccattataccctgagggtttctttagacctcagagggaggtgatgtaatatctgcccacaacaatgttagcacgggtagagtcttctgcacagcctattgctgggtctcacgaggagagattcccaggggcctgtcctctttctacccagagtatatctgtagacatacactatgcagcggatgctggcatcagagacagatgaattaataatcactgtcacaaaaacaaaaacaggaatgcccagtcacatccagtattcagagcagttcttcatgcaaaagttaaaaagctagacaaagagcagcacataaatctttttggacatgtcatctctaggtatattttctagaattttgagaatcaagtatttacagaagaggaaactgaggcagatgcagaccaaaacagaaatgggatgttcctgtgtatgagtgtgctagagaattgtttcaatgtgggaggagggtgagagacacaggggacatggagtgtgttagtgttgatcttttagccagacaggattgagagagtcctgccttcacccaactgggcaacattaggcaaattagttaacctatctgagtttcaatttcttcaactttaaaatggagatagttacactacttagggaattagccagattaaaattaaattagataatcagtgtaaacccttatccctgtgacctggtaatgatgaacgctttctagaggaggtgggtttcaatggctcctggaattgtagaaagacaagctatggaacagactgcttttactcatgaccatttgtgcagatgcctgttagcatttatatcaggcctgagtgtattttctctcatctaactcctgcctacctccacaggtactctcaggatgcatagctcctcatatacagctgttcctaaccagctgtttgttccagtggcaggtggatagcacagcctgggcaggccccacaggcagaaggagcagggaagctctggtgaccaatgtctagctagttagctagacagtgctgtgatgctctgacttgaaaatctggctagcccagtctttatatctcttcctcctgccccttacagactcctggatttcatcaatgtcttgtcttatgacttacatggaagttgggaaaggttcacaggacataatagccccctcttctctctgcctgaagaccccaaatcttcggtaaggaaaggaaagatctcaggtggtccagacatctgcccccctgagctcaggccattggctcttagtaacaaggaggagtctggattcttcttacctgcaggcatatgctatgaattattggagaaagcttggggcaccctcagagaagctcatcatggggatccccacctatggacgtacctttcgcctcctcaaagcctctaagaatgggttgcaggccagagcgatcggaccagcatctccagggaagtacaccaagcaagaaggcttcttggcttattttgaggtgatgggaatatcagtctctgtctagcagttaggactctcccacccccagctggagcaaaggccaggacaaggggcaatggcaagggtgagagctgtagacagggcaaagaggtggtctattagtacaagagaaacccactctctgggatattttctttttctttgaggtaagttatttgagtcctttgtaagggacgaaggacttggtggaatctggatggaagggtttcattgcaccccaaaaatgatcttatatgctatacaggtaaaccctgactttctgtatggcctaaataaaaatcattaatatttgcaatatatataatttcaaacatatgcaaaattaaaagaatagtatagcctctgtacctcccccacatactactcactcagcttcaatcattaataattcatggccaattttgtctcatctctgctggctccctccctccctactactagatgattttgaagcaattccaagacattatctactacaggttctttctctccactccagctctaccctcttcatcttcgtctcaaccaagcttgctattgggtggcggaaagagacatgtttccaagggaatgtaaccaccagaggtggcaatacgagccacataactgtgtggctgtagtgacctggaaaggtcttatggagcaggtagagtttgagcagagtttgaagcacaggaaaatcctgatggacaggaatgactagacgggaaggacttcccaggtagaggacagcaggtacagagggacagggtgagtactttaggcagtagtggaggtgctgcaagtctctccaatctctgctctgcgctggatggatgagggtgtttttctaacccaatgaagcatttttatgagtgctggcatagttgaaacaatgttcttgaagggcaaagaagctttgatagacagaccctttgaagcaccaaaggaaaaaaggaatggcttagacattaacttctgcagcacagcttgcgtacctctacttttttgcagcatatagtttttagcacaatgctgggcactcagtggacactcaaatgcttaattatttatagcaacctagttctccctgccttcaagaactttaaatctactagaagttcaggtgctagtttgagaaccacctatatggggcagtctgtgctgggatctaatgaacaggagagacttgtttatgaaaacactttgaatgagatacagatttggtcaaggatcatgtatgttactcttactattttggtactggcattatacccctggcttggtttcttaaggatgtcatccactctttggttcccttttttccatcatggacagtagagagaggaaagggtaacagtaggaatttattcaaaatagagaggaactcatttgtgagtggcctctccattctctctttggtttaccttcttctcattcactggttagggattcttggattctttatccttgggcaaggaacaactgtctcttggtgcttatctccatggcacttcccagaactaacctggtggtcctcttggcagatttgttcctttgtctggggagcgaagaagcactggattgattaccagtatgtcccgtatgccaacaaggggaaagagtgggttggctatgacaatgccatcagcttcagttacaaggtgagaccctggctctttcatgctccagcacatggtttcctaccggtttctatggggtccttatttgtacaatgcatgtatgtgtattgggtggagagtgaaaggtgaggatgattagaccaggggtttcaggcatgcctacattttagttctaactggggctttataatcccatctgttccaagtctctattctgaagagaaagaatctaggttctgagggaataaatagttccctcagttcttacagcttttcgatgatctttttggtctcttcctttccatttggaccagctaatttcataacagataaataccaacacaaagtagatcatggtaagtgctctgtaaatattactgacatgtagcagaaatgaggaagtctgggagggcttcctgagggaggtgagcaggagtaggagaagattatgacattggggaaaggctcagtggtgtagaaagcttatagcaggttcaaagaagaatttgggtgaagcagaggctttttataaagggacttgaatgctggtaaaggtgttcagtcttcatcctgtgggcattttaaggcaaaaacaggtttctacaggtggatgacctttaattttcaaacttttagagccaaactatgaccaccaccctcccttcatgtaagtggtattttatgaagttgaatctggcaggtttttatagtgaactaaaagagaactgacatgctccagtagttcctaaacctgcctctgttttggaatcacctgagagactggatacatgtagaaatcatggttccactcctcaatattcagtaggtcttagaaaaactttggaaactattttagaatgcctccatatatgatccttccaaatgctaagttggcattttgggagctctgggcgtggacacagaggtgtccaagcatgagataatgagggtctggactagggtagttggaaggagcagcagtttaaaggtgagaaattgtcggaatgtggcaactgcttggatattgagacttaaatagagagaattcacagttctcctgttaacggtgatgcagaaatggcaggtgtcggctgttttttgggggaagtttgtgtgggaagcaccagagaggaaggcactcatgaagattcactgcgtagctcctctgtgcattaacactgggtgaggcctgctggggcggagagagataaaaaagcatggcttctcccctctgggatcttgctctgtggtttgggaatgggaagacacaaacaggaaagattaatgactcaatggatttacccaattggatggagttaagtctatgacccataggacatcagagaggggattgatcccttgtgttgggtgaggccctgggatgagcagcagagggtggtcttgctttgaggtgcagttactgtaacttgcagaactaggtgaggagacatgaagccaggttggggatggttaagggattttgacatagaatatcagagctaaaagagaccttggggattattgttgggagataattataccctggatttctcagagttcctgcacagtttgaggattctgggcaaaggaagcagacaagctttactaaaaatagagagctgctttcctctttcccccagagccatttgtttaccttcaatgattgtgaaagtccccttcccagggaggacttgtttacattccaggttctctcctctctctggaagggaggagggccacatatgtcaaccattctatataagctctgagtctcataatttcagagttcttctctgtagcgcagaccccactgcatatgcaggtgaattgaacatctgaccttcatcacattgtccttgggacatggaaactgactcaaggtgctattctggctattttgttttgttttttttctgtgagtaataaatattctgtcctctgatccagaggtctggggtgttggggtatgtgagtatgtgtgtgtgtgtgcatgtgtgtgtgtgtgtgtatacacacaaaactggcagactaatttcttagcttgtaagtagcataaaagtctcagaaacttcacagtttcagacttaatgattggattcctccttcctcttattttacatttggggaaagtcaactcctgaaaggagccaattgacttggctaaggcacacagctatttggacctgatagattctgtcttttccatcagacttgacagagagcactggcaaggtaataataaaacctggacttgaatctaagctctgccatttagttgtagtggaggttttaaaaagtgtggatgaaagcctttattttctcatctgtgagaagcatataatattttgtgctctactgtattttatagcatcacggtgagataaggaaatgaattttaaacagtagagcaatatctacagtttaataggataataatggtgattaatgaggtggggaacccagagggttagtagctaacttttattgaagattcactatgtgccaggtattgatccaaatatcttatgcatgggaactctttaggaaaacttatgtagcattcctatgtaacataaaacataagatttaccattttaaccattttaaagtctgaaattcagttgcattaaatacattcatgttgttgtgcaattatcaccaccatccatctccagaactttttcatcttctcgaatggaaaccctgtgcccattaaacagtaacttccccttcctccttcccacgtcccctggcaaccaccattctattttctgtttctgtgaatttgactactctaggtaccacacataaatggagtcatacagtgtttcttattttgtgcctggcttatttcacttagcatagtgtcttcacgcttcatccatatcgtatgtaatatgtgcatgtaagaatcttttgggtctaaacatgttggacatgttattatcctcttttttttttttcacaaatgaggcagttaagacacataagggttacataacttcttcaggatcccatagctaataaacagtaaaagctagattcaaatgctggctacactcctaaccacccagctacattgcttcctgagggactatcttcagttttttgccattgtacccagtctagagactgacaagtacagcaggttgactgactgttacttttacaggcatggtttataaggcgagagcattttgggggggccatggtgtggacattggacatggatgacgtcaggggcacgttctgtggcactggccctttcccccttgtctacgtattgaatgatatcctggtgcgggctggtaagtagctgtgacctagaagctggggttggaagttgcataaccaagcactgggtaaggcccttctgctagatctaaatgccttggtgaggcaacatgacattgaggggagagaaaaagctttgccaggccaatatgttttccagtctttgttgggatacttggcccttatttgacctctttgagcttcctttgttctatttaaaatgggaataatctgtatactcatgacattattataagaactaagtgagctatggaatgaaaattctcatagttagcactcaatatatgttatttatttctctctttctcttactctcatgggcaagggctgagggaattaggtttcttttgatatctctttttgatagtagaggctaccctggcaattaggaaatggaagctagcatgcaagaggtgaagcatccttacggatggtttataatcttcattttatgggtaatgcgactggagctcagtcaggtcaagtctttaggtgggccccagtcccattgttcacagcatgctgtccctagcctccttgcctctggctttgttcctggtgcctcctacaacatagagacataagaagcttctccttgagcattcatcaagtaattatttagaattaggcctcgaggcaaggttttgctgatgatgcaatcagagatgtcaaagtgagggcttaagcacaaggaatgggtgggctcctttctgaggtcattcatggaaaatgtagcaaatccactgagtgcctgtgggtgtctgggacctgtgaacatggcggggtctggagcaaggcttctatgtggtgggatttcatctatgtcctcaagtaggtatagtatgaaatcttacacttctgaatttttggagcaggtacttcagccctggattggttctagttctgccagtaattaataggatgagaatgaagtggtaggaatctcattcttttctgttgattttctctagagttcagttcaacttctttaccacaattttggctgtcatctgctgtgaattcttcaagcactgaccctgaaaggctggctgtgaccacggcatggaccactgatagtaagattttgcccccaggaggagaggctggggtcactgagatccacggaaagtgtgaaaatatgactataacccctagaggtacaactgtgacccctacaaaggaaactgtatcccttggaaagcacactgtagctctaggagagaagactgagatcactggggcaacgaccatgacttctgtgggtcatcagtccatgacccctggagagaaggccctgacccctgtgggtcatcaatctgtgaccactggacagaagaccctgacctctgtgggttatcagtctgtgacccctggggaaaagaccctgacccctgtgggtcatcagtctgtgacccctgtgagtcatcagtctgtgagccctggaggaacgactatgacccctgtccattttcagactgagacccttagacagaatacagtggcccctagaaggaaggctgtggcccgtgaaaaggtgactgtcccctccagaaacatatcagtcacccctgaagggcagactatgcctttaagaggggagaatttgacttctgaggtgggcactcaccccaggatgggtaacttgggtcttcagatggaagctgaaaacaggatgatgctgtcctccagccccgtcatccagctcccggaacaaactcctctagcttttgacaaccgctttgttcccatctatggaaaccattcctctgtcaactcagtaacccctcaaacaagtcctctttctctaaaaaaagaaatcccagaaaactctgctgtggatgaagaagcctaagcccctctggtgtcagaaaccagggaaaacccttgtcttttcttctaagtgacatgttggaagccttctcatcccggggcaaagcaggcatcaaaaccagaataggccaatctcttttccattaaataaactgtaaacacaagaacccaccgagttctctgagattcttttcttgaattgaactctgcaactcagttgtcagcttcttcctttcaaggtcattttccccactgctatttttggaaagagggagtttgtgtctagtctacaatgatgctatcctgtgtggattatgtgcttccttctttgctgtgagcaactgctcacttcactgttggttggagccagaatctcttctagaacagtttccaccatcctcaaggggagctgagatggggagggggaagttgagtcttccaattacattctctccttggtaaaatccttgttttccctgaaaaaacaaccccatctattctctcctcaagaagtgtttgaggaaaaggtataaaaaaggtactttaaaaattattttcttatagtattaccttcacacttctgctaggtctcctctagaaacaccagttctcacacattaaaactttaatccactcagggaacattttcctaggcatgactgtccctcataagttgctatagacaccagatcaatttctagccctccaattctaggagctagtgctacacagagtgggtgccatacctattattatgttactttttcttttggaagtgtagcctccaagtctttaagccagagtctgaaattaaaatgtccataggaccaggcacctgccataaagattgaagcacgtgaaagcacatggccatttgcttaacagaacctaggtcacatatgaaacccttttgccttgacaaaaaaattagctgggcatgatggctcacgcctgtagtctcagctacttgggaggctaaagtgggaggatcacctgagccctggagattgaggctgcattgagccacgatggtgccactgcactccagcctgggtgacaaagcaagaccctgtctcaaaataaataaataaaaaaatatttttgatgaatctgagttgtttttctgtcccatcttctgcatgcactttattcaagggcaacttgccttccagtttctaatttatctatttttttttcttatttataagcttccttgaacttatctcttaggtatacaatgattgggtcttctgtctttatcatcgaatccaaagcatagatcaatgggttgtcaagattcttgcctctatttatgacagctgttagttgcagataatggaatccactaaagctaatttaagaaaaaagacattagatggtattagagtttctgggagggtcaggaaaccaggatgggatactacacatctggaaacaacatgtccaggagatatggatgactcactttttaagacatactgttaaaggtctcagcttttaccctacttgcaacctaacaacctagccttttgccgtgtgtgtatgcacactacaaaaaaacaagacctgtgggtcagagacaagggaatgtattaataatagcaaaagccagatcaaaatcttttgccagttccacaagctacaagggagatggaatgaggaccaaactgtgcctgcacattcagtgggtgcatttcaagagagaaacccaaaattaggaaactatgatgttatatataaggctgctgatgaccagcccatttttcccctcttcttcttcgtccagagatagagatttatctgcagttttcaaggctatttcctatttgaatatccttgaaaagatagtccaagatgtgcagaaaggccagatccatggagaataccttgggactattctagcggtaatcccactgctgtcactgcctgcagctcagcatccgtgatgttggagactagatactagaatctctacctcagcttttccagaagagctggtctcccctatacattaattacctttattctgtaattcacctaaatttcctataggcacatttgcttagcagaacctaagtcacaaatgaaatctttacttcagggaatctgggaattctaggtttagcttgctagcctatatcacaggaaagcacactggagggggttagaatg

SEQ ID NO: 16496 - DNA, 15817 bp, Human
catacttgcagaacttgctgacaataagtgtctcattctcatctagttcccacaattcaacagcacctgttgggggtagggtaaggaaaacatgagcttggattataccaaggcagtaattcacttctaggattcaaagagccattgtcactaaattaacaaagtaagttagttattcctgtaaaagcaaagtccacatcattggagagttcagctaatttctgagtctttgactttattctgcgttactgttttcctaatgacagcccagacaagtaggtgcagaaagcttccagaaaaagacaaagatggaacagtctgtaaaattcattatctgcttttagtgagagaatatggaaaatgagctgcaaggggacaaggatgaagtttccacaactgtttaagcagcacactatccagtgatgttaacacttccccaatatttggacactagtaagtatttgctgaactagttgaataaatgtcttgcagagtctttaaaaatatgttgaataattgaacgtcttgcacagtgactggttaagtatagagaatccgccaaaagttgtcttgattatgtagtgttcaagctcaactgtcagagaggttaaatctatcaaaaactgggactttaaacttccatgcaatgccggccaacttccaaattctgattttaaaaaaaaaaaaatgccaaagcctgcatcgctaagcctaacagtcaacaaaaagaaagcagaatgaagacaagaaagcggtaagaaatgggaagagacatgtagcacagattggcttcaatgtcatcttaaaatcaagattatgcttggtctgggctgtgggggttaaggggcaggttacacagaagaaaaatggttccaatccgttgcttaattttgttacggatttttctaggaaatctcaccagacaatttagaattttagaaaaggtatttcccacctacacaagagtttgcattcggggccaacactctcaggctcctccaagcactgagtataggacgttagatattgagctcaaccctacggtaccccaagtctccattctaccgttccacccgggggtgggggtggataatgggatagtgactcacctgaatcggaggccactagaatacctctctccccaacccaagtgaggtcagccactccagcctccgtttggactccggcggagcagaagccttcgttgggggcggcacaggggtccttaaaaagccagagggagccggcccagcagcgcccactcaggctggaggccccgaggagaagcgccccatctacggggggtacaagctgtcagcgcgtgaagggtagaagggttcgcctccatggagaccgcacagaacagcgttccggccgggtctggatctgagctcaggaacgcggggcagggctggggacagctcggtgacgcgacccagggtcaggataacatgcagggcggggatgggctgggagggtcagtctccggggaggggcgccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggtcctgccctgacagattctcctatcggggtcacagggacgctaagattgctacctggactttcgttgaccatgctgtcccgggtggtactttccgccgccgccacagcgggtaaggggtatagaccctgctctggactatcagagtgattggaaagaagcgaatctaggggtgacagggaggggagaagggcgcagcgacacgggcctgagaggcgagtggtcagtgcagttcggaagggagcgtggggtcttgagggacgggaaagaggggtacataggcttagtgatagagcctggcgggggtaaggaaagggcaaaccagatttcatttgactttgctgaccttcgccttgtctatctgcagccccctctctgaagaatgcagccttcctaggtccagggtaagtgtgaggataatgctccctttcgtctttgttttcactaccttttatttcccgattcctgcccccacccccttagctttaggtcagaaatttctttccgataattttgggacacttaaaccctctttcagacaagacacttgttcctgtaactgccaggaacgctctcatgtcacctaatgaccaagattttagcaggataagtaacgtattctaactaaactagaaattggttttgctgtcttctatacccgccctactcctttgtgaccttcccttgggaccttatgacatgtagcttccacagcctgaatccgagtagatgacatacccaagaataaattttgttcaataaaacagtaaagcatgttgtttacagtcggtttcccagatacctagtttttgctgccatatgataacaatcagagaaatcattcattgattcagtaaatatttatgttgcctaaaaacataaccaaggatacaagaatgagtatggctaattacctgccctcatggagctcacagtctaggaatgggaggcaccttaagagtattggtttagagtgagggctccacagccagtacagggtccctggcccctccacttactggctgtgtgacctcaatttcctcatctataaaatggcgataatagtgcattgtggcttttgagaattaagagacaattgctgtgaaactcaaaaacagttcttggtacatagcgtgtgcttagtaaatttagcagctgttaccgttaaaattgttccataagacatgtccattttcctagagatttctctttttacttccaaacttagttctaaagcttgcaaaatacggtaactcaaattgaaaaaaaatggacttgaaaaagtggtcttatctataattaagtctcatgtatgcaaaaagtaaggctataattgactgcttccaacttagaagaaaaaggaccccatacagactggtaaacaaataattgtaataccaggtagtaaataacttatacttacaagatacaaggaatatccttggttttctttcacactccatgtccagtacctcagcaaggctcttcctctagaaatttggactctgactgctgcttccactaccgctaaagtaggaaccactataaactttcacctaggtattttagtagtctcttaattagtcttgcatctctattcttgtcccattacagcccattctcataatagccaggaggattatgtcaatcccccaccaaggccttccagagctccccatcccacttgaataaaatccaaacttagcataacccagaaggtccaacatgaattgattccatcctatctcttgacaccatctccttgtggtctctttttagctcattctccaaccttggtgttcctctgaaaactaccaagcgcattcttgcctcaatatctttctacttgctcttctctcttttccccagatgattgggtcaaatgtcatctgactccctaccaaaaaactcttccccattttgttgctccctatccgcttaccttgctcagtttttctccatagcacttagagctgcctgaaattttgtatggagatacacactcacccttcccatacccccactagaatgttgaaggctggagctttgttcattgccatgttaccggtgcctagcattagtagaaagtcagtaaatgttttttttaattgattaaaagaatgaatgttagcccaaaatggggggagggctttacaaatctggaggctaattggtcttggtagtcattgctcctgattggtcttgatagtcattgctataaagtcatggtatgaagggcatacaaggcagaaggagcagcataaggcaatttttttgtggtgtttctttgtttgtttttgagagctgttaagtaattccaggagagtaagagaatgaaggaagataaggttataaaatttggcaggaccaggcacagtggtggttcatgcctataatcccgaggccaaggcaggaggatcactggagcccaggagttcaagactagcctgggcaacatagacaaaaacaaaacaacaaaaatttttaaaaattttttaaattagctgggcattgtggtgtacacctgtactcccagctattgggaaggctgaggtgggaggatggcttgagcccaggaggtggaggctgcgagtgagcagtgatggcaccactgcactccagcctgggtgacacagtgagactttgtctcaaaaaaaaaaaaaaatgacaggtactagattatgtatgttatattaagtagttttctgtaggcaggagagagcctgttgagttttcaagtcagattttcattttagaaacattggcagtaatgtgagtgggctaggtttaagttggggtatttaataagaagcagaggccaggtatagtgtctcacgcctgtaatttcagcactttgggaggccgagacggcagatcacagtagtttgagaccagcctggccaacatggcaaaaccccgtctctcctaaaaataaaaaaaaaaatagctgggtgtggtggcacacgcctgtaatcccagctactcagctactcgggagactgaggcacaagaatcacttgagcctgggaggtggaggttgcagtgagctgagatcatgccactgtgctcccgcctgggtgatagggcaagattctgtctcaaaaaaataaataaaataagcagagagaccaggttttgtattgttaaactaagcaagaggtgataaggacttgaactaaggtagctagttagggagacttgtcagcctaagcataccatttagtgctatgatttaaatcagtgcttcttagcctggggtggtttgcctgcaggtgacatttagcaatgtctggagatatttttcagtgttaccataggatgggtcggggagggaggggctactggtacctattgtataaaggccacaaagatactgccagacattctacaatgcacagaacaacctcttacaacaaagaaatatccagttcaaacgtcggtagtgctgaattgagaaaccttgatgtaaatgaaggaatctcaagcatgattctcagatttcaaaacctggtggggtagctaatatatttggaggcagaaataatattcaaaagataagcattgtaccaaaataaatgaaataatgtaaattcttatattacaaggagatagaagttgagagattggaggaatggagggtaggaagtgggacagaaatacactgaaaacttgaaggagactaaatgacagcagatataaagggactagattttatttcatcagaagcttaaggagacatcagtatgctgtaactgttaaaagtgtagtcttaagctgctttaatacaagaatagtttccaaatccactgttgataatagttcaattgttcaagctcagtactggcaatagtaagttctcaataagtatttgtaggatgaataaattggccagactatacttaaagtattatattcagttctgtatacctcattaaaaaaaaaaaaaaaagataaaaccagagaagtccttacgggcaatcaggattgtgagggaacagatgtttgacccaggtacatgtgtgttatcttacatagaaaagcaaaattagaactaagaatggattgaggttccaagaatgtatgtatcatctcaattcaaagatgaacataattagagctacccagtactgaaaaagtctgttacatatagtgtttagcactctcatcaaagagagtattcaaaaaggtccaggagcttacaacatatcaggcatataatagctaaccacttacgtagaacttttccatgtgccaggcatcattctaagcacgtcacatatattaactcaattaatcctctcaacaaccatataaggtattatcttctatttccattttactgagagaaatctgagattacaaaagcttaagttctttactcaaagtcaaggagcaggtctaggatttgaactcaagatgcctatctgaccgccacgtccacattcttacatatttcagtgctaatgatagacatacaaagtgctagacagatgatctgcaaggctgatagaagggattccagtattgggtagaaggttaaatgtctgtgattaattctttgctgttgtcacagctgattactggaccctaaccttcccattcccagtccattctctttccattatgagagttagaaaactgcctcaattatcaaccctatttattgtttctgctcattattcatacactgtattctccttaaagaaacaggctttacatttgtacaattactacctgtagggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggtgagcatttttgcctagtctctggtaatatgttttgatggcaccactaaaatcaagttaggtgggttttcttctttggtttttgttgttgttgttgttgttgttgttgttgttttttgagacagggtattactctatcacccaggatggagtgatagatcacagctcactgcagcctccacctccccaggctcaggtcatcctcccacctcagcctcccgagtagctgggacttggcgtgcacccggctcatttttctatttttttgtagagacgggctttcaccatgtagcccaggctggtctccaactcctgggcttgtgggatccacccatcttggcctcccaaagtgctgggattacaggcttgagccacccgcctgcagccgcaagtcagctatttttaaaaggaaattgtaacaattgatttgattgctccaacttgtctttggtataaatttatttgggattttaacttaattttacagcattatctctgtttgttagtagatcaaattttttgatgcctgctttatgccaggcactgttgcagtcatacagtgttgaacagtgttaagtgcctgctgtcctggaacatacattctgttgtaggatgacaataaagaaatgagtaactgtataatatactgttaggtaatgaaaagggtacgaataaaaatgaagccatgtaaggcaagagtcccctgattaagtttatgattctctctactacatgtactgcctttcttggcccatacccaagtattgctatgactggaacattggaaaccgaagattgttttttttttagccctggagtcacctaaagtagcattttcctaactgaaattgctagaaacattagtctcctcagacgtccataggtgataacaatgttacatatgatagatgtttcttgcaaattcatatttaaaatttgtatattaaaggcagttaaaaaaaactgttggaactttgtatgggaaaccaggtaaaatgtatttgagtttgtaaccctgttgttcttatgatacatcctgccatcctatgattctcagaaatactgtaaaatgctttcctaaaagcctgctctgggcctcccttacatcctgtgaggcgcggaggaaagactaaataaatgtaaatcatggtttgcatcctttcagaacacatggcctggttaaagaaaaagccatatttgaagcattgtaattaggtgctacaggaattgagaatcctaatatttattcatccttttatatacatatcactttgtagttgttttttgcttgtttcttgtgtaaattttatccggtctagtgtcccattcgataaatagtatattttgctggacaaattacttcagaaagttatctgacatctttgtagaatagtttaatttactgtgcggggtattgtgcttaacattatttctcaaatttatcagactgaagaaggtactgtccccattttacaaataaggaactaaattcagagattatttagattgctcagtttctttaaaattgtagagtcagtatacagatttccctgagtccatatctttgttctttcaactctaccatactgcttcccaatccagtgttttgtctttgaatctaattaagtcattactttgccttcagctaatcaaatatagaagtacctttctatcttccctcttttaggcatagcatatcccttcataaaataactctttcttcttttaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgaggtaagaaccataaactttatttcctattttagactagcagaaacatgaaggtcatctagtgatatttttgatatgagtgttaggggagcaacatatagaaatgaatctaatgcttcaaataagtgttaacgttagttactaatttgagataatttttttatatctactaaacactttagcttttctatagtttaatcattcaaaagatattctatagttattatgggcaattctttttaaggatttgtgcgtttctttctatgtttctttgtgggtgtttttacaaatgagatatacaactttgaagaagcatgaaatgaatctcctttttttaccctttgtgctttcactgatctttgttgttgctatcacaattgtagcaaaaacttgcccaactagaagaggcgaagcaggcttccatccaacacatccagaatgcaattgatacggagaagtcacaacaggcactggttcagaagcgccattacctttttgatgtgcaaagggtaggtttcagaagtttctaggaagaatgaagttacttgttgtgtgcatttttttaattcagaattttttatgaagaatggttaaatagattgaacgtattttatttagaaaagagaagatttgtgtaggagttggcattcacggctattcaaacatttaagaactgtcaagtggaaaaatagttcaaattattataaaattagaatctatagaagctattaaaaaaaattttggatccacacaaaatgaaatagtcattaagttaaagctgatttaaaaatggcatgcactgtgtaaggaagactaggtaaaatacatcctgtgtatttcatacacacttgctgcaagaacatcttaacatctttgctgtaaggaaatctgatactgtacattctaaatccacaaagcaggcagggcacagtggctcacacctgtaatcctaggacttgaggagggtgaggcagcaggactgcttgcacccaggaggtcaaggctggagttagctgtgatcccaccactgcacttcagcctaggcaacagagcaagactctctcaaacacacacacacacacacacacacacacaaacaacaaattcagatagcagtagagctttttatcatggtcagaacatgattagattctaaaatatgcagcttccaaaacaatctttaggaatatgttcaagtattttgttattactgtttttattttgagccttgtactttatggctaatatttaaaagtgaggtgctgttatgttgaagttttatattaaaatgaaatgaaaaatgagatgctaaggtagagtaagcatctgaaatagttaggatcttggccaatatttctcaatattggccaagatactaagcatctgaaatgtttaggatcttggccaatgtggtcttggtaccacatggattagagttatctttggtgttaatttttttgtccctttccaagacttatggaatcagaacctttcttaggggctatccagaatctgtattattttaaacaagatccctaaagactcttaagcacatggatatttgaaaatctcagaaaatgttaattccatgtatatttaggttacaaagggagaatgcttcctgcttcttgcatagtatatacacacacgtgaatgcatgcatacatatattttggcttttttaaaaaaccatattggaaaatgtagctttttcctaagagtcaaatgatagtaatttaggtttttatttatttacatttacttgatagatatttattgagttcttcctgtgtagatattctgatcaaggcagagtgctgaaaatatagtggagaacaaaaagcttctgccttcatggagtcttattttctagccagcctttgggagaagcacagaaaataaataattgaacagatgcaaatgtcaacaggtaataaatgccagatagaaaaataaactagtattaaaaagattgcaggccaggcgcattggctcatgcctataatctcagcactttgggaggccaaggcgggaggatcacttgagcccaggaatttgagaccagcctgggcaacatagaccccctttctacaaaattgcaggaggagggagtcactgtttttatagggcattcaagaaatgtctctaatatgatatttgagcagacacctgaaagaactaatagtgcaaagtatgtggatttttggggaaataagttccaggctgagggaagaacagttgcaaatgccctaaacctggaagtttgcttgatacagtcaaggaaaagtaagaaggcccatacagctgaagtagaattggtcgggggagaataaaaggagatagagggaggcctgggactgtgatatataaagaccttaggctcctataagaactttgacttggactctgaatgagagaaagtcattgaaggatcattctgattgccttgttgccaatagccttcagtttggtatgcattggtttgtgatgcctatgggttagccaagtagagatatgtaagagcttggccttatgtagccttactgcctgtatgctgatcttggcttcacagtttattagctctgtaaccttgggcaagtttcctaatttctgcctcagtttcctcactgcaaaatggatacaattataataactatgccatggtttggttacaaggtttaattgaatctaaacacaagagtgtttagagtgtagtcagtactctacaaatgttaactattatttgatccagcaagtattatgacataaacacaaagacaaatctacaatgtatgcaccattatttgtagtaccaaaaaatgaattatagaataccagtatagtggaatccagtgtaacttaaaattgaggtaggtttgtgtgtcataattaataaaagtgatgtgtatatgcctatattttgatgggtatacctatatttttattaaatatttctgggagggaatacaagaaatacaggaagttaatggcctatgggggaggctgaaggagacttatttcatacagcatcacttttaaatatgtttttgccatatgctgttataatttctaggtacatattacctattaaataaaagaatttcacgtaaaatacaaaagaagtgggcattctcactggcagaatcttcagagtagaagtattccttcaagtatacaaacaatatttatcatttcttaattttgccccagaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggtacacaacatttttgtaggttctgatgttgtactggtatctcttaacaagtatctgctgatgttttgttaaggtaggaatagctggcaaggagtctttagcctagaagtagcagtgtaaccccggtttgtttttctggatagtgataagcaggaagatgctgcatacctgtcaggatggcttttctctttccttaaatttgggtaacattaactgatatatttaatttctctataaaatagactgggctgggcacggtggctcacacctgtaatcccaacactttggaagggcgaggcaggaggatcacttgaggccaggagttcaagaccaacctgggcaacatagcgagatcctgtctctacaaaaaatttaaaaagtagctgggtgcggtgacaaacgcctgtagttcagctactcaggaggctgaggtgacaggatctcttgagcccaggaagcataggctgtagtgagctgtgattgcagtattgcactccagcctgggtgagagagcgagaccctgcctcaaaaaataaataaaagactgaacaaggctatttctaagccccttccattttctaattccatgacattccatttcttcttttcacctgcataacttgtctgttttgaacggaaatgttttctatttgcttaaactgaattaattttttttcatttatatttttgctttaatatgacttgattttttttttctttctcgagtttataacatttaagtatttctggttgttttcagcataacctatacaggattagaaaaacagtgtctatcaaagttttttttttttttttgataaacttttacataaaagtaatatatatgcttacttaagaaacttagaaaatacaaaagaagtctagaaaagagattaaaaattattttcattcttaacatttatatattactaatatttgttgaattggtctttttcaagcaactgttggttgtacaagccaacatcagtggcagatggttacaggaatatctggcctcaaattctatacaggtttcacccataaaggctgtgagccagggaattttaactaaccccctggatttgcttaaaataaattatatctcctctgtgttaattaattttacttctaaacctgtctagtagctgtatagtgttaagccagtaatcatcttgaggttctggtctggtaggaggtgtcttttagaataatggtgtttatactctatacttttctatgttttggaaaggtctaaccagatttctctttccttatcacaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactactgtcttgtttatgagaccattcagtggtgaactgtttctggctgataggttatgagatatgtaaagctttctagtactcttaaaataactaaatggagtattatatatcaattcatatcattgactttattattttagtagtatgcctatagaaaatattatggactcagagtgtcataaaatcactcttaagaatccatgcagcaggccaggcacagtggctcacacctgtaatgcctgcactttggaaggccgagacaggcggatcacttgaggtcaggagtttgaaaccagccaggccaacacagtgaaaccctgtctctactaaaaatacaaaaggttagccgggcatggtggcaggcgcctgtaatcccagctactcaggaggctgaggcaggagaattgcttgaacgcaggaggcaaaggttgcagtgagctgagatcacgccactgcactccagcctgggcaacagacctcgactccatctagaaaaaaaaaaaaaaaaatccagcagacacctatcaggaacatagaaaataacaagtgttggcaaggaagtggagaagttggaacacttgtgcactgttcgtagaaatatgaaatggtacagccattatggaaaagtgtggtgattcctcataaaattaaaatggaaataccatgatccagcaatcccagtcgacatatatactcaaaaaaattaaaagcagggtcttgaagagatacttgtgttccatggtgatagcagccattgttcacaatagctaaaacatagaagcagcccaatcggccatcagtagatgaatggataagcaaaatgtagtatatccatgcaatggaatattattccacttcaaggaagaaaattctgacactggctacagcatgaatgaaccttgaggacgttatgcagttttacaggatgagttatggagctggatagtggtgatggtggcacattaaggatgtatttaatactgttcttaaatggtacacttaaaaatggtaaattttatgtgtattttacaatctttttttaaattgaagaaaaatcctgtagataaattagaaaattcttcccttcataggtttatctgcatttgattctcccatacttgtacaaggatttatttgtattcaaatggacaaattacgcaataggaaatatttgaaaatatttatcatgggtaattgctattttcattgacttcctaagattttatgtaataatcatttgagtcaatattggtagctaatgtactaatctaatattgaaatcagattgatatctttgttacttaaagataatttgattggatcagcagttatttcaaattgattaaacaaaaaattataaaacacctagtttgtgctaagcaacgtaatgcagtgatcatacagagataaaagtccttacctcggagttaaatatctactaggaagacagcaagaatatgtgataatacaaacttgagcacagggtgctctgagagtgtggcaagcaccattttaggtagtctcaccagcctcttgtttccctcatatacatcatccaggtcaaggttcagtcagagaagcagaatatatgtttatatataaggaatttgactacgctgttgtgggagctaaacaatctgtaaagctgttagtgttctttctgatgctggagcttagagtccacacggcagtcagttaagggaagacgggtgtaaaatgggaggcagttaagaacaagtggaagtaacaagcacagacaaacccatgtccgtttttatcatctctggccttgatagtggttgtcctgtgtaaccccatatccaacacaaacatgtggtttagagaaacctggttagagaaatgagtgatccagggaagggatgggaagttgtccagctgcagcttgtgagctaacaca

SEQ ID NO: 16497 - DNA, 30755 bp, Human
  misc_feature (1)...(30755): n = A,T,C or G
agaaggctctcctcccttcttcctgaggacagactgaagaaacatccaaggtggtcttgaaggacactgggatcctgtaacacaggtaaaagataaagactaatgtaatttctatggggttggagagaggtggtctggtttgagaaatatttaggcaaaagcataactgacaggacttggtggctgataataggtggtggtgtgggagagagagtagcttaagaggacacctggtttctcatgaacgtggctgaaaggccagtcaggcctttcctggatggtggacatggtgggaggagcaggcttgagtgtggggatgccaagttaatcaaactgaagttggatattggatttgaggtgcctgggagagagtggagctcaaaggagagatcatggcatctatatagatttgtgaatctttggaacagacagatagtaattagagccatcagaatgggtgagataattaggaaaatatgagttcagccagaagcctctcctcagccccaccacttcagggacctgtaagcatggcagcagctctgagtgagggtcagtgattccagccgaggtgcagagactttttaatagcattccctaaagtgtagttacactgaaaaattgttccccaagagaaactacacacacacacacacacacacacacacacacaccacacagttccatgctcagataagtttggagaaatctatatattatttcccctgcttagagaatattaaggactgacaagttctgcagtaaagacctttttaccttcatttaattcagttttccccacaagacagccctggctggagattactctggatctgaatgtctcagggtgaaggaagcgggagacagctagctttcccagaggcatgcccgcaagtcagcaccgcagagtgcatctatctgttcatttataagatgaaaacattggggcccagtgattgcttccaagtttcatagttagctagtgatacatttgggttgtcacatactcctttgacccaatctaagaaaattccagtgatgcagcatagtgaaaccagaaacacatttttcaaaatatattgatcacagtgtttctcaaaaggccttctctgtgaccttgaattttaatcctacctctgacatgtcttagttgtatgagcttgggcaaattttctaacctctttgagcgcctgttttcttgtatataaataaggatgtaacagtaaccagtaggattattattaggtgttaccattaataaactgaggctgacagattgagacttgctcaagatctcacagctaaaagagataaagctggaactgaaactcagatctttggctccaaatgtggtgtttcctgtactaaccaaatcatttctaccagtgcccctgggattatgccttggggactcaccttaagacagtcttgctctcgagacagagaagtctgcaaatggtgtccaattcaagtctagagactggctgaagccagacagagggagtatgaggagggggcagagaatcttcagaaagacattccaaagtctcgggcctagaaaatgtttagaaatattggttcctgtgttcccctccagtctgtctacctgaatgggaaactggtggtggggccaggcatacttctttttgaacaaatacacagttaattctgagatgccaccttgattgagaagcactgtccttttctaagcaaaaatcattgccaaattaccctagaatccaccactgctcacagatctgtgcctgaaccaacttggttttgaagttttcttttgtttcacaaaactagtttagggtgggctgtgagaggaagcttctaaaaagccactgggaaagtactaaatctctgagactaaagagggcggactcagcctcacttcctccttcttctcatctgggcttcctgtcgtcacagcatgatcatattttttcacccttcacttctccttttacacaaatagccccggatatctgtgttaccagccttgtctcggccacctcaaggataatcactaaattctgccgaaaggactgaggaacggtgcctggaaaaggtaaggttgatgacgttttaacttggcttgctgtctaatgtggggtagggcgtattcttaggggtctccatatacctctctagtaaccataaaatctccggcaacttctctttcacaaatatttagtgcacaaagtaaaacagattagcaagatcctagtaacatccccaaaggcaatcaggccagaaatacttttacttaatcaggttcccattatctaaatctctgagtcgaggcattcacatgccttaattgcttcagagcttgaattactctgtgtagtaattcctgatgcctggagctttctatgcgagatgacattggggagatttcctatgtgctctggtcttcagaaaattggtcttgtgattttaaagtgaggaaagaacccacagccagagctgtctttagaaagacagctagaagacacagttctttttcatttgagaaaatttcaaaagtaaatttagtgactcccactgtggttcttcaaagccactaaatagaaaggtggctaaaaatcaaaacaccaggatgtgctcagtaactgtattttaaaaggtgaaagctagacatctctaaaggatgcatagattgttggcttttaaggagcaggaagcacattgggatcctcagcatttccccaaattatccttggtgtacaaaacatgaccactgataaatgtcacatgaaatgcacgtataaaatgcaatccccaaaacttgatactgcagtaatttccaatcatgtgctgtaactaatgactgaggttgcatggactcagcaaagtgttagcagagcttcggtcctgactctctgtgaccaccatcggaaactctatgtaagagctttcttcttccaagacctgtgagaatttcacttgattatgccctggagcagaaaggagaaagttctctttgattacacccacccatctaagtatgaggattgggaacagggcagagggctctagatttccaagaggggtggggacggggagagggctctggattcccaaaacacctcagagtttattgagccttgtattaaaaaataaaaagcagtcttttaaataaattcacttaataatcaagtggtaggtgcctcctgaggccaggcactgtgctttgggaattgtgggggagggagatgaaaaggtagaaggagaatatttgtctagcaaacagtcctactcttaaggaactcccatgggagataagagatatcatactatgcgtgtgctttggaagaaagctgagaaaaagcaaactcccagctgctggacaaacaaagaggttttgctttctcaatcttgaggagaatctgtactattttgaaattgtggttgaatgggagcaaagactgaactgaaacattatttcctgtgatgtttcctgtgtgggccagttaagaacacttaatttttaaatgaaaggattgggtacctttatattcatgaggaatgattccaagttcatgccttcacagctatggttaccaccacctaagtgacctcacctttgttcactgacaagaggcacaaactggaaaggacaaagtctgttggtccttggttttttgtgccctctgattgacctctgactgcacagaggccctcggactctggttctcctttcccactcctaccccatggccagatatggcacttggtgctggagatacaggataacagaaaagattatcatctgaaaggagttgtagagtttattatggatgacagtcacagcaatatacaaatacagtgcaatgtgctcttttctataatagatggagaacgtgcacaaactgtaggagttaggagtgtgccaaaaactgcctagagaggtgactggtgggttcactttcacagaagtatgggtttgctatggagacattctagaccaagggtgctgtatattcaaattcaaagaagtgtgtacctccaggcatgttagaaatgagagaaagcaagtgagactgcagtgtaacacaccatgtttacagagccacatgaagtggaaagccctttctcctacttggcaccagaaagtggagggcaagatcgctcaccaggcaggtcctaggtccagctctgggtggggctatgcccaccatgttcacacgacagaattgatgggatgtgggtttgaaatgagggagaagaggcaggtttttgcctcctcaacctagattttcacttagagcagaaggaagggtggagcttcttgtgaggttacagccattgttttcagcttagcttctgttccaggaagtactgcattgattcagttatagtggtttgttctgcgtccctagattagtcagcctagggcacttcttgtaccaagcaagcatccactgtgtgtagatcaccctgggccctagagactgggcacctgtcctcaggaagctcctaggacccatctgccactgcaggtgcagggcactgaagcaaagtaacccagagaaaacagacagctatgcagagcaggactccagcatggctgctggggcagaggagggaaggattgagctggaggttgggtggtcagtttgagaaggctgtctggaggtaggttttgggaaagagaaagacatgcatttgcaaagccagtggatgaccactcagagtaaaggccaggaatctctatactgagagttagaggtgagtgctctctcttcattatccatttcataagcacacagcagaatttctacccaagcaatagcatcaatatgtcatagctctgaccaagaattattgtaaaagaaaatatgacacaagcatacatttttataatcatttaaaatgagagtgctatattccaagaattagaatattggtacttcaagcgaagttagagattatttagattcaaataaagtatcttaactcacaatgagagccaataaataggagctgtcgcaactgtccaatctgcttacttttcaggtaaaatgacttgtccaaaaatcataaaattacttaatagttattcagaatgtcttctgattctctatggcatgctctttcttctacattatactatagtcccttttctaagagattttttattaagtaagcatcattagactgtattcttcatttacataaattcctagtgcattttaacataagcaaacataaaaataccacttaattgtaaatgtaattgatcttaagctactatgctagcaaactaaatacttaacatatattttattttccaaacctttttgtttggccttttctatttcaggagaactagattgaggaataggggtaagaaatgattttaatgcctcatatcttttaaaacttgttaaagtttacttgttaaagtaaatttgaacttatggcttaccttatatcaggagcaaataaaggcattcaagaattattccatagtttagtcttcttaaaataactattgtagaatctcagtatttataacatagaagacaaattgtaatgattttgagatgagaatcccttagatcatttatttatttcccatccctttaaaaaaatgacaaaattcagactgataaaaaggttgaaaaaatattatgaaaaatttctaaatccttttcacccagatttccaaaatattaacattttacttcatttgtttattctctggctctctcatttgacagtaattagtaatttgattgatgccctttcccctaagaatgttagtgtatatttctacaaacaaatgcattctcttatataactactttacaatgatcaaaaccaggaaattaacacttatgcaatataattaacaatctatgtactttattcagattccaccaattacctctttaatattctttatagcaaaaggaaatttctagtcacgcattgccttcaactgtcacttttgtctcctttagtctggaacacttcctgaatttttcttgccattgatattcttgaagagtaaggtcagttcttttttagaatgtttctccatttgggtttatctgatgtttcctcatgattagattcaggttatttaaatttttgataggaataccaacaaagtggcttttcttatcccacaaagagtcttgcttaatctgagcatagccagcctgcagacaccatggacaggcctctagccgagggaccccgtatgtaaagttctgcatatttctacctaggaggacggagaacctctggtctcttgactctgtaacagtgctaactgttttaggtaactgttcctgatttacgaagtaagcttattagaagagtccctgtcccacctcagctgttattagtatcttgctaagctcccacatgggaggaagtgagcttccaagatcatctggatttgtctttcttcactttttctctcctcttttcttcttccttatttctctcttcttctataaatcgccaaatcctctcccctaacagcgacctagaagaaacaaaatttttatcagattacaattttaggaaggaataagataacagatattccttgattagttgatggagagatgagtggacacgaatacatgagagttgatgctttggcttcgttttattttactcctacttcttcctctacaactgcttattactcttcaaaaggacgtacagcgataactttgattgcacctcagccactgctcacaggagttcaaacgagctgatgaaaaatggaaggtcttctcctggatgctcaacacattgcaccaaatgagttgggaagtaataggcacaaaaccagagcctgggacggtggaaagagcatgggctttggaggctgaaagaacttggccttcaccctgcctttgatgattcttagctgggtgaccttgtgccagtcctcggcttctctatttgcagaatggggctaatgacacctaagttgtcaggccgatttgaggattataaataagacatttatgaggaacttagttattttgtgggattcagtgaactatctattatgtatctcagtttgtttgagcaaggcctacatttgggagccctcactggggcagattttcgctcctatttagaaaaactttttcttaatcacagcctcaattgtctttgctaaggaacaaagactgccacaggctctgtgtaggaagggatagggagccgtaattaccttgcgaatgctcttgtatgtaaattgacaatctgtatatagagaaatgtatatggagaagtgtctggaaagacgtttgccaaaatgctaatgatggttatctctgggaggtgggatttcagaagattttatgctttcttctttatacttttctttattttttaaatgtagaatttttttttaaagaaagcatgcttacatttgctttctattgctggatttttcaactttttctaataggtttgaatggagtaagaaatgtgttctaataatatatattctcaatcttagcttacaaaggtgtttctctaccaaacacttccattcactgaaagaaaacaatttatgcatcttaaagaaactgtgcttacatttgccttttattgctgggattttccaacatgtcttaacagagttcagtggagaaagaaatgtgttctaataacgtattctcaatcttagcatacaaaggtgtttttctattaaacgcttttcttcactgaaaggaagtcttacagaaactgtacttgcatttatttatttatcttttattactgaaatttaacattttcaatttgttctaataggtacaaatggaaaaaaaacatgtgcttttctttattgtttgatttctttttgtttttttattttttttacaaatggcacacgaaacctctttttaaaacgtatgaaacaagcaagggattattcttgccccgtgtatgttttattcctaaaaatctgttagaagctaagggttacccttaggaatggactggtaggtaaggtctgaacttgatctttcagtgagttttcactgaataaggcagatacacagggactgagccatcctggaaatagtatctcatttagccctcagaacaacctctgaggtaagtattaataaccctatttcaaagatatagtgaaagacaggttaagcaagttgcccaaggtcacacttctgataagtagcactaacagaattcaaaactagacctgtctgattccaaagctagtgtttatcaaactgtgttccacagaatactatgttatttgacctgttaataagtgatctgcaacataaaactaggtttgtagttatataaacatatttttgtcttagagactcacagtgcacattagcatataacaggtttttctcttacactgtttttttttctttatcttggcttttgtttgaggagcacttactaatatctcataagcgtaatggtctatgtagcaccaaagctgtcttatgtggctccagcctagcttgtaatattggatcagataaggctgaagatgaagaactgatagaggttcttttttttttaacttaaaaaaattttaaaatagagacagggtctctctatgttgttcaggctggtcttaaactcctaggctcaagggcttctcccacctcagcttcccaaatggctgggattacaggtgtgagccaccatggcgagcctgatcgaggttcttgaagcctctatccaaccttaaccacttctaagcttgattaaattcaagagtagattacatggtgctgttagtacaggtcaaaaaaaagacagggatggaattagaaatccgcaggttctaccagctcaagcccattggaggaaactaaagagcaaagttgatccctaacctccatgttgagttgtggaaggtagccacagttaagtgcagtttggtcacgcaggtttcctggaaactgatattggtggctttttgcatagaaccatgagtcatgcatctaagagtcatagactttgactgtgggaggggtgtcagttcctctagatggtagttggaaggggtgggaggcttaatcactgcccagtaacagtgaaaaggggaaggggaaacggagcagcattctctctggggcccttatggcatgtggcaaaagtagtgacaatcttcaccaggtgagaagattttcttactcaatttagtatgagtctggagaggtagaaagtgggagaggaaggaagaagaggttcttcttcctgtctgtgaaggaaagaatcagtaggaatgtccctaagtttgtgggcacctagccagctggtgttctgtggacaatcaggttacacgggcctgaactaattgtcacaggataccaggatgttggggctgatgtgactctaggaggcatctggctcaattcctttctgttactgatgggtgagttagttattttcctatgtccaaaacatcagtttattagcagactgaaaattcaagcccaaggctcctgactctgcagtgtcatgttcattccactacatcagataattctgaggtaatgaggctttgagaattcaaagatgaatagcatagatcctaccctcaaggagctcacattctagtgagggaatagtcacttataaaacaaaatggttagtacaatggcagaggtacacaggtattacagatactccttagggcaagtgagggttgggtgtgaagacttagacacaaacagagaggacttcctggaaaagtgacacatcattaggatgatgagtaactaaccagaataagaggccagaaagaaaagagaaaatttcagcaaagaaacacattaccaaagtaaggaaggaagcattaagacaaggattcaatattgctttgctaaattttaaagtataatacagggggtgttgccatgagtgtggagtgatggacaggagcaaattaggaggggcctttgacgtaagtgtacatgcataaatccatcaccacagtcaaaacactgagcgtatgcatcactcaccacagattgttgtggccttctgtaatccctttctctcacccttccctgctccctctctactcacctcctgccctcccccaccttcatcctcagacagtcattgatctgctttctgttgctatagattagttttcattttctaaaatgttatataactggaatcatacagaatgtactcttttttatttaacctctttcactcaccatgattatttttacattcacctgtgctgtagagggtaacaacagttcattctttttaattgctaagtagtttccattgtaaaattataccactatttatttatacattcacttgtttatggacatttgggttgcttccagtttgggctattacaaataatactacaaaactatgaaccttcctgtactagtcctagtatggacatatgctttcatttctcttgggtaaatacctaggagtagaatggctggatcatatgataagtatatgtttaactttgtacaaaacgagcaaactgcttttgaacatggttataccattttacattcccaccaacagtgtataagagttccagtttcactacatcctcaccaacacttggtgtggtcaggttttgaaaacattttagccattctaggagatgtggagtggtatcttaccatggttttaatttgcatttccttaatgagtaatgaagtagagaatttttttcatgtccttatttgccatccatatagtatcttctttggtgaattgtctgttctgatcttttgcccattttaaaaattggattgtttattttcttaccattgagcttcaagagttgtttttatactctggatacatgccttttatctcctgtgtgatttggaaatattttgtcccttctgtgccttgtcttttcattctcttaacagtgtcttttgaagagcagaagtttttaattttgaagaagtccaatttatcaacttattgtgcttttggtgtcttatctgagaactctttgcataaccaaggttgcaaatatttccttctggagaattatagttttggattttacctttagatctatgattcatcactagttacgatttcgtatggagagaggtataaatgcaagttcatttttgcatattaatagacaattgttccagcaccatttgttgaaaaaagtattcttcattctgtaatatattaattttgtattttttttgaaaatcagttgtccatatgcatatggactctattctgttctcttgatatatttatttaacaccagtgctatcctgtctttattgttgtagttttatagaaagcaatataattaggtagtgtttgtactccaattttgttctttatcaaactcatttttactattctaagtcttttgcattcccaaatgaattttagaattaatttcttgaagcctacaaaaaattctgctgtaatattgatggggattacaatctatagataaatttggaagaattgacatcttaaaaatattgaattcctggtagatggacgtggtatatctctccattatttgcatcttttcaatttctttcagcaatgtttgtttttaagttttcagtgtacaattctttcacaacttttgtcagatttatgcctaagtatttcatatatgatgctattgtaaatgatacttttaaaaatacttgatttctaatggttactagtgcatagaatgctattattttttgtggattgaatcttgtttctagcaaccttgctacacttacttgttagttctagtagtatttttgtagatttatttagattttctacaaagacattcatgatatctgtgaacaaagccagttttacttttttttctttccagtttggatgccattcttttcatatttcatttgcactgcctagaaactccagtacaatgccaaatagagtagttaagagtaaacagacttattttcctccttatataagggtaaggcatttggtgttataccattaagtatgatgttcttaattctatgcccttcataaatgccttttataagtttgcataagcgttcttctattcctagtttgctaagagttttcatcaaaaatagatgttgaattttgtcaaataaatttcctgtatctattgagatgataatttattttctctttcaattcattaatatgactaattaagtagttttttcaatgttaaaataaccttgcattcctgagagtagccccatttgttcataatttcttatcattgttctatatcgttagatgctttttactaaaatcttgtttataattttcacatcttgttctgaggaacattggcccgtggttttatttcttgtaatatctttctgcttttagtatctgaaaagtctggcctcacaggataaggtagagagtgtaccctccttttctattttctggaagacttgatatagaatcagtattatttctgccttacatgtttagtagaaatcatcaataagacatctggactagcagttttctttatgggaagacttttaaactccaaattcagtttcttattagagataggattattcaggttatctattttttgagtgagatttggtaatttgtgcctttcagtgaattcatctatttcatctaagttgtattggcatgaagtcatttattatattgacttatatttttgatatctatagaatttgtagtgttgttctctcaatcctaatattgataatctttgttctctattttaaaattgattacctgtgtataagtttatcaattttatcagtcttctaaaagagccaacttttgtggggtttttaaaattgttcttctgtttaattgatttcagtgcttatcttcattatctacttccttctgcttattttgggtttagtttgttatactttttctagtttctcaagatgcaatctgaagtcattaatttgagaccactttcctttcagctatagacatttagcactaaaattcaccccaaaatattgctttagtgacattcccacattttcaacatgtttttaaagtttttctcaattcagaattctaattttctctttgatttcttctttcatctatgaactatttagaaatatgctatttagtttcccaatttgaggaaactttctagggatatttctgttattgatttctaattcaattccttctaaatttgttgaaacttgatttatggtccagaatggtctatcttggtaaatgtttcatgtaaccttgaaaagaatgtatgttctgctgttgtggggtggagtgttctatcacaatcagttagtttaagttgactgatgctgttgttcaaatatttactgcttttctgtctactgattccatcaactattgagagaaggatattgaactattcaagtataacttatacttgtctatatcttctttcagttctgttcatttctgtctcataaattttgactaggtgcaaaaacacttaggatttttatgttttttagctcaatcagtccctttataattataaagtaatcttctttatccttgataattttttctgtaatagtgtttgttttagtctaatatagacactccagcctttttttcccttttattagtgttagtatggtatatctttttccatccttttactttaaaatgtattcgcttctttatattttaaatgcattttttgtaaacaacataattgggtcttgttttttcaatccatctatttattcctgcttcatattttaagtattcagaccatttcatttactgtgatattggtatggttgggattttagcatatttgttttttatttgtctcatttttctacttgttctttattttttcccatttgttgttaccccttttctctttttctggcttcttttgattaatcgagtattttttaagatttttaccttcaagtgagatttccactttacatataagaagctcacagtagtatacttccatttctcccttcccagtctctacactattattatcataaagtttacttttacatttattattaatgcaatgcaatactgttactatttttgtttgaacagttcagtatctattaaagagatttgggcaggcgcggtggctcatgcctgtaatcccagcactttgggaggccgaggcgggcggatcacaaggtcaggagatcgagaccacggggaaaccccgtctctattaaaaatacaaaaaattagctggacgtggtggcaggcgcctgtagtcctagccactcgggaggctgaggcaggagaatggcgtgaaccagggaggcggagcttgcagtgagccgagatcgcgccactgcactccagcctgggcgacagagcgagactctgtctcaaaaaacaaaaaacaaacaacaacaacaaaaaaagagatttaagacgaggtgcggtggctcaagcctgtaatcccaacactttaggaggctgagacaggcagatcacctgaggtcaggagttcgagaccagcctggccaacatggcgaaaccccctctctactaaaaacacaaaaaattagctgggcgtggtggtgcatgcctgtaatcccagctactcaggaggctgaggcatgagaatttcttgaacctgagaggcggaggttgcagtgagccgagatcacaccactgcactccagcctgggtcacagagcaagactttgtctcaaaaaaataaaaataaaaataaattaaagagatttaaataacaagaaaaaaagtattgcgcatttattcctgtagtcaccatttctggtgctctttgttcctttgtgtaaatctgtagttccatctggtctcatttttcttctacttagaggattgcttttaacatttcttgtagtatggatctactgatgaggaattctttcaccttttgtatatcttaaagtcctttttttaagttattaaaatgtatttttattgggtatagatttttagtatgacaattttttttctttagtattttaaatgtgttgctccactttcttccagcttgcctgttttccaataagaagtctgctcttatccttacaattgttccttagtccataacatgtctttttttcccctggttgttttaagattttctttttatcactgttccttgagtactttgattataaagaccttagtgtagctttcttcatgtttcttgtgcttggagttgattgagctattgagcttcttggttccatagggatattattttcatcaaatttaggattttatttagtcattatttcttcaaattatttttctatctctcttctctcctcaattttagagactccagtgacatgtatattaagccacctgaaattatttctcaactcatgatgctctgttcatttaaaacattttattttctggccaggcatggtggctcacacctgtaatcccagcactttgggaggccgaggtgggtgggtcacttgaggtcaggcatgtgagaccagcctggccaacatggtgaaaccctgtctctactaaaaatacagaaattagttgggcatggtggcacgcgctgtggtcccagctactcgggaggctgatgcagaattgcttgaatccaggaggtggaggctgccgtgagccaagatcacgccactgcactctagcctaggcaacagagcgagactctgtctccaatatatatatatatatatatatattttttttttctgtctgtgtttctttgaggatattttctcttgccgtcttcaagttcgctagttttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctcgatctcctgcccttgtgatccgcccgcttcggcctccccaagtcctgggattacaggcgtgagccaccgcgcccagcctatttttttgaaaacatagtatctggcttaatggctttactaatctaacacctgggttggttttcatctatcgccatattataggttgtactttcttgcttcttgcatgcctgatattttgagtgaatctatgtgtaaattttactttgttgggtgctaaatatttggcattcctataaatcttattgagctttgttttaggatgcacttaagttacttggaaagtgtttaatattttgggcccttactcttaagatttgttgggtagaacagtgttcagtctagagctatctgttccctattactgaggccacatccttctgtgtactctagcctgtgaatcttggagttttccagtctgactggtgggaatagtcactggtgctgtgtgaatgccaggcactgctcagatggtacctatccttgggcagttttgtacatgcaggtgctaatcaggactcagctaaattcttaatggacactttggtagactgaataataggccccaaatatgtccatgcaccttatagggcaaagatgactttgaagttgtgattaaatcaaacatctcgaaatggggtgattatcctggattagccaggtggttcttatctaatcatatgggcccttataagaatgaagcaggggataagagtggaaagtagcagatgtgatgacaaaagcaagaagttgcacgatgcaagaaaggaggtaaggaatgcaggtgactttagaagctgacaaacacaaggaaacaaattctctccctgagtccttaagaagaaatgtagcctagccaacaacctgaatgtatacttctgaccttcagaactgtaaaataataaatttgcgttgctaaggcacgaagtttgtggtaatgttttagcagcaataggaaactgatgcaagcacccgctgcgaatctctggggtttgctctctgtgcacctttcttttgtacattgcggtgtcctgtaaaccctagctgccttggtctcctcaaaatctcagctctgccaggctctccctctatgctccatggtttggaaactgtctgtgaatataagctgaggcaatcacagggctcacaccatttatttcccgtctctcatgggtccgtgcccttcattgtctcacattcagtgttttgcagaccattattttatagtctacattttttagctgtttcaggtgagggggtaaatctggtccctgttaatccattggccagaggcacatttcccaaatatatgattttatatttttacgttaagaaaaggaaaatgaaaaaggtgaaatgaattttaataacattttagttatctcaatatgtacaaaatactataatttaaaaatgtaatccatattgaaaaattactgatataatcctttttgtactaagtgtatattttacacttatagcacatagtaattcagactagccagattctaagtgctcaaagctgtagcacagctctagggtacagtgaatcatgagagtctgtgtttagctgctcaaggggactacattcatttgaatgtttcagcttttatgtcctccaccatgaaatattctttgatcaacccagctgcaaatctttgcatcttcatggcctttgttactgttctttgggacttgacatattttatcttttattgattgatgtagcttgtgcaaagggcaacaggaaggattctcaagaatttggaaatgaggactggcaaatgtcacattctaagagttaatttaatttttttaaaattctagataaaatgaataagattatttattcatagatgtgtcttactctatgagatattttgtcagtgtgatactgataaagggctgggaaacactcaaattcatcattcactcctgataaacagagtagttctttaagactcaataattggccgggtgtggtggctcaagcctgtaatcccaacactttgggaggctgagacgggtagatcaccaggtcaggagttcgagatcagcctggccaacatggtgaaaccccgtctctactaaaaaaaaatacaaaaattagccgggcgtggtgacgggcgcctgtaacccagctactcgggaggctgaggcaggagaatggcttgaatctggaaggtggaggttgcagtgagctgagatcatgccactgcatgccagcctcggcgaaagagcaaaactccgtcaaataaataaataaataaataaataaataaataaagactaaataatcatgggttcaatttattgagtaccggtcttgctgtatgccagtctgtgtgataagatcatttaatattcacaaccaccctataagggataagtgttggcccgttttacataggaagaaattgtgactggaactgttaagttggtgtgcaattctcacacagctgtttagaggcatatgtaagaggaaaattcaagtttgaccccaaagcctgggtagtaaatcattacactttacttctgatatatattcaaatgcatttataatctaatttattttattttattaaagtaatcatgtagatttaagaataatcctgaggagtaagacaagaagaaaagaggggaaaagagcacaaagtaaaggaaaaggatatgagatagatacaagtatttggtgtttacaacagagaaattcactttattgtggaagagaagtagctcatcaggcttatctacagcctggatgaactattccctcaagaccatgtgattcccaggtaccttgaaactgcaaaggagatactatggattgcacaagtgacccatgcactggaaaaggcataattttaatggaaaaaaatcactgccccaacattctgcttgatatatcagtcctgtgcacggttttaaaaatgagtcactttatagaatatcattacctctgacagaaaattcaaaattctggccaggtgcggtagctcatgcctgtaatcccagcactttgggaggccgaggcaggcggatcacctgaggtcagaagtttgaggccagactaggcaacatggtgaaacttcgtttctactaaaaatacaaaaattatccgggcatgatggtgcatgcctttagtctcagctacctgggaggctgaggtgggaggatcacttgagcctgggaggtgaaggttgcagtgaattgagattgtgccactgcactccagcctgggtgacagattgagaccctgaaagaagaaagaaagaaagagagaaagagaaagagaaagagaaaggaaaggaaagcgaaaaggaaaagtcaaaattctgtatctggatttctagaattgagaaccagacattggacattgatgtcctcactaagaaaatgatattctagttgaaaaaaataaagcttacattgctatctctttttacttccccattgcatatttgttggcttgttttatctttgctgtaagactgttgtcttctggaggatagctactgcttagtcatggttgcatcttccacaacatctagaacagaaaacataaatgtttctgcaataaaagaataaatgaggcgtggatatgttccccctactttcatgtggagaagtttactgatcaaatgtagcatgtacataaatcacagagtatttaagaaactggctgatcaagctgttggcttttttgatggctgattgaccagtccatccctgacttcaagggcttaagtgcccaggcactagttgctaatgctgcagttagagctaaagcactggcctggtctctgtcactgtgactcatcctcttctaagaatggctctattttcttctacaatacttaattcaatgttaagcattgttggcttgccgaattgggcaaaaactgaatgtctaagatgagccagttggtatttcagtttagaactaggaaagcgcagagtttggggaaactttccagaggagagccacagctcaaacccaaggtaatgctagagatccctgaacatttgtgcactctgatctctggctaccttacagagtgaggtaacttactttcttcttccttattccttagggcaagaatatcacggcatgggcatgagtagcttgaaactgctgaagtatgtcctgtttttcttcaacttgctcttttgggtaagtgtatctcttctgagcacggtttagctcacctttacccagctaagctctcctcattcctctactgaagaggctggtgtggggtaaaatgcatgcgtgtttgggtcatgtccagcacaaccatcctagaaacaaaagagtaataatttttcccctcttcctgccacagaataaacctgcaaaattgaaaggtaccagtgcagttattaatggaggtgctgtttctctctgagggctttagtttactactactcatagctaacatatataggtgagaaacctgagactgtgctctggatattgagtgcctctgtttttcttgtctttttttctagattccttgaaacaataagtgattgaaaggaaagtcaccctttccagggaggtttcactgtataaaattcagcaattgaatttcagatataggatgggttggtacttgtgtatatgagaagattattataagtttggcttctctagttttctgcctagcaagatgagcttcctcaagcagggcatcttctctacatggtcatggtttctacagagaaagccatgtgtgagcgactgaaaagataaggaaaaagaagttagacctatatatggtgaagatattgtgtggctcacagaagtgatctttccttggtatctggagatgggtaggaagagttgtgagtaggtctccacatgagaaagctgagattgcctctccaatgtaagcatggaaaagtttggtaaagaaattgttcatgagactcttgattgagccagttaaaaataaagtgattctgatctcaaggaagtgagaatatgaggagatacccaagaaccacattttgcttcaggatgttgtgggattcttcctttcagatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcggtgagtccttacagcagatgtggtgccccaagtcggggagatggtgcctaaatcccaggcaagatgtttcttggtagatcacttataggcacagaaagatcataggaaaatgagattggtacctcagatcagccaagtctgcccagaccaatagtatattatgtatgactagggtcccatggacaggtgaaagagggcattgctatcccccttgtagccatttttatattgctaataatgacttttgtcattattgtaattcccctttatagcattttattttttctttatgtctggatgaaatcaggtgtcatccatcttccaaaatcctcctcatgctagctattattatgtactttcagattctgactgagagtcgctaactaatggaaaataatttctaggctctttcctccccaaatgccaaaggatgcttccttaactcatgtctgcacaagatactccgtagagagatccaacttaggtgagggctctggctgcagccattgaggtctaatgtgagagatgctacagccttttgcatgttccctatcaggtactatcctgaggagtaccttaaggcttaggttttgcctgtaagcacagtgcctgtagagcactgagctctacatttctgtagtgttcccagaacagagcttggtgtaacagtgccactctaccaataggcgtgggtttctaatcacattggttcttccttaaatcatttggttaatcttttttccattatggttcaacattttggtggtggttttttgttttgtttttttcttcttgttgttgttttggagatggagtttcactcttgttgcccaggctggagtgcaatggcatgatctcagctcaccacagcctccgcctcccgggttcaagccattctcctgcctcagcctcccgagtagctgggattacagtcatgcgccaccatgtccggctaattctgaatttttagtagagacagggtttctccatattggtcaagctggtctctaactcccgactttaggtgatccacctgcctcggcctcccaaagtgttgggattataggcgtaagccactgcgcccagtctgtatgggtcaactcttaaactggagccaagagaaagaattttttaaaaagtccctcttctcagatagttgtcagactaatggcaaaggatggaagatagcagacatggggtaaggtaaatgttttaagcagtcaaaattaatgttggggtaaaaaaggtgaaggagaaggaataagtgaaaatgttttctgttgtgtgttattagcataaaaggagtaagcatcgaaagctggaaacaaatatgagttagaaccatggctaggacccttctttctaccattgtacagggctcctctcagccactaccagcagtcctccacccagaggtatccctgatcttgtagaaaggaccaggccccaaatgatctagtttaccaaccttttgcttaactgcttcaataggcagatgtcaaaattgcttaacttattcaacaggtggtggtgtgtatgtattatgcatgtagtgctctgataggcacagcaggtaggagagagcaaagaagacagttgatctgccctctagagtctaattgtagaaaaagaacacatattttcacaaaacaaaagaaggcttacaacggcctgaggaggcagaacaggaacaccctgtacgcgtgcaaatgcccctggatgctcccagagctgagtgggagtgggacgagaatggggatcagtgctgtgagaatgtatctgctttgtcccagttcttcatcctgctgctgattatcctccttgctgaggtgaccttggccatcctgctctttgtatatgaacagaaggtaagttataaagacaacaacttattgtcttaatactgaaagtggggagtatgcagtggagaagttggtacaaagttacagaataagttctataatagagatagacatgaagtggaaggatagaggaaacagagagtaattgtaattggggggaaaaatttgtatgaaagagattgtatctgagtggtatcttgaggggtgcctggaaagagcagtaaaacaagtgtctcttcctctacttgctttcctctgtgtgtttggcaggagagaatgtctgcctcagtgcctaaggatagcccttgctttaattgctccttttcctcccttgtaaagccagagctctagaaggaagcaagcctactaaatacttcttccttcaatgccacctcatgctcagcatgtatgcccatagataaacaccctcccctcacccttagttctgaggagaccatttggaagggaagcgcaagtggaaccactaacctatactggaaattccttattccttgaactcacctgctttttaccatgtctcctctgctggaatgtgcctgcccagctgaatgagtatgtggctaagggtctgaccgacagcatccaccgttaccactcagacaatagcaccaaggcagcgtgggactccatccagtcatttgtgagtacaggtggaatcctcttcagatcagcccagacttcattttcaagcctaaatccttgggggctagttcctttttctggaagtttcagaatctaaggtccacatccctgaatcccagaataatgccttggctatcacaaacatgggagcccagtaattagtctgattagtacaaagttctctacattctctctttcatccttttctaacatgaataggtttattttctaagttctgctaggatgtgaagaagacccaaacacagcaaactggattagtttatgtattttccaaaattttactgaaaacagcattgtataacacaagaaattgccattgagttcccgagttgcccaaatcaggcttgttacctagcccaccaacatcccattcctcatgtgctgtttccacccacaaacgtgtatatgtacagcatatacaagctctgcattcctgacatgatgtgttgggagataaagatggagccttgcaccagtataatctatttgtgtctcgaaacagtaccactatgaaagcacgctggcttagtgtggagtagaagaaatggcacaggaattagagcctggagaccagaattgggtagccctggggaagtcacttaacttatttagatctccaattctttatttttttaattcagtttagaaaactttttattacataatttttagaaatatacaaaagagaaaaacagaaaaatgaatctcccaactcctcaatagttaacattttccagtgtcatctcatctaattccccacacttttttcgttagaatatgttaaagcaaatactagacaatatattatttcacccactaaatataaaagaacttctttttaatacacctaaaattttataatttcttaataccactaataaagtctataattaaatttccctaattttctcaaaaaattttaattgacttgttcaaatcaagatcttaacaaggcctatgtgtttatatttgaatgataggtctctctatttatcttttaatctataatagtacacctctttgttcttgctctttgtggaaagaaattaggctatttgtcctttagacttctccactctctagatcaggctagttgcttcctcgagtattttggtatcagggagtctctgtctcccataagccccatgaacttaaaagtttgatgtggtttttgttttgtggtaagactgccatagctgtcacttcctgttgcatcgtgtaagcaggtacataatgtctgatggtcctcctttctgtgatcttaagattggttggtgggtccaggggtggtcagcctaatccctccattatgcagtccctgggtgccttattcttgatctgtaaaatgtgactagattaagcacaggggtctctactccacagggatcttatgtgaatgaaatggtataacagattagaaagcactttgttttaaggagcccatagcaatcagaccaattctggacttctgctatagagtcagatctgaagggcacaccttttcctctaaggtccacagctttttttcactgttgactttctaaccatcatcattttgggggtttggcttttagctgcagtgttgtggtataaatggcacgagtgattggaccagtggcccaccagcatcttgcccctcagatcgaaaagtggaggtaattttgtcggcaatgtttctgttattgacctctttgtttaaatgtttaattacctcggaaactgcagtcatagaggacctagaccttctattgagaaacaggggaccttgaataaaagagaggccagggcaacaaccttgggtaattagaaaagtcagaaaaacatacgaacaaactcatttagactagagacactgtgattgatcttgctacactagactattacattagaggggaacagttacttttgtgtgaaagtaggagagggttgtgtctagatatttcttaagcaagaagtaggtctccttatggttaaagtgaaatgtatagggttgagatagaaaagtttctccctctccctctttctctgctcttcttccttggagatggcagaatccagccccttagggaaatgaatcataggtgaaggagtaaggagttgagggagacagagttagtggaactactgaaacaacctgtccaattaatttggacctccagaataggctctgagaagaagccacaactatcttccaactagactgaatccctgaggtcttgtctcctcatgttatctgctcctgaaggggtttggaaatctccagggtttttcaggtttgtggagaaagactaggacaaccactgaccagcaactgccctggcacttggtagggctatgatggatttactgaatgttgaagcagaaagtgaaatgcaaaccaattttagtattgcatgccctatgttaatctctggtcagcactgagtgttcaaagacagtaggacgtcggttgctgacctgcctcttagaagctagtttaactcagcgggtaaggatctaggacttctacattagttaccactgtaatgataacaccaccagaaaagtctgtagtttaatatttcccaccttatgcctgtttcttcattcacgcaaagaaaataaaaatataatacctaagcctctttgtattacataaagcaaaatgcaaagcactgtatcttccaaatacttcctcttgatatggtggaattatagagtagtatcatttgtaactgaaatgtcttctagggttgctatgcgaaagcaagactgtggtttcattccaatttcctgtatatcggaatcatcaccatctgtgtatgtgtgattgaggtaagagcttaaccacagggttattgtgaggattacatgagttaagtcaggtaagatttcagaataataccaggtacacagtatttacacaataaatgttagctatttttactaatatatgaattcccccagccaagtagcaaataatgtaattaacaatttgctttaaggtatatagaaaatgtgctataagaacatctcttggccgggcgtggtggctcacgcctgtaatcccagcactttgggaggctgaggcaggcagatcacgaggtcaggagatcaagaccatcctggctaacatggtgaaaccccgtctctactaaaaatacaaaaaattaaccagacgtagtggcaggtgtctgtagtcccagctacttgggaggctaaggtaggagaatggcgtgaacctgggaggcggagcttgtagtgagtcaagatcgtgccactgcactcctgcctgggcgacagagcgagactctgtctccagaaaaaaaaaaaaaaaaaagaacatctctctggtcaattcattcctcagagatatgagtgattcacatgattcacagtcaaacaaaaaagccaccaagcagaatcccactgtgatccctcctcagctggtctgaaaaatacgaattgataaagtatttcatttgaaaacctgatcttgcatgttaaggggctgatgacgaaaattgtaatcaatttcctctttgtttctgtgcttagtttgacaagtgatgggtgaattgagggtagttttttgtcctttttaataaaaaaggacaaaaataatgtgatatttctaacatttttctacccaagtgttgggtatatcatagattagttaaaactcaatcaggaagctcagagaaaatgatttttctctgtttggaaacaaaggaggcacagagcatggatagagataactcattgcacagtgttcagtgagcagaatatgaccatcctagcagcaaggcttctgtgacttcctcagaagataaaacatgctccagtactttacagcctgttatcttgtcatcattgaccccgtttctctcctcactgctattctttaaccaaaggaaagagctcctgagagagacttgaaagtaatggttggaagggtggtttcagtgtaatggatacattctttttctcagaggccaatcccaggcattgtgaaagaaatggcttttcttatgaagacttcaaattttcccaactcttttcacaggtgttggggatgtcctttgcactgaccctgaactgccagattgacaaaaccagccagaccatagggctatgatctgcagtagtcctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctcaatcacaacattcctatatatcaaacactccttccatgacccagcctgattaccctgattaatgcaccaaaccaggtgtattaattgtctcctgctgcataaaatattactccaaaatttagtggctgaggacaacaaacatttattatctcatggtttttgtgggtcaggaatctaggagcagcttagctgggtgattctggttcacagtctctcatgtaactgcaatcaacatgtcagcctgggctgcagtaaccttaaggctcaactgaaagaggatctactttcaggctctctcacatcgctgttggcaagcctcagatctttgccacttgtgcctttccacggggcttccttatgacatggaagctggcttccccccatttaaagacatccaagaaagggcatgagattcggcacccaaaacagaagccacagtttgttgtttttgttgttgttgttttgagatggagacttgctttgtcacataggctggagtgcagtggcacaatctcggctcactgcaacctctgcctcccaagttcaagcgattctcctgcttcagcctcctgactgggaccacaggtgtgtgccaccatgcctgactaatttttttgtgtgtttttagtagagatggggtttcaccatgttggccaggctggtcttgaactcctgacctctggtgatccacctgcttcagcctcccaaagtgctgggattacaggcatgagccacgccacagtttttatttataaccccagatgtgccaccacatcagttctgccatacactgttttaaaaaagtgagttgaattgttcagctcacactcaaaaaaaaaaaaaacaaaaaaaaaaggagattatagacaagggtataaatctgtagcacatagagatcactggaggtcatctaagaggttgccaaccccaccatatttgtttggtcaaaaaaagaagctaaattgaattgtctataagctaaatttaattatctacgtataaccacactttgtaaggcagaaaataagaccatatctaatagggagccaaatgtagagaagtcagagaaaggaatagagaaaaactggtttctgttcctgaagttttatgtatcatctcccctctccttttaaaaaaattagtatttcagtggtagtctgtagaaaaacctacaacttttgcattttcctgagacaaagaagtagcagaggagacattctctctctctgtttttttttgtttgttttttgtttttgtttgtttgtttttttctgagacagttttttgctcttgttgcccaggctggagtacagtggtgcaatcttggctcactgcaacctccacctcctgggttcaagtgattctcctgcctcagcctcctaagtagctgagattacaagcacacgccaccacgcctggctaatttttgtatttttagtagagatggggtttcagcattttggtcaggctggtcccgaactcctgaccttgtgatctgcccaccttggcttcccaaagtgctgggattacaggtgtgagccacctcgcacccggccttttttttttttttttttttttagacggagtctcactctgtggccaggctggagtgcagaggcctgatcttggctcactgtaacctctgcctccctagttcaagcaatctcctgcctcagcctcctgagtagctgggattacaggtgcacaccaccaagcctggctaatctttgtatttttactagagacagggtttcactatgttggccaggatggtctcaagctcctgaccttagatgatccacctgccttggcctcccaaagtgctgggattataggcatgaggcaccgtccccggtgagacattctcttgagtatcacaagtttcaaaagtatctcacattaaacatgcacaaaatgaaacttatcattctatcttccaaatctgcttctcttctttgttccccatatgagtgagtgataacatcacccacctagttttcctagccag

SEQ ID NO: 16498 - DNA, 52494 bp, Human
  misc_feature (1)...(52494): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcatagcctatggctagcgctgttctaaatgctccacctatgggtgtaagctgatttctgcccctttgtactttctgctgtggcaggccaatactgagctccaatgcaaaagaccacaatcactttgctctcccttcagaaagtgcacagattctctctccatgcaccatgggcactgttgggggaatgtgagaggggtgatgtatgcaatccaagactctctttcctaccctcttcaatgactcttcacttgatatgatgctaaaatcaggtactgtgatcactcacctgaatttggttcttaggaaggtactttctttgtgtatgggtagttgttcaatttgatgcttctgcagggggggatggtcactggaggcttcttttcagccattttgctctgtctctctgccataagcttcattcttatcacattcatccaacttaaagtttcccgtgaaagtcttttaaataattatgaactccttttgtaaaaaaagaaagcccacacaatttcctacccttaattaacatttcacagaacacatgttaacaccagctttgttccttatggacagatcagacagccaatttgaaatgtttggatacaaaacaatataatttagctcaacttatctgaaattaaattctccttgcctaatgtgattattgtaagtaataagtcaaataatgtaaaataatttcaagaagcctaaatcagaaaaagacagcataatacacatagtgtttaacagcatggactcaggtgtaagactgtttgggtttaaattgctgctgtacctgttattagtagattgactttgaacaacttacttaacttctctgggcatcacttctctaatctgcaaaatgactttaattacagtacctacctcatctgtaagtggtgataaaaatagtacctgctttcaaaaattctaatgaagattatatgttagtaattatgaaagtacttgaaatagtgcccagtatgtatcatattcatgtttattcatacaaataaacataaaagacagtttttaaaattgcttggaggcatacacctttggaaataagctaatgtgctttattttatgggatataaaatatattatatagaatatttattgtgtatgtattaaactatcctacaaggatgcttaaaaacaaatttacagtcaaaatagcagccttataccatgttctgataatttttttcttcctaaatgtttcatgatttcacctttttttaactgctcttctttaaatgcattttaaagtcatgatattcttgtaaatttatatatgagtcacatatacctaaagaagtagaataactttatttttttttactattctcaactttattaatttgaaattccatttatttatttttctattttttatgtatatatgtgaatgatctattcttctaggtatggccaggattaacagtataccctgatttcactaatccaaactgcattgattggtgggcaaatgaatgcagtattttccatcaagaagtgcaatatgatggactttggattgtaagtagctattttaaaccaatgattttggtcaatgaccatagacttatttatctgtaaaaattactaagtcaacaaaatatttttttctgatgtattcaatgtaaaatttaaagctactataatgttttttcccagaatggataaatatacccatcgtgtgcataagtaagaaaacaaaacaaaacaaaaaatgccaatcaaggtttttcttttttagcaatacactgtatagaataaattttatttctgtatgcaaggttttgttcctttatgactaatactttacctgaaaattagttaataagatttggtgataagcctattgcagtgcaattagcaaaacatttattaaagttgacaacagtcaagcaacagcagcaatatgatctgaataagcccctgccctttagagacttctctttagtaagctatggaagagaataaataaaaattggcaataggttaagtattactatatctcaaaaaagcaacaaacagaatcctagtttgctcataaacttattaaagaaaaatacagtcttgtgtgatggctcatgcatgtaatcccagcactttgggaggctgaggtgagccaatcatttgaggtcaggagttcgagaccagcccgaccaacatggtgaaaccccgtctctactaaaaatacaaaaattagttgggcttggtggcacatgcctgtaactgaggcagaagaattgcttgaacccgggaggtggaggttgcctgtgagccaagatggtgccactgcattctagcctgggcaacaagagtgaaactctgtctcagaaaagaaaaaaaaatacaagtgtttaagagtttctttaaatgaagttgtgtatctgtagttattgatggcctgctgctagggatagaaactaaattaccactggcaagaatttggaaaaagtacataatggacacactaaggatgactatattttctttggtttttaggtccacaccgtctctattttccttaagtgctcattattgattcaatcattattctaattattcacttatttattaaatcaatcaatcatttagttagcaaaaatttattttgcaccgtgtatctatcagacatgttgttgggaatacaaagatggaaagattatgtttctgctgacaacatggatttgggtaaaggattagcataatcttcaggattcctatgatgacagtaacaaaatgaagatgaaaagccttcagttatttaacataaaatcagtgatatcacaccactaataactagcaattggtagaaataaaaaaaatttactgtgatcttgagctttatttttaattctagttcttatattatttaacctatattgaaagtttctttagtcttttatttttttcttagttaggagccactttgattacggtaaagttacaagtataaataatactgtaggaatagtgagacagagcctgattgtgttatagaaagagagagtgttgcatttcttgcattcattgagaactgaaattcctgattcacctccaaagtgtgggagagaaggttgtctgagaaaggcagagtatttccaacactgctacagaagcactgtaactaagccttaaacaaacaaacaaaaaacacaagaagcagtataatttcaaagatcagtgaacatcagtgaactaatatatatcatggataaacagtggatattctacttttagctattacttatctacttgccatatcacactgctaagtggtttatctaattatttcactttcttcagattattgtttctgatccagctaaaacaagttgttattcaactgataaagttttaatatttatgtcaagtataaaaatagttttataatttactagatttgtaatttagtttccatgctaatatttgtgaattttaggtttaaatattaaaatcactttgggaaatgatgtgagcttaattgtcattgaagtatagtttttgtgtataaaatataataaatttgaattctctttttttacatcatttatgggataatcgaatagttgagaaacaaaagcctactgtacttaatgtaattaagaccaaaactatgatttcaaaacaaaagtgtcagtcaatatttttaaaattaaaataccatttccattttttgaatacatatgcatattttgatatcattgttgttattttggttctattcttaaaaatctaataagcaaaattattcaatgaaaaaactgaataatttaatatatagtatttggaaacataaattttataagaagatatgcccaaataagtttacatatccaaataactagaagcttatttggttatattctttctacatttcatgtgaatcttataaaaatgaaattcttttacaaattcttttaaaaatagggctatatatatttagatttagtttaaatgtgagtataaaatgccatcagatcactatcacaatttttaaggaattttaaagaaacttgaggtacattctcagaaacaaagttgacgatttttttttgttttttgagactaagtcttgctctgtcacccaggctgtagtgctgtggcgctaacttggctcactgcaacctccgccacccaggttcaaaagattctccctgcctcagcctcccgaggagctgggattacaggtgcacttcaccacgcccagctaatttttgtatttttagtagagacggggttttgccatgttggccaggctggtctcgaactcctggactcaaaatgatccacccgcccttggcctcaaaaaatagtttttaatagacttaagatgatttgaatgacacctacatatctttagatgtttttattactatcagtccactgaggcttttgcctcatgactacaatgttccaaatctactagttgtaatattaaaaatcttaatttaatgcagtggtatatgacattaaataactgtagtttcacttaaatcatttggataaattagagaattaaaatgcttttataattttcaaaatgccacttaaaaacactacaatagataaattcttttaaaatatgggtagtaagtttaatttaatacaatcttgctatatagacatactttagacatatttaaggaaggttactaaaatattaaatgtcatgtattatgtaaaatatggttaaaattatgaaaaaaaattttgcctcagtaggttaataatttatattcttggttcaaaaaactattttcccttttattgtgagctggcaaaataatcacattctgattcaatcatgttgaaatggtcatacaataaaacttttaaatatttttaaaattattttcagtaaaaccaattaattattttctaaaaaaatttttcatccttaaattacataataatgtttactttcagtgatgaaagattttgtgaaatttatggcaaatttacacatatttaactcaaatagaaatgatattaatatcatagatgagtgttttacccttgcaattcctcaactatattatatattcggatgttaaaattgtttagaaaaagactcttttaaaatttaaaataatgcagctcactattcccaaattatacatttcagcagcagttttttaaaaatttaatgttattggcggaatcatgaagaaaaatgtagtttacctacacttatttgctgtgtaactatggtataccattattaatttctactggacacaggaaacaaaattgaatataacattccagacaatttcaaaaaaataactcaatgtagctttagatatttttgtactttggaataactatattaatttctctcatttctgcttactctgaaaacatttgggaagtggaaatatataccgattaaacgtgtcatgataacaaatctattcttttttcccttgagcaccattaatttatcatttcaattccatgtatcaaatttccttagcttctttttatatccatagttagaaacttttatgagaatattttgagaataatagagatgaataatcatattgagtgtgcttgggtcagaggaactcaatatttatggaagcttttgcaaactaaataagtatgtctagttatagttataattttatgaaacaaatgactacaatacaaatgattcaccattacatgtgtttagaaaattattttattagtgtctttgagtgacaccatcggtctcagatattttctaatctgttaataaatattatctgggaagtctcagaaagtagtatgaaagataggtttaatgattgcaaagttaatataggagtgttaaggttaaagggaggattgaaagctgaaataagaggggaaggattcaagaagctgaaaagcagtgagtcttaaaatataggcatgatgtggatggggaaaaggaaatgtaattaagaaaatctactttttctgagagaaataaaagtaacacagacaaggatgtgactgaatgtgatgtctttatgtgaaaggagactattatagagatgagaaaaataaggcttatagaagtcctcaacacagtttgcagagaagaaagatgaaatgcatatttcttgagtatatgtactgtgatatatgattttataaaatttatcttttttagtgcaaagacttaactgggttatggtcacatagctagcaggcagtgggacaagattggggcctatgttaaaatggctagaaaatccatgaacataatatcccaccactatttcttcaagagatgtttaggtcttggttctcagagtgtgatcatgctcacctggggttctctgaatgtttcagagattctgtgaagccataactattttaattaaaatactaaaggctatttgcctttttacagctttcattcttttatgagtgtataggagctgttggtaggcaaattttgctgctagcaatgtgcttagcacatcatagaaactaggtaagtttaaatgaaaccaaacatattgaatcaatgaatatgcaaggaatgtgtatattaatggactcataatgagaagactaacagctatttagaaatgacttaatacttataattaatgtaattatatataatcaaaactagacacatgaactacattttgattgtttaaaatctctctatcccatctaagatacttatctgatatagacattctgtttatttttaggttggtagcttatatttatcttctaggaattaacgagcattatggttatcttatataaaacattttcaaacaactagagagtttctgctaataggatttataattatgtaaaatctgctgttcttcattttgtatccattcaggacatgaatgaagtttccagctttattcaaggttcaacaaaaggatgtaatgtaaacaaattgaattatccaccgtttactcctggtaaaatttatttggttatctaattactgttttaattgagaataattttgtagttgactagtaatttctaacatatatttctaaattacaatttttggtatagttctaaaaccataaaatcaatttgtttatcttttcttcagacaaatattttctgcctaggattatatttaaatagacaaatctagtataaggctttaaaattggtccataaatatatgatgtacaatatagtttggtataggtatatttctatattgttaaaggttatttttaaagttaaattatttgttatcgaagttaggaaacagagtatttgccaatgtaaatataaatctaatagttaatccaagtttagcaagagtgaaagatgaggacctaattggaacttattttaggtttaattggattgtcctttgtcattgtttttgaccaaatatggaatttcataacacaaatgaaaaggaatatgacatttatgatggaaaatatataacttttataatggaaaaatataagaaatgtttcttatgtattttctcaaagatattcttgacaaactcatgtattccaaaacaatttgcatggatgctgtgcagaactggggtaaacagtatgatgttcatagcctctatggatacagcatggctatagccacagagcagtaagtgcaatttcattcaaagacttctttcatatttattgcttaaaaatgtttttgataatttatcaatgtattcatagttaggaaatagcaaagtttaaaaaaattaagataatattttatgcctgctaaaaagttatggcattcaaaatatcagttctcttactaatattcatgaatttgggactcatttattaagaatgacatggtaggctgggtgcagtggctcacacatgtaaccccagcacattgggaggccgaggcaggcacaacacctgaagtcaggagtctgagaccagcctggccaacatggcgaaacccagtctctattaaaaatacaaatctagctgggcgaggtggcaggcacctgtaatcccagttacttcggaggctgaggcagaagaatagtttgaacccaggaggcagaggttgcagtgagccgagatcatgccactgcactccagcctgggtgacagagctagactcagtctccaaaaaccaaaccaaacaaaaaagaatgactctctctctctctctctctctctctatatatatatatatatacatatatatatgtatatatatatttaactaagactcttttttgtaactcctagatttaaattatccttcaaaattttaccatttctgaatataactgtgttttaagcttgcatctcacaattagcctgggaaaatattgccccaagaacaggtctttaactatttttcaaaaagaagtattttaattaaaacgtagttttctaattaatatccttctaactaattttctaatacatttttataaaatatgatacaaaacaaaagaagaaaacaatcatatgttcattatctactaattttcaagcattgtttatggtcctgtgatacaatagtcagtaaaccaaatactattctcaatatacttacgattttctcataattaaacagttgtgattgagtgtttattcaaatttgtatttttatggtcttaaatcatactgataccagaactcttaaccactgtattcatggtgttacttcaatttactttgtaaactcaatggagtattacatgaagcagtgtttaagttaatatatcctaggaaagaaaaaacaggctatgtttcaatataataaagattataacatggaaaagcacttgagaatgtagttacacatttcctaattgtttccaattatgaaaatgttatcaataatagttaggtaacgtgagtgatgcttgtagttgtggacagtggttaacttctagaaactaaaaaaaaaaatcttcttaattatgtaagttttatcccaaccttgcctgctaatatttgaaaatgtagaaataaatatataattggagtcatcacactacaaaaaatgtattaggttcaagttcaggtataatattttctatttataagggaattcaattactttaaatattatatttcaaaaccaaatgttgagtggataccaaatgcccatgtttatgtaatttgataaaggatgattggagtcattcaaaatttagtgatttctaaaaattccttttcactgtattttaccagaatatatttaaataagtaaatattaataacaaaatacaaaattgatataaaattttgacataattattataaatattatggcatggtgtattagcccagtttcatgccactgataagacatacctgagactgggcaatttactaaagaaggaggtttattggatttacagttccacatggctgggggggcctcacaatcatggcagaagacaaggagaagcaagtaacatcttaggtggatggcagcaggcaaagagagagcttgttcagggaaactcctatttctttaaaaccgtcagatctcatgagactcattaactatcataagaacagtgtaggaaagacccacccccataattcaatcatctcccatcgggtttctctcacaacatctgggaattgtggaagttacaattcaagatgagatttgggtggggacacagccaaactatatcacatggctttggaattatgaaattttagaatttaaataccaactttattttttaaaataaattgtatttgttaatttggttttatttttagagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggtaagacagtttcatagagtgttactcataaaagctacaattacattaatttttaatgtaatcttaattaattttagtaaaatgatcaaaaggcatgttacagaaataattcagttttttatttttatggagtttatgaggaaaataagaatacagatggtatctataatttccaaccattaaagtgggaatgtagaactaataaaattcaatgaaatcaagataattgaggaaaacaaatataaatataaacagcatagaaaagcttatatgaaagatgtaaagaaaaaaataagatggtgaagaaaagttcaaatacattggttataaaaataaatgtcagaagtctaagtctacttaaaatattagattaccagtttagattttaaaagataatcttttgtttacaatatatataaaacataagaacagaaaaaaagtttaaaatttcaaaagtggagaaaatgtgtactaggaattgtagacatgaaatatctgagaagtctaactctatcaaacaaaaacatagcatccaatattgatattcaagactaaagagagacactacataacaaaaataatgtagaaggtattataaaactatagtgatttgttttctttcatatgcacaaataaaacaaacaccaaaaacccgatcaataaaagtaacacccccacacacaatcttgtgtttgaaaattgaaaaataggctggacaaggtggctcactcctgtaatcccagcaatttgagaagccgaggtaggtggatcacttgaggtcaggagtttgagaccagcctggccaacatggtgaaaccctgtctctaccaaaaataccaaaagacgggcatgatggcaggcacctgtagtcccagctacttgggaagctgaggcaggagaatcgtttgaacctgggaggtggaggttgcacagagccaagattgggactcacttttttgagaccctatctcaaaaaaaaaaaaaaaattgaaaaacatattatcaaattcattcatgagtcaaaagataaactgaatagaattgaaaaaaaaacaacctaagaattaactggtaacaattttacttattaaatcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaaaacttttaataaaatagatcaatttatagcatatttgttaaaaaaagaaggaaaaacaagcaatattcaaatgtattttagtataaggtgtcacttattatagcaaccaattaataaactgtaaccaacagtcaatattaaaactaaatgtaggactttttgagaaaatataagtgatagctaagtaaattaaagatataccctgttcaataataagaaggctcaatatattaggaataggcattctctacaaaatgttatcaaaattttgtggaattccaatttaaacaataaaagggattttgggaaacataaaaggtgactctaaacttcatatggaaaacaatacattttaaagaagtagagaaaaagaatgaggattagttctaaccagataaagctgtagttattaacacaatgatactggactgtggatatacaaatagattaacacagcaaaataagacacaggcccatgcatgtataatttgttaaatgacagcagtgaagggaagtatcaactatttatatggactattgactcagtatttaggaaacaatataaaatgtgtcaatttctcacaccatgcacaataaacagtcccagatagattaagggacctatgtgtgtaaaataaactttatccatttcagaagaaaatataaaatggtaaatttatgacatcaggttagagaaataatttcttaagcagaatacaaggagaataaatcttaagagaaacatacataaatttgactacaacaaaatgaaaacttctgttcatcaaaagaacatttgaaaagttaaaaattaaaagcaactcaccaggaaatgttattttcaattcacatagtctataaatgatattcaatttgaagtgcctaccttaaatctgtaaaaattaagaacaatagaaaaataagtaaaagatataaacaggcaattctatagaaagagtaatctatagggacccaataaaaatatgaaaaacttctcaatttccctgtaatcagagaaatgcaagtaaaaactgtggtgagatatattttatgaagaaaggtgataaaatttgtctgaaaatatcaagaattggcaagaaaatgaagaaggggaatcttcgtgtgctatatagtgcttgcaaatggttacaaacagttccgattatacaatgcacattataagtaaaccagaaaaataatcctatgtatgtacaccatagaataagaatatgttttttacatattcacaaggatatctatacagggtgagtaacccctatccaaaatgtgtgggaccagaagagtttcagatttcaggtattttcagatattttaatatttacatatatgtaatgaaatgacttaaatgagcaaatttatgtttcatatacaccttatacacatagtttgaaggtaattttatataattttgttcaggaaacagttttgactgcaacctgtcacttgaggtaaggtatggaactttccacttctggcattatgttggctctcaaaatgttttggattttgaagtatttcagattttggatttttggattagggatgctcagcctatatataaatttcacggaagaatttttatagtcatgagttcccatatactggagaactagagtgacattaatataattgaatttcacacaaaaaggaaattacattataatgcatacaacatgtcatttatacagttaagaaaacatgcaaaacaatgctatatattgtttatagatacatatatacttacacagaaaaaataaagaaatgtttgtaaatggtaaacactaaattcaggatagtattttctggagagtccttgaataaggataatgcagtcttacatgggtacacatcgggcaaagctcaattttattcagaataattaatttcaaagctcaacatgaacacatggtcacagtttgttattttattcctacagttacatattatattataaataagaaaaatcaaatcaaagaagttgagttagggattaagaagcaaccaacatattttaatacagtaatttcatcttttacaatgaattaatgagaacatcaaaataaaaaatgagtaaaatgtaaatacaaaaggataagaaaatgcataaagggacaatgaaggaaagaacatataaaataatgcaactagagacaaggatgcagcaaaaacggaaaataaattggtttaaggaagcatatataaaaggagtaaaacaaattgtatataaggcacattcatcagttgaggcatacagtgtgatgctctaggcaaatttgagaatcttaacattataaatagtaaatatatttgttatttaggttggagcagacatctgtggatttgtggctgaaaccacagaagaactttgcagaagatggatgcaacttggggcattttatccattttccagaaaccataattctgacggatatgaagtaagagcctcttgttctccatgttgcgaaataaaaaacaaccatagtttttattaatgtacttaaattaaatctatagagtatatggtctgaaagattgtagcataattcataagacattgttagaagtccctctctcaagtcctatacatattttgtatatttttacattttttaaaaaacggtcaaataaggaaatcatgaaatgcaatgtattcacagcacaaatattttagttgagactaacgcataactgtacaagtatattaagttaccggtattttaaagtagagccaaagcttttagagtatgaattcttggattctaacaatgtaagttccaggtaacttttatacaaagaaaagttataatatactgtcatggattttgagtttgtgtttagttcatgtaaaacaagaatttaaagatagtcacaaaacaattagagtccagcgtctttcaataataaatagaactggcatagagacaaaaacaaaactaacacttttaaaacacgattttggactggtaggagcagaagtgcaagacaatacaaagctagtctaccagccgtgggaactcagcatactgtgggctcatgatcataggcatgtttttcggagagaatagtaaaattcagttaaaccattaagtcaattaagtatctgttggttaagaaaccgttcagtgttcacacactggttgcatacagggcttatattgtgtttgagaagagggacaactactgagctcagcctggaaggaggcatgatggaaaaaaattaaaaggtacaaattggagattagtttcttcctaatacaccgaaatgatactttcaggaaatgtgtgtccatgggagattttgatagaaattacatgacactctgcgttcacttgtattctccaaaatgctgatgataagacagaaataaattttgaaatttattggtgaaataatgtgaatgacaaagggagtgggcatgagaaaatgaggagagcctgcagaccaccgttcaggtctgaacttgatgaagatgaagggaaggaaggtggtttggtaggcagaatcccgaattgcgcctagttctaaccaagtttcaatcaagtgagtggggagtccttcagggaaagttgaccattgacctttcttgcatctcccaagaataggcctgcatggtgttcttactatgctcattcaaggctgggagcagcactgggaaacatggttttcagtgcaaacttaatagtggattcagggagacagtagttgaggtcttcagttaatattgttatccaaagcaagaggtctaaacaggcttgtccatatcagtgttacttggctgaaggagtcacttatctaccctgagctcagtagagaggctgcactacaaattgtaagtctacaggctgtccaggtagctctgttcactgtgttcctgagccagcaacctatctgtgataattctaatagcaatgggataagacagtaagtccttaggcaagcccatttcaagcctctgctttagtgtgtcacatgtaataacatcctattggccagagtagtttgcatgactgagcgccacatcgaagcatgggtaggcaccctccaccttcactggtagggattacaacattccatgataaaggctgtgggtacaaggaagcatgaaacattgatttacaagataaaaattctattttgtaaaaaaaaaatttattttttctgtggcaacgctttaaatatgttgaaatgtccacttcaaaattaagtttaattaaaatatataacaaaacctagaaatattcattcagacactttgatgatgaaataggaataattttaatttctcataaacaagctgaaatttatgtagttgctttaaaaagcagattaaaatgcttctactttaattttcactcatactttagctttcttattttaatttctctttctatctcacagcatcaggatcctgcattttttgggcagaattcacttttggttaaatcatcaaggcagtatttaactattcgctacaccttattacccttcctctacactctgttttataaagcccatgtgtttggagaaacagtagcaagaccagttcttcatgagtgagtactacgtacaataattataataataccttttaaagtatgttcaaacatacacagaaaagtttaatggaggtaaatcaagatatcaattaaatttctgctgcttgtttttacattggtgtaaatgatttgaagagctatataatgatgccagtaaatataattaattggacaatatttaggtagaaatgagagaattaaatagaacttaccaaggaaaagatatataaaatatgttaggatattatatcagtaaagagattaagcatagaatttttaaaaatacatcaactaaatattgaaagtataaactaaatatagatcaagagtagagtataaaacttacaaaaaagggaaattgtgcttatctttgcatgtatctttgaccagagcagggcctttctgtgatgacttaaagatccttttaaattcaggtaaaaactagagcttaccacaaaaaagttaagtgaagaaagtagaacatgaaagatttccgatactttatgaacctatcttataggagaaaataatttaacaggagaatttttgtataaataaaaagtaaccttgtcatctgtgatagatttttctgagtatgagataaactttctccttctcttttcttccttccttcttcccttccctaccccttttctactttccttccctctgttcccatcccttcctcctatcctccctcccctccttctttccttcatttcttccttttcctttctccctcttctactccccccttcttccttcttcccttcctcccttccttcctgagtgtcagatgaacaataaaggatgtaagaaccatgaattgaaaatgtcatctgaaacaagcacaattcaagataacaacaattcccaggaaaaaactgaaaagataaactgaaccaggaatttggataaacttattttttcattattatactttaaacattgtcattgttcttaggttttatgaggatacgaacagctggattgaggacactgagtttttgtggggccctgcattacttattactcctgttctaaaacaggtaggctctacaggtttaataaccttattgtttgatctttgtataactaaatcgaccctacattacaaaacatctgaataatagatgttactcagtggactgtttcaagctgataaacatcaagttggaattctacgatgtgacacaaatttcaaaatgttataaaaatattaagtagattgcttaccaaatatgtgatatctaacctggggacaagaaaattgtatgaagttatttttctcctgaaaaaaaaaactgtattatcaaatcaaaatcaattcataataacaaagagttctcatttaagtagacatatacattgaaattttgctcaattgtaaataaagaggaactggaaaactcgctgatcagatgaaaatgttggagaaacactggagtgggttggtaattattacctatttttaaaaggtgcatgtgtccattgaggtatacagaaataaacatattcacattcacaatgaccatgtgttttataacaatacacatatatgcatgcattattttaattgctatctaaattacttttttatttacctctttgcttttttaagttttacaatatgatattatctaaagctaataaaatagccctttgattattatctataggaaatattggagtgtaacaacataaagtttttttcccttgactatgaaaacccaacttaatatttgataagatcctccttgttaaaaattgaaattaaaaaatacatattatctttattttagggagcagatactgtgagtgcctacatccctgatgctatttggtatgattatgaatctgtaagtaaccttaacatactaatggactcacaagtattatattttcaaacacttctacatagaaacttaattccatagaaacttaactacatagcatacatatttttagaatttctgtcattactataaaaaataataatttcagactttaaaaatgtgttaaaatttgtgtaagtataccctttgttgcacatgagctagactcaaatatgaagttatattatttagcataaagagatattatttatttttaaattttggaaataaaaggttagcagtaatttaggaaggagtggcaacttattttaatgctttttcctattttacatatttatcttattgccagaagacttgagtactgagctagtcttatatatttgtttttatatggtatattcaaatatttgaaaaaggcttttatttcaaccttgaagaggcaaaataacagcactcaaatacaccatccattttttcaattgaacaagaccttttgagcaatatttatttatttttttttttttgaatttttttttagtagagatggggtttcaccatgttggccaggatagtctcgatctcctgaccttgtgatccgcccgccatggcctcccaaagtgctggaattacaggggtgagccactgcgcctggcctgcaatatttattttaaatgatattattttgcatatcacttatattggctaagtataccctttatttttacggaaataatgattttaagaaaatccttcctaaaggcataaactttaaaccaaaacaaagaataaaaaagctaattaaagtactgttaattattgtagaaagaaaatgagtctctttttgttgatttttttatttttgagaaagtgaacttatttttcctctactttgttcagcaaactgaaaaaaaaaattctcctaaagttagaaaacaatatattcgtattcatttggatgacatgaattgctcataataaaaatgccttttaattcttgtgaaatagagtttaaagtcttcaataatattaagaatgtttttaatcttccaattattagggtgcaaaaaggccatggaggaaacaacgggttgatatgtatcttccagcagacaaaataggattacatcttagaggaggttatatcatccccattcaagaaccagatgtaacaacaacagcaaggtaaaatgaaaaatcattagttgaaatctaaaataaaattcaaatcttaatatttcatatttgcattaagaattagagataatatttagtttctgcaccagaagatatttgacatacagaggtaatactgaactataaccatcatagctataaaaagaatgaaattatttatattattataaatatcttgattttcaaaatttctaatttacttagaagttaacttcctgtatcaaaaatttacccacattagcataattaaagataatatttgattcttaataactatacaaaatgtgaatatttgttatataattgagtgaagtatttgttaatttttacatatttgaatttccatacatacataaatcccaatgtatttctttctgctaaaatgctttaagttcataaatgaactggatattttatgttaggtaaagagtgagagagaaactaaattgctcactaagtgtaaatctcagaaatattttctaaaaataaaagaaacttgaaaatgctggtgctccatttcacatattcattctgagtacaaagagcacagaaagtgccgtattgaatttacatacttttccctattctgccacaacccaacaggaagttactctttattccttaccctactgtattttcttcataacattaagaatatctgaaattatattatttattcttttcttgtatgtagtatgttagcgatacgcattagtaattagtaatttaactgttttggcattctggaatggactagtatcacaatgtaactgatacaagagtatgttctcaaaaaattgttatacaccagagctgtaatgatcaacagcaacaaacactttggtaaatgcatactggaaggaatacatcctatacagtccaggagatgcctggtaaaatgtaactaaaaaaaaaaaccatatttcttgactacatctcattactcctgttataatcatttcatttataagattcttacagattccactaaactttttttaaattttaatcatatttttttttctcataagatgtagacttaatacattgagatttaggattacacaggttgagttgagccttaataagacatttaatttttcttgtttgaattaaaatattatattatttcaattttgcaagtatctcagccttcaaaaaatccattattgcatttattacatttattcttttgacttattttctacatgtataaattatttcggtattcacataagaacattggtatcggtaaattattaatacatataaatacaaatttattgatgtcaatgtccttactgaattcagggcccataaaacagacaggttgaagtggacttgtttataggatattgtattattatggatttatttttaaccatatatgcacctaatttttcttaacagccgtaagaatcctctaggacttatagtcgcattaggtgaaaacaacacagccaaaggagactttttctgggatgatggagaaactaaaggtaagtctgaaagtaatacgctttaaatgttcactctgataatgggaagttttggctttattgatataggttgtatcattttttaaatatcacgaatttttatttttaattcctaatgttttttatctgtttcaggcttttaggctactttaaaacttttaacattgttatttgctttatctatatgtaactaaaatatccagttttgtgcttttgtttgttgtaagtctttggcaagatttttaatctatctttatctattagattaaaatagtcaataaattctcagatatactaattgcattatattttcaactgttttaaagtaaggtagtgattataactaaaattttgttactgtaaacagaaaataaaaccaacatttaaagatttagttatttaatgtcaaattatttgaggtaagaatatcatcgtatcaattgtttacaatttattttccttattatctttaattgaatttcttgagctccaaacttgggaattcagtataccaaacaaaatgtttaaaagtaatcttctgctatggtatttctaattatgccatagtaagtttgtctatttgtatttaactattcacttacaattttccttatacatttttagaaactttttagaaaaatctcgtttcttctaatagagggctgttaggtatgtgttttatatatgagtataaaaattataatttatcttctattttaattaactacttctcaggtgtattaaggaatatccttgtacaaattttaaagagttacagataaatataggaaggacaacaagaagaaaaagactatcctaaatgcctttaaatgtatatgaaacatgtgaatatttatttatttttgaaaatgtgtatatttaaaaattaccacaggattctataattctctcctaagacttacattcaccctcagttaacattcatttaaataaattacatttatttatggcattatttcaatgtattagcaatcaaacttattctaaggaaagatctattctctgggtgattttctcaatgcaagctatgaattacttgtatcattaacagctattaattataaatattctctgtcttttaattattactattctttaccagtagtcctttccttgataaatgtagtcttttataccatttacctgactttcaaatttatatctccaaaccagtcttctatgtacttctctatttgtttgtctaataaaaatctaaaacataatctgccaagatagaacttggatcttaccaccatgtatctgctccatctatcgtgttccctttgtcagttgatggtaacttcattgctacagatgccaacaccttggaatgggctattatctctcacaacctaaggatttcattggttctactttgatctgaagcctctcatcagttcccccactgtcaccaccatctttcatgttaatttagggcaataacttcctaactggcctgtagctctttttaaccccttttaaaattttattacaatccagcaggtagagtaatcattttaaaaggtgattccagtaattgcatctcttctcaaaaccttctaatgatcctccattttactcagttaggagacggagttttatcgagacctagagagcttattatttgtgctttaacatgtgcacacgtgcatgcgcgcacacacatacacgcacccacacacacacaaacacattatcctgtattgctttctatttctcattcaattttagcacaccaatcttcttgctctttcttaaataccctggggtgtaagcacactagggtgagctctcctgtgagattagattccaaacctattctctggcttatgtagtaagccaaaacttagtacatagaagttttgtaaaagtggatttcagctgaacttaacattgcttgtagtcatcaatcaaacaatgttgagataatacctccattgatagcatgtgtggagcaattataagattattcctattactcaaattatataaatactccaaatacatactgtctactgataaagatgcatatgaatagcttactttcatataagtaagtagttaagaatatgaataatataattcaatcagttatctaatatgatacctatgtagctatgtgcatttaaaaagtgaaagaaaaccagaattctgattaatggatttgtaagcaaacatggagacagtaaagtgatcttcagttcaggttctgaatataatattatttcctaggactaaaattttaagcaaattaatgttatggaaagtatattatatgaatcctaggattccctttatattttaacactgtttatgacaaactatttcagtccttatcttcagtttttctttaaagagatacattgaataaaagttatattacatatatggtacagaatcattgtattcatccattttcctcattaaagtttatttaaatttcagactaaagtttatttcaatcttcaacatgtctccagatttattgttttccttgaataaaaaataatagaaaaaaataaaaagatgcaaaatgtattataatatgccatgtcttcctaagaaaaatgtactgttatgaggtttacaagggagagaatatctttcaaaataatacatttttaattatatattatttactgtaagttttgctttctcttaatttccagaaataccttggtagtctttgaaaaaataagcaaggcaaatatgtattcattacctctacttgctgtgaaaatgaaataccattattatataatttagagacaattaaaaaatttaaaaacaaaatctgtttgggatgcttcattaataaacagcatctagtttgttctaatttcttaagtgttgtataagtgtaaaaccagagcagagaatttaacattgcattttgtactgatcacgatatttttcatttcagatacaatacaaaatggcaactacatattatatacattttcagtttctaatgtaagcactctctttgtacatatacttaaatgcataatttgttcatgcctaggttattcttttatgataaattttttggaaaagatgtttacatttgcctacagattttaatggaatgtaatgaaataaattgttcaattaaattgttatatttaaattgttaaattataaataaattgttaccttaaaattttataaagtttgtgaccatgtaattgatggaaagaaacctttagacttcttgacatgttatgattggttttaggcaacatgccctaggaaaacaatttcaacatatctgaaaatgttttaatgaattagtcacagtaataattggtgtggattttggtttattaaattttgaatagttaatagaaatgattttttcatagattttgggttttttcatacattcttctttagcaaagctaaattattcttcatcaatgttaggactagaatgagtatatatgtgttgcatatgagtaattaaggttatctctgaaaataaaattttctggcatatatataaaaatgaaaatagatattaatgagtatatttctatgtgctacttggatgaggagagctggtgggaatagagatgtagatgatgacctttttttgctatttcttatcggtattgttatttcaggtttgtatctgatgacctaatatataatatcttatactatttttctcagaacacattagatattgtgtgcacacattcatcatatcaggaaggaactaccttagcatttcagactgtaaaaatccttgggttgacagacagtgttacagaagttagagtggcggaaaataatcaaccaatgaacgctcattccaatttcacttatgatgcttctaaccaggtaattacaatcttttaaaatattttagctatcatataatctcatatttaatattatataaccattcaggcacttatcctatttctcctcacagtgtgtattcctttcttcccttcgttgcttccttcttcccttcatttttttcttcactttttctgaacaatattccaatttatgtcaatccaatttgtatttagatatcaacatgaagggaattccttgctatttctctctatatatttcattttctcatgcattctaattatatgggactttctaatattttccataaaaattcttcaaatctgaactctaacctacctattgcatgcaaaagaaaatcccaaatgttttagctgctttagactctttaacaaattggttttgttcatttctttagtctttctcctgtttcttttttagtgaggtctcattgtcctcaaaatatatcttgtacttttctaactttaattttgtgtttacacttttcttctcctgtagaaagccttccttatattgtgatttttgtctctttttacagttgtagtatagaggggaaaaaataacaaaattggatgcactgttattggatgcacagattataactctgctatctctgcttctaaacgcattaaatcaatctctcattattttagctttctcatttgcaaaatgtaatatttcaatcataatgttgctttgggtagtagattgatgtattaaaaaagagactgtaatatttaaaaacacgaaagcaattatttttgtcatttatcttttctccatttatataatactaaattattagtaatattaccataaataatttctaaattatttaagatatagaacattgtcttataatatttttgttttaactcataagacctctggcccagggcttttcaattattagttttcagaaaatatgtactggtcaattattttttatttaataggcatattatgatttatatttcctagcactataagaataaattgatataaattaagtaatacaagcttattgtgaactttatgactctaatagagattaaaagagggaataataaaaaataattttattggttatgtatgcaatataaaggtctatctgtggctatttgtatgtccacttttatgcttataaatatatatatattatatatatataatcttcataattctgctgtgtataccttcataattctgctgtgcatagattgatctttatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttctcctaattgcagatctcaaacttaatcttggaagaaactttagtgttcaatggaatcaaattttctcagaaaatgaaagatttaattgttatccagatgcagatttggcaactgaacaaaagtgcacacaacgtggctgtgtatggagaacggtaataatacttttaactattactcatgatatggttatcacataagcattttggtgcaaattttacatattataattttaaatctgcagcatataaactaaattcaagtagataatcatttggaatttgaagttagcatctctgacaggcaattcacttttatcttaattaattatccaaagacatatcttagtaaacgccaggctgaattgatgtgtaaattgctttccaggaactttggataatgtaactttacttaaaaaaataatactctgtctgagagttacactctacttggtgttgactgtagctgatttgcttgtttgggtaagatatgccagtaatggacactattttgaaagagttgtctcaagttattaagacatatgatgttgagtaacgggctacttctcttccactaaggatgataatctcttgccagttattttggctttcattttaacaaaatgatgatggctgaggatggcaggtgtttttaccaatgtcacaggaaggacattgtaaaacattcctcttgctatgcctgtttttcaaattctgggcttttcattacatcattgagttttgtcaacaaatatatttatttaatataaccaaataactaaatgcatctgttatatcactgaggcgagtcaagacatatttgtcagcaatttcccagagacatttacatttgtataaagagatgcatagaatctctgcctccagagaaattatcccaatttctctccattaattgttaaagcagcataatctgtatcactagtgaagaatagggaagaatataagaacagaaaaagtaaggagaagaaaagattctaaaatcaataaaagtcaaatagtgaagttcacttctctaaaccttctcttaagttgcctcttttcagccaaatacacatccattcccctttgcattcaaagtatgctaactttatcaaaacgaatataaaggacaggtgggaacaattcattttgctaaagaataaatatcttctaaacatgaaaatgtgaaattttatctttcctattaaataattttaatgttatatatatatataaggctaatgttacatatatatacatatatatgtatatatatacatatatatgtatatatatacaccacagtttttttatccactcattgattggtgaacatttggtttggttccacatttttgcaattgcaattgtgctgctataaacatgcacgtgcaagtatcttttttgtataattacttctttttctctgggtagatacccagtagcaggattgctggatcaaatagtagttcttcttttaattctttaaggaatctccacactgttgtccatagtggttgtactagtttacattcccactatcagtgtagaagtgtccccttttcactgaatccatgccaacatctattttttttttattttttgattatggccattcttgaaggagtaaggtggtattacattgttgttttaatttgcatttacctgatcattagtgatgctgatcattttttcatatgtttgttggccatttgttcatcttttcttttgagatttgtctattcatgcctttagtccactttttgaagggattgtttgtttgttttttcctgctaaattatttgagtttgttgtagattctggatattcgttctttgtcagatgtatagatggtgaagattttctcccactctgtgggttgtctgtttactctgctgactgttccttttgcactgcaaaagatcttagtttaattaagtcccagatgtttgtctttgtttttattggatttgcttttgtttttggtcatcaaatccttgcctgagacaatttctagaatgctatcttctagaatttttgtagtttctggtcttagatttaagtccttaatccaccttgagttgacttttgtgtaaggtgagagatgagaatctagttttattctcctgcatgtggcttgccaataatcgtagcaccatttgttgaataggatgtcctttcctcactttatgtttttgtctgctttatcgaagatcaggtggctctaagtatcagggtttaattctgggttctctattctgttccattggtctatgtgattatttttatacagtaccatgctattttggtgactatggctttatagtatagtttgaaattaagtaatatgatgcctccagatttgttctttttgcttattctcacttttgctatgcatggtcttttttggttccatatgaattttaggattgttttttccagttcggtgaagaataatgatggtgttttgatgagaattgcattgaatctgtatattgttttggcagtatggtcattttcacaatattctttctatccatccatgagcatgggatgtgtttccgtctgtgtcatctataatttctttcagtagtgtttgtagttttccttgtagaggtctttcacctccttggttaggtatacacctaagtattttagtttattttattttctgcagctattgtaaaagaggttgagtttttgatttgattctcaccttggttgtttttggtttataaaagagctactgacttctgtacgttaattttgtatccaaaaactttgctgaactattttatcagttctaggagctttttggaggagtctttagggttttctaagtaaacaatcatatcatcagcaaagagcgacagtttgacttcccctttactgatttggatgccatttttttctttctcttgtctgattgctctggctaggacttccagtactatgttgaaaataagtgagaatggccatctttgtcttgttccagttctcagagagaatgctttcaacttttccccattcagtattacgttggctgtgggtttgtcatagacggtttttattatgttgaagtatgtcccttgtttgccgattttgctgaatgctggatgtttaaaatgtttttctgtgtctattgagatgatcccgtgatttttgtttttaattctgtttatgtggtgtatcacaattattgacttgcatatgtgaaaccatccccgtatccctagtatgaaacccacttggtcatgttgggctatctttttgatatgttgttgaatttggaatttggttagccaggattttgttaaggattcttgcatctatgttcccagggatattggtctgtagttttcttttttggttatgtcctttcctggttttggtattagggtgatactggcttcatagaacaatttaggggggattccctctttctctttcttgtggaataacgtcaatagattggtaccaattattctttgaatttctggtaaaattctgctatgaatccatgtggccctggacatttttttcttggtaatttttattaccattttaatctcacttcttgttattgatctgctgaggttatctaattcttcccgatttaaggttgtgtcattccaggaatttatccatctcttctaggtcatctaatttatgtgtgtaacggtgttcatagtagccttgaatgatcttttgtatttctgtggtgtcagttgtagtatctcgcatttcatttctaattgagcttatttggactttctccttttcttgatcaatcttgctaatgatctatgaattttatttatcttttcaaagaactagatttttgtttcagttgtcttttgtatttttttgtttcaatttcatttagttatgctccaatcttggttatttcctttcttcttctgagttttggtttgatttgttcttgtttctctagttccttgaagtgtgaccttagattgtctatgtgtgctctttcagactttttggtgtaggcatttagggctatgaactttcttcttagtactgcatatgttgtatccctgaggttttgataggctgtgtcactattgtcattcagttagaagactttttaaattttcaacttgattttatttttgacccaatgatcattcaggagcatattatttaatttgcatgtatttgcatggttttgaaggttccttttggagttgatttccagttttattttactgtggtctcagagagtgcttgatataatttcaaatttcttaaatttattgtgccctatcatacagtctatcttggagaaagttccatgtgctgatgaatagaatgtatcttctgtggttgttgggtagaatgttctgtaaatatctgttaagtccattttttctggggtatggtttaaatccattgttactttgttgactttccgtcttgatgatctgtctagtactatcagtggagtattgaagtcctccactattactgtgttgctgactctctcaattcttaggtctattagtaattgttttataaatttgggacctccagtgttaggtgcatatatatttaggattgtgatattttcctgttggacaaggccttttatcattttataatgtccatctttgccttttttaactgctgttgctttaaagtttgttttgtctgatataaaaatagctacttctggctttcagtgttcatttgcatggaatgtttttttctacccctttatcttgagtttgtgtgagtccttatgtgttaggtgagtctcttggaggcagcagatagttggttggtgaatagttatccattctgtaattctgtgtccttaaagtggagcatttaggccatttactttcaatgtcagtattgagatgtgaggtaccattccattcattgtgctatttgtttcctgtataccttgtttttttattatgttttataggtcctgtgagatttatgctttaaagaggttctgttttgatgtatttctaggatttgtttcaagatttagagctccttttagcagtttctgtagtactgattctggtagtggacaattctctcagcatttgtttgtctgaaaaaggttatatctttccttcatttatgaaccttagtttttctggatacaaaagtcttggctgataattgttttgtttaaggaggctgaagacagcgccccaatcccttctagcttgtagggtttctgctgagaaatctgctgttttcttttataggttagctagtgcttttgcctcacagctcttaagattttttccttcatcttaactttagataacctgacagcaatgtgtctaggcaatgacctttttgcgatgaatatcccaagtgttctttgagctctcttgtatttggatgtctagatctctagcaaggccagggaagttttctttgattattccttcaaatatgttttccaaatttttagatttcccttcttcctcaggaacaccagctattcttaggtttggtcatttaacataatcccagacttcttgcaggctgtgttcatattgtcttcttcttttttctttgtctttattggattgagttaattcaaaaacctcatcttgaagctctgaagttctttcctctgcctgtatgattctattgctgagactttcatttctgtgtttaaggccatgtggtagcatgatatcatcaacgaaataagcttgaatagatgagaagtgttcaaagactaaaccctgggcgattacaaactttagccaaggaggaaatgacaaaggaggcttagaaagaacagctcaagtattgggttggaaataacatgctgggtcctggaagccaattgaacaaagcatttagaatggaagaaatgatcaactatgcaaattgtttgtcagtaagataaggactggaaactgacatgtggatttggcaacatggaagtctttggtaactttaacatgcaaacattagatgtagtactagggataaaagcctagttagagtgagttcaagagaaaatcaagggacaaattagagatagtgagtatgttttgctgtaaagaaagcagaaaaaatagaacagtagtcagagaagttactgaagtgacatttactctaaaaaaatgagaaaaataaaatcagtttatgctgttaaaaataacataatgaatgaaatattattgatgcaagagagagggtggagaattgagggagaaatatttttataggtaaggaggcctgggatagggtacacagatgaaattgttcactttagatagaagccagacagtacacccttaagaagatgagtcaaacagagtatctcaatttagtcagcttaggcccctttcttttaaagagcttttatgaggactcacacaacttctttaaaaggaaattggaaatgtagataaatataatatttctctccaaaatataataatttaataaacaaggaagatagggagaatggattgtggtatggcaaccagccatcaatgccagagtttataattctttttcttaggttttatctctcacttctatgttaaaccaatcaactctgattcttggccagggttcctatttcaaatccaggtcaggatgtaattaaccagtataagaacatgttaaaaaaagaaggattgagagtttcattataagtaacagaattctagcacttgccctttagaggcatgttataatgccatttttatacacaataatcaacaatcaatatgaacagtaagaacaaacatggaatcaaaatttattagtaatatacttgcttttgcagacaacacaatttaatgctattttttgagttaaaaaatgtatgacatttgatccttctgctctaccattctttctctagagtgtaaatgtaaatattttgtataaaattttagtacatgggatcccaaattgcataaaatatattttgtgttataactgttatttcatttttgtattaatgaaacttgtaaatcatacaatgtgtgactaaacgtcagtataattttaaagagtaaaatattacaaggcttataatttctggcaatgaacatgcattgtgtttttagggttcttctctatccaaagcacctgagtgttactttcccagacaagataactcttattcagtcaactcagctcgctattcatccatgggtataacagctgacctccaactaaatactgcaaatgccagaataaagttaccttctgaccccatctcaactcttcgtgtggaggtgaaatatcacaaaaatgatatgttgcagtttaaggtatgcttgatataaactaccccaaagcttaactcatcttgtgagatgagattttgaataatcctgtgattgatatttaatgtaatattaaaggttattaacagatttgataatattttgattttataaaaatattttttcctacacaactcatagctaggtgcccaataaatgaaactgctcattcctgctaactttgtgattaatacaatgatgattttaaaaataaatttaaattcttacaaaatacataagtcatttattatcaaactatgctgatagtgtcattaaaataaacaaaattggatgcctactgtttccattatttttaagttgtggtcttaattttctggccaatgcaataagacataccaaagcaataatttcattcaacttttagagatagcattttttaacttaagaattccaaaggaatccattaagaatagtattagaaatttaaaatatcaacaaaataactagatgtaaaattatatttccaaagatattttcttgtgtattattgctcattatttagaagcagaaatggcaacaaatctcattagcaaactcaaatgaaaaaatcaaataataaatcatcaaaaattataggactaagtggagtatctgtaaggagaaaaactattaaaaatgttcatattaagtattttaaaattataaataagagtaaacgatattttaaatgttaattcactttagctcagtcgctgcttttaaagtattttcatataaatcttagtgaaatatcttttgagacttcataaaataacttttaagtttgtctgaaaaaataaacaccttgcaattgttaaaattcagcaatgggtaaagaataaaaattcatacaattaaaacagtgtggaactggagatagcattgcctggttgtttattgaaacgagacggcacaaaagcatggaagattttgtgtgtgtgtgtgtgtgtgtgtatgtgtgatggcacaaaagcatagaagattgtgtgtgtgtgtgtgtgtgtgtgtgtgtgtgtgtgagatggcacaaaagcatagaagatgtgtgtgtgtgaagaaaggttcacaaattaataatgaagaggtaggttatttaaaaatttatataaaaaagtgtgtttttaatcatatgctaaaataaaatttagaatgagttccatgtgaaaactaaacataagcctaaaataaatttagctgcatatttattttgtatctggctagcaaaggcctttcaagccacagataaaaaggcgttaagtgacataggtaaaaatctacacattttctaacataaaaataaaatatgttttcacatcaaaaaacactataaacaattagaggacaaaaaaatgggtaaacatctgataaagatgtgacatagggaaagcaattccaactcatgtaatcaagaaaaaatatcaagacctctcataagaagatatttaacagaagaaactaaaatatcaacataattacactcattaaaaattccaggagcaaaatgcagtttaaagtacagtggaacataaatgttgaataataatgtagaaaaagatgaaacctcataagtaggaaatgaaatgattaacaatgaaaaataaatgcttttaatttaacataaattagcattagagtacacattttggtgagaatattaatcagtaaacaaattctggaaagcagtttgtcaatagttatcaaagaccctaaaacggtaagtatactcagaccctagtggtatttaagaaatgtgctgaagaaataaaaacacaaataaacataaattagcattagggtttattgtataataatatgtatgacaaaaaatattgaaacaacttctgtttttaaccatgaaataattttggtatacccatacaacagaatatttagctctaaaatttttgttttgatttcttattatttagaaaacaaatcacaaaacattttttaaaggttcaaaaatgcagtattcagttaggacccattataaatgtgtatgtggaattctatattgatatggttatatggaccatgaatgtagaattagaaattatgtggagaaaaattctaaatattcttgtttgagccattatttaacttagttcatgatatgtacatgctatgtcagcaatcagaataaacttttttactacttatctgcaatagatttatgatccccaaaagaagagatatgaagtaccagtaccgttaaacattccaaccaccccaataagtacttatgaagacagactttatgatgtggaaatcaaggaaaatccttttggcatccagattcgacggagaagcagtggaagagtcatgtaagtaattgaattatttgatataaaggatattttaattttagcttacgaagggaaaagtaaaatgattaacagccttcactgtcctagagtagcatcacacaaaaaaatttaagacgtgttaaataactttgcccattttaatatttctagctaaacatagtccatgggactattttaaaggattggcccacaattttatctacactttggaggtgttcaatttcactattagtatcagactcattcttctaatcaagttgagaaccaaaaccaaaacctcttttaaaaagcatgataagtgttggcaaaaataagtatttggaaacaagtgaagtaaatattttattgaaactgttgaaatagtttattggtgcttgaatctgatagaattaataatttatctgccaggtattagtgaaaataagttacaacatgtaagtctagatatatttttatgttacaatgaataaatttaattttaaaattgtagtctttattttattcaaaagatctataaactataatatattaaaatatacttttatgtaatttaagtttgccatgccattccttagatgatgttatcaggatgttttctggtattgtcaagatatgtacaaataatatctaaaactatatctggattattttaataattttgttgttatgacaatatttttgttcaaaagcatgggaagctaagtcattttataaaaatatcctggtgcaagggcattatttattgtcatttgacaagcattattctcgattaaatagttttccaaaataataaatataaaaagttaaaatatgcccagattacttgtaatacttacgcttcctctccttgcccatgttactttccttcctctttatgttcttcttgcaaatgagttgaataataatatgtttcttgtaacacatttcttcatacacagctatttttatgaacataaaataaaggaagaaaaacacaattgggagtagtaataggagagagttaaacatttgaatatctgttaaacttaaaattcattataatattgatgtatttttattccatatgtagaaaaaaatgtattgtgattatctcaagggagcaggaaaattgaggccttttaatttctaggtcacacattactaagtcatttatgatttcatattaattttatttttaaaaggaatacttgtctaaagaaaaacatgtacaatcatattatttatattatgattctcctataagtatatgaagcatattttacatattccttaacttagctaaaagaaaacatgtattagattaatcatctatttccatttggtacctgggtataattaggaatatggaaaataatattgatttttagataatctaagaaagaattaccgttattatttgtgatactactttgcatatattttgacagacatagctttgttttcttttgttttcagttgggattcttggctgcctggatttgcttttaatgaccagttcattcaaatatcgactcgcctgccatcagaatatatatatggttttggggaagtggaacatacagcatttaagcgagatctgaactggaatacttggggaatgttcacaagagaccaaccccctggtgtaggtaccaacatatgaccactccacgaggcaactaagaccatgagtagaatccaagccacttctttatgggcctgtgctttaggattgaagtaatgacaaaggcattagctagagatctccagagcagctatagcaattttctgagaaacaaacccaaaaagtcaccataaattacaggtggaagtagaggagtggatggataacaatttgcttgactactgtgagaagccaggctttgactcaataccttaactgtttcaaatgcatacaaagaatatgctgattctgtattccctgtcaagtttacctttactccagcttttagaaaataactgcctaaagttttccttgattgtttttacttctcaggtactgatttgatcttttttccctttataaccttcagttgcagttgggtaactttatgtggccaaagtgctaattacatctttacaatgtgtttttatatactcatgactctttttccaaagatttgtctcgttaatgcaacacattttatgaatatttaatgtactgtgcaacaaataatattatctataatattccaaacatatcataaaaaatatattttaatgaaaattattctatttgtatttttcacatgtgatgtatacttaaaaggatatactcagtaccatactataagtctgtgaactattgtaagcattttttattgttaggtgctcaaacagcttgcatttatatcataatactccaaacttaggttattgaaggctgttttctattaacactaacttgaaagaatacgttttaccaaaactgatttcttaaaatcccttcagcatttgtaccgatattattagactaatatacttttgattcttgatatctaaaattacttccactagtaattttgcatattactaaaaataaattactataaaatctatttcactggtaattttatatatattaagaatcaaaagtatataatctaataaaatctgactatgattacagtatgaaacaatgaattaaatattttataaatataaaactttaaatgttctataaatataaaatatataaacaagatattttctggacagtttaattgtattcatcacttttatcatttctaggacattttactatggaaaaaataccaatttatagataagttaaacacataacctttggaaataaaccaaactactctaatggcaatagtattctatgtcatttaatgtggaagcatttgcagttgttacatattgtatattaatacaaatatatacatatttgtatattaatttctattaatatacaaatattatagaaacatatttgtaaactacacgaaagcagaaaaaatttaaacaattatattctagggagacacatttattttaactgaagcatagtttaaggttgggaaacgggaatttaaatatcaagtctcgattgtataataaattttaaaataacattgattaaattcacatgctattgttacttaaaatatattgtgcttatttttcgtatttcagtacaaacttaattcctatggatttcatccctattacatggctctggaagaggagggcaatgctcatggtgttttcttactcaacagcaatgcaatgggtaaaacaatcatttgttgaatgtctcttattttatgtgactttttcataaactagtatacatagatgaaaatgggatgttattttggatttccagatgttacattccagccaactcctgctctaacttaccgtacagttggagggatcttggatttttatatgtttttgggcccaactccagaagttgcaacaaagcaataccatgaagtatgattgcatatttcttttaaaaaaattaaaaatttttatagcataaagtaattctcttagttcacacatgaattttttttaaaggtaattggccatccagtcatgccagcttattgggctttgggattccaattatgtcgttatggatatgcaaatacttcagaggttcgggaattatatgacgctatggtggctgctaacatcccctatgtatgtatatcaattttaaaacaatgttaaatatggaatacgtaaaagtagaatgaaataattaaacatgtatactttaatttaagcagctggtaataatgcttagctttttttactggcaccttatgtattggatatgagatttataaacagtgtctttgtcagactgataaaggagaggaagaaataccattccttttccttttccctccctaatactatcatgctgtgttgtgctaaacaagtcactgtgcacttgatttcctctcacaaactctgggttgtacaggcagtcactatgttctcttcatgttaaagttcacagaaatatgtatcatcaataagataagaaatctgtatcatcaaccagagaacaagttggaggtggaactaattttttttttgccctggaatagataatagttgtaatatataatagagattcactcaatattcaggaagctaagtattccaaagtatccacaaatgatcaatctctgaatttcctcattttttatcaaaattaaggaatcctagggatgctgctgctaacacccaaacattaaaatatagaaggcttgatatataagagtttattctaagaaaaatcagaaaaacctcattataagacattggtatttatagtagggtccaatatagagttcctgaataactagtatgggaaattaattatatatgttgacaatacagaaacatgcacgtggaaatttattatttaaaaggaggtatacattattgaccatactttctataacacatagaagaagaaattgagataatgtcaactaacagaaaataattaacaaattttgtatttaggcttcaattgaatattccatgatacaattcaaatatttgttggtttaaacatacttgcaattacctatcttaaaacaattcttgcttagataagcagggctgttatcctaaaagtgactttgatggatattacaagaacaagattatagtaattgatgtaattgttaatactccttttgccaatattagaattatttgaaattacccgatatttgctgtatagttcccggaaacagcaacatctctttctgtatatactgtacaaaagtcctatttgtcatttaacctaatttcatagtatcataaatcctattgctcagtgtctttctgtttcctttgaggattacataatatataccaatttagaacagtttttacctctaaatcaaaatgactaaatgaactgttgacaaaacagaacatttatagaaagttgttcttagaatactttacatctttacatgctacttttattccttgaacactaaaccatttaattctttttaggatctagtgaagaggaactcaaactttcatattgctgttacttttataagtatgataaaatatgatacacttactattttgtattttttgccctactttgataatttttggatatttcaggatgttcagtacacagacattgactacatggaaaggcagctagactttacaattggtgaagcattccaggaccttcctcagtttgttgacaaaataagaggagaaggaatgagatacattattatcctggtcagtacttggagtttatctgagtcttatttcttgtttccattaattcacctaaaatgagcaggtgggggggaagatgtttcaaaatagaaagtatataactttgagtaacactcccaaatctaaaactctcttcctttagcacttcattttatttgcatgggttgtgatcagctacctttgtatttaggtatatccctagagatttaaaaccaaagctgagttaaagggaagctgttttctagttatcatccaagctacaaattggcctctatttatgggagttatcaaaatgtaatggtagattttctatttttatacaattattagttcattctctgggattgcttctgatgtttttcatatttaaaaacttgccttcagattggtgattcagtgaagataattttttatcactatcttataggaagtaagctagttagccagatatctcaccatagaaataaaaacaaaataaaaacctctactaatctttcttgaaatgatagctgatgcatttccaagagtccttagaatttccttctaagaaatttggagggaaatctagctagaacactgatgtttgtatcatttgtcatttaatgtgagagcacattattatgataatgtagtaatgaaaacttatgcttcataatcactgtccaagtagttacgcttttttcatgtgtaccttgtttatatttcattttaattttaggatccagcaatttcaggaaatgaaacaaagacttaccctgcatttgaaagaggacagcagaatgatgtctttgtcaaatggccaaacaccaatgacatttgttgggcaaaggtactaaatcgatatcttgaaatagaataaatacaaaaattatatttcaatgaaagtttccatttaattagtaaaagttaaaaccgttcaggagagctatacagaaatgtaatgatttaataactaataaaataatgtatagtctttggttcaatccaaattagacacaaagaaagaattcatataagtcacatgtccaaatatgatttgtttcatctttaagacatattttattatatttattggtaccacttgtaatttattataagactaccattagtaagatggctactcattattctgtactgcaagttatttaaatgttcacttctcttgaaaacatatgttaatagtagcaacaacatgttttgacagctatacttatatttaaaacttagatcatgaagtataattcactgtattttatataaacaagtatattcagacctgatatattaatatattacaaaaatattttgatttggcttttatataaagcaatcaagaaaaaaatctcatagtaaaaactagaatgaacaacaatgataacaccatcaaaaaaatctatgatgagggccaggcgcggtggctcacgcctgtaatcccagctctttgggaggccaaggcgggcggatcatgagatcaggagatcgagaccatcctggctaacgtggtgaaaccccgtctctactaaaaatacaaaaaaattagaagggcatggtggcgggtgcctgtagtcccagctactcaggaggctgaggcaagagaatggagtgaacccgggaggcggagcttgcagtgagccaagatcgagccactgaactccagcctgggggacagagcgagactccgtctcaaaacaacaacaacaacaaaaaaaaaaaatctatgatgagagacacaattaaatgaaatgtgagaggctttttgaatcttgggccaaaattaagacattagtgattaaatctgcaaaatgcaaacatgttcaataaatgttgattgtactgtatcaacattaatttcctggttttgataagttcactattgttatataacatgttaacattagagaaagctgagtgaagaatatagacagggctgggcacagtggcacatgcatgtaatgcttgcagtttgagtggctgaggtaggaggattgcttgagcccaggagttcgagatcaacctgggcaacatagggagattttgtatctacaaaaaatttaaaaattagctaggcatggtggtgcatgcctgtagccccagctacttgagaggcatattaatccagaggtttttttttaacttcctactttctcctcattctgtatttctacacattttgtcagatttctaccatttctccccttcctttagagcactattctctaccatcagctaatcccttgtaaataattcctttttggtggattatttatatttttatataggactttcaaacttctacaatatagatccaaatttccagagctttcagcaaattgaatttcagctctgttttgtgtgtttctggtcagagtagaaggaaaaaaatgttggtaggcaatgaggtcaggctgggaatagtggtgggatgaagggagaggaggatttagtactaattctgaaaatcactgggatgtttgattcagcatgacattattcaatcggatctttgcttcctttcaaacaaaaagatttattgtttttagtttttaaccctggagtaattctacaaataattctaatatactatattaaattaaatttaacttatatttttcatattagtttttgaccagaaccttttggttatatgtattattttcaaaattactaactaccataaaggttggcaatgctattttgtatttgccatattaaagaggagactaacatggaaaatgggaatagtttgcaaatggtatgtgtgtcaataataatgagatttgaagggattgcagatctgaagactttgagttaataataagcctctaatactccattacacttcatctacatagcaatcatatcatgctgactatgttttgatcagcttttccatgtcttgtctcttgtaggtttggccagatttgcccaacataacaatagataaaactctaacggaagatgaagctgttaatgtaagttttacacgggctaactatacaatgagaagaaattcaaaacttagacttgattattttaatcaataactaaatttgaatgcttttctttaaaaatagatggccattttaaattatcgatatcagaccatatttagataaaatttacctaattttcctaaataacaaagtaccagtcaccctattaagcaattttatattttgctttatttaatccaagcaatcattcctttatttaaaaagttatggcctggcacggtggctcatgcctgtaatcccagcactttgggaggccaaggtgggtggatcacgaggtcaggagattgagaccatcctggctaacatggtgaaactccatctctactaaaaatacaaaaaaaaataaccaggcgtggtggcgggagcctgtagacccagctactcggaaagctgaggcaggagaatggtgttaacccaggaggtggagcttgcagtgagcccagatcgcaccactgcactccagcctgggtgacagagcgagactccatctcaaaaaaacaaaacaaaacaacaacgacaaaaaattattacagtaataacatttaacattagatctaccctcttaataaatgtttattcatataataaatcatcgtaaactataggggcaatgttgtgctgcagatctctagaatttatttaccttgcgtaattgagattttgtgtctatttcttagcaagcccttattttctcccacttacagtcctgggcaactaccattctaccctatgcttttatgagtttaactgttttagatacttcatgtaagttgaatcatacaacatttgtctttctgttactggtttatttcactcagtataacatcctaaacattcactcatgaaagcaaaaggaatgaataagatattaaatgcaaatgataaacagaagggaacaggagtggctatagttctatcagagaaaatacattttaagacaatcactgtcacaaaagacaaaagaagtcattatataatgacaaaagggccaattcattaggaagatacgatgattataaatatttgctcccaacatgaaagcacttaaatatttaaagtaaacattaacagaactgaaatgagaaacagcaatgctgtttgaagactttgttgccacactttcaataataaatagaacaataataaataaataataataataaataataaataaataataacaataatgaataaataaataataaatgataatacataaatagaacaataataaataaataataacaataataaatagaacaaccagagagcaaatcaacaaagaaacagcagtttttaacaacaccgtaggccaaatggacttaacagacatacgtagaactttctacccaaaagcagccatatatacattcttctcaagtgcccatagaacattttctaagagtgatcacatgttaagtcacaagacaagccttaaaaattgtgagaagatagaaaacataccatttatctttcccagccacaatgaaattaaactagaaatcagaaaaagaggggaaataagtcaattcaaaaatacgtggaaattaaacaacccacttttgaacagccagtggaacaacaaaaagatcaaaagagaattagaaaatttcttcagacaaacaaaaataaaaatacaacttagcaaaacttctgggatgcagcaaaagcagtactaagagagaagtgtataacaagaaacacccacatgaagaataataaaaatctcaaataaataacattacctctcaatgaattagaaaaagaataaacttaaagttagtagagggaagaaaataaagattagaggagtaaaaattaaaagaaaaacacaaaataaatagaaaatatcaacaaaactaagagttggtgatccttcttttagccagatgaatttacaatcattaaattatacaagtttaggtaactgtgaaaaatttgggagcttaaaacttaccaaaactacttctaaaacagagtcagataattgaacctactgaactatgtcattgaggaaaaaagtgttatttcaacttgagttccacccactattcttgagaaccactagagagacaggcatggatttttatataggtgttggaggacagtgtcaatttacgtagaatggcttatgcagaattccctgggattctcttccacaaaaggtatcaacagtgttggattacatgtacctgattgattttctggatataatcaatgattttatttaagtgatagaagcagccagctaatagaataagttaaactaaaaaatgaattatgtaaagagcagaaaagtgaaaattaatgaaaaagatctggcactaccatttgttattaattatcatacgggagatccttgcatagaaaatattcaatataatcccaccaagccttctatccttatgagtaaaatgtaattaataggtaagatgataaaattaagtccctttctactcttgaagatattcatcataggccaggtgcggtggctcacgcctgtaatcccagcactttgggaggccgaggcgtgtggatcacctgaggtcaggagtttgagacaagcctgaccaacatggtgaaaccccgtctctactaaaaatacaaaaaattagccaggtgtggtggtggacatctgtaatcccacctactctggaggctgaggcaggagaatcccttgagcctgggagacagaggttgcagtgagccgaggttgtgccattgcactccagcctgggcaacaagagcaaaactctatcttaaaaaaaaaacaaaatccatcatatgtattttgtaaatctctatatttcctactctctgcattttctgtatgtcctccgatatcttgttcataaagaagactgttaaggccgttacaacagaatcttaacatgtgccaaaaaagcatccaggttgtcatgtcatttttttgagacatacccaattaacttagctgcaggtcaatcttttgctaaaacacggttactctgacactggaacttttatgtttcgactggcaagtagggaatattcttagtagagattggaataaaacacctcttctctgttgggatgagaagggctagatgtgagagacaaaaaaagaagcagttgatgagggtggtgagatggttctgggaaatgagaaagctatataaaaacaggctttatactatggccctttgctgtttcattgtgctccacaaaggtaaacctgaagtatgggctctgcagtaacagagaaaaaaagcttccccattactctaggaagcactaaaaataatgcttttgtgggttgtgaactgttcctttataattcacataggattccaaaatggctctattatctccaccgatgtccctctttactctattgaagtgttgaggaagaaaccacacacatttatgtaattaagattgatgtcaatttccttcattatcagtcatacatgacttgtggatctgtcaaatacattcagatttatatgtatataatctctcttaagactttccacatgtgagcctaaattttggttttacaggcttccagagctcatgtagctttcccagatttcttcaggacttccacagcagagtggtgggccagagaaattgtggacttttacaatgaaaagatgaagtttgatggtttgtggattgtaagtaagctttgaacaatctatgttttaagttatttattgtgcagtgattatgcaaaattagtacttggctcaaataatgtcaacaaaatattttatttgaaaactagtccacttttttcccccacagaactttcttacacaaacaactgctaaagtaaagtgttaaaaactaaatttatgtgtatggatgctatttcctggactttttcaatttgcaaaattcaaaaagcaaaatattctatatattaataaatccttgtaaatatttatttcacttttatttaatataggaataagtgtcaggcttaaataaccattagtcctttgtatgagagataaaaatttcttaaatttggtaacattgtcttttaaagtttcttttttgatgtaatcttaaaatgttagtagtaagatttttaataatatatttttttagatagcataaaaataatttactttgctacaagtaaatgcttaatacagaaaattttatgtaatatatttcaatttccggaggaaaaattttttactttgttgatttttccagtgtaaagcattaatttacttattttttaaattgaaaaaagctttatacagctgtcactatgtggaaactttgtagatataagattgtataaagcatatattttgtttaaaaattcatggaacatctatgtttattagatgtagcaattggtataccataagggattctcttaagtatattcctgagaatgtcatctggatccagagaaaattatctttttcaggtggaggcaatccattttaaatggtggctgacttatttatttagatcatgattcttttaaatatgactactgagattctgagatatgtactcaatagagatacttcttgaaattatctgcatttgtaaactattaatatatcttgtagttttagcaataaaagcaattgatatcaggctcagggcaggagtggaggggaaggagatgatagggcacatattattataatgctatgtcttaaagatatgaaaataaactatttttatgggtataatgcataatacagagaaaacaaaacattttatttttcaaaaggaaactgaaaaaagcaatcaatgagataaactaatatcattgagatgttttacaattttgtttgtttagaatagtgagtatatataacattgttcaaatatgttaacctacttactttttgaactagctcttttgagaatatatgttgtaaatttatcttttgtttacctttttctttcatctttttttaaggatatgaatgagccatcaagttttgtaaatggaacaactactaatcaatgcagaaatgacgaactaaattatccaccttatttcccaggtacaatattgttggtatgcctttgatattatcatgttattattatatattaataggtatataatataaactgatatatatcagttagctatacatagaatatatatatagaatatatatgtatatataaaaaatcagtttgatatatatagaaggtagggaataggattcacacacccaattttcactacccacccacacactggaccacaccttgacccattaccaatattatttaacactattttgagaaaaaaatcaaggaatatattttatctacatgaacacaattctaaatttgtttgaagttgttattttggtttgcttaataattttcccagattcaaaaaatgttaaatactctttaagataaaaaataaaattattttgaaaggaagtttttagaagtgtttctttactaaggataagggaaagaatgctaacacttatctgtttacctttgacatagaaggaaatgaagatgaatgtgatgtttcatattcatcatcattctcttatgcaggcagaaaacgtcacaaactattagcatattaagtgatggcaaaactctggaaaaaaatcttaaactgagaaaatgtggatcaaaaggcagtgttataacatttgcctagcccttaaactctgggctttatgataccaagtgaatttttaataaaactctaatcagtgttttccatctaaatgcactagaaagagtagacattgaggagtgtacttatttttcaggtttttattaattcatgtaattcagttacaatttcaggccattttaagttgataattaactcatacaaagtatacaaatggttaaaatatacataggttttataaaacactgattaatttctttgtcaaggaatacataattatgagttacacgtttcattgtagggcactgtataatatattaatattttttcattgattctttccagaactcacaaaaagaactgatggattacatttcagaacaatttgcatggaagctgagcagattcttagtgatggaacatcagttttgcattacgatgttcacaatctctatggatggtcacagatgaaacctactcatgagtaagcaatgttctgaattatcctctctgactcttttattctttggttcttacatttaatgttatcattttaacagtcccgacaatcttctcttgtatctctttacttcccaattgttctctgtaacttcttccttcatagcatttagaaaaaatgtgtttctttctatctaatttatctaaatatctttattgttattattctaatttctatactattccaaaataaatcctagaccatttttattttgtttctatgtgcccagcatagtgcctggccaattgtaggtgctcaataaataatattggattaatatttataaatgaattaataacatataatttgatatcattaagacataaagcatcaaacatttggcgaaatctgttatttgaattcattgtcagcccaggcacagtggctcacgcctgtaatcccagcactttgggaggctgaagcgggcggatcaattgagaccaggagttcaagatcagcctggccaaaatggtgaaacctcatctctactaaaaatacaaaaaattagccaggagtggtggtgcagagctgtggtcccagttactcgggaggctgaggcacaagaatcgcttggacctgggcggcagaggttgcagtgagccaagattgtgccattgcactccagcctggcaacagagcgagactctctgtttcaaaataaaaataaaaacataaaataaataaattcattattagtaaattagagcacttttaatgaacttctcaaatattaatgatcatagtaattatctgcatttttaacaaacttttatgtaaggccaatgatgatggaatacagaccattcactgaaaatcaattctttattagcactttccaatacaagttttgcagtgattgaaatcttctggccaggcacagcagcttatacttgtaatctcaacactttggcaggctgagatgggaggatcacttgggcccaggaggttgaggctgcagtgagctgtgctcctaccactgcattccagcctgggcaacaaaacaagaacctgtctgaaaaaataaataaatatatagaaatcatctataattctgggtgccaatgtggtacttaccagccatatatggccatggaacaatgtgtctagtgtgactcaggaatggaattttaaagttatttaattttaagtagtagtatacaataattaaatatgaaataatagataattagtggctaccatattagacactgcagttgtagatccctggcttttgactacatattataatcacttggagattttctttttagggtttagattttttttaagtgtcatgtgcacatagtaggtgggtatatatattgggcaagtgagataccaagcatgcaatacacagtaatcacctcatagaaaacagaaggatttttcccctcaagatttatcctttgtgttacaaacaatccaattacacttttagggttttttttaagtatacaattaaactattattgactatcatcctgttgtgctatcaaatagtatatattattcattctttctaactatatatatagcacccattaaccatccctgctgtattagtctattttcactctttcataaagatactacctgagactgggtaatttaaagatgtttatttaaagactgggcaatttaaagaggttgaattgactcacagttctgcatggctggagagtcctcaggaaacatacaatcatggcagaatgtgaaggagaagcaaggtgcatcttacatgactttaggagacagagatagtgatgggagaactgccatactttaaaaccatcagctctcatgagaactaactcactattacaagaatagcgtaggggaaaccgcccccatgatggaatcacctcccaccaggtcgctcccttgacaggtggggattgcaatccctgatgagatttgggtgggatcacaaagcccaaccataacacttgctttcccctcacccccacacaac

SEQ ID NO: 16499 - DNA, 7295 bp, Human
catattctcatagaaataagggaacacctattaccctccttgcactgcttcctgcacagctgggatactacctttcacaagcatcctgagccacctgctggccttttgtgtgtgtttccttcctggcttcctcccatttttttttccatctctgaacctgctgtaaggtgaagaattgaggcgggccccaaatgtaagacctcatgaatttgacgatgcaacagtgtcctggacagcctggctctcagggctggggagctgggcagagagaaaagagggcattccaggggccagggagctccaggcccagagtaggatttcaaggctaaagaaacagaggctgtgggtgggtagagggtcttgactagggtagggacagagggtgcgtcttaaggctcagctagggacagcttcatccaggaagtagtcagcaattgggggccaagctgcaaggaggaagaggtggggagagagaatggagagagaggtgttcagtgatcaaatgcctggcctggcctgtttcctcaggagacacccctgggagtctgggagcctctcccccgggctgctatccaacagggtgcaagtaatccccccttacacacactaagaacccagggtgagtgtcaaattatatgttagctaagaaatgaagagagggagcaggatttctggttgacggtgaggatatttattaagggtttactggtacaaggagaggggctggatgatttggggtgggaggggatctctgttctgggatcctgcagctccaggcccccatgggtggggtgagggtcagggacctaagaacattcttcaggggccactgtcttctccacagtgctctcttgtgtgtgaccttacagctgtagctgctgcaggacctccactggtcgggtgtcaggctcaggtcgcttctggctgtgtgcttgttgctctgtttggaggtcttggtgacttccgtaccctgggtgacaggggtgctgtttgccttccaggccaccgtcacagctcccgggtagaagccactcatgagacacagcagtgtggccttttggcttggagctcctcagaggaggacgggaacagagtgaccaagggggtggccttgggctggcctgtgggtgggcgagcggcaggaggtcagcatcctgttgtgtacctgggagccccctgacctcagtgtatgaagaggggtcaggccccctcagtgccagtgtaggacccctcagacatggtccacagtgtctcagaagggtgtgacatgaggttcctaaaacaactctctgtcattcagggaacctccgagcctgtcccctgcccaccagtggtggcagttaatttggtattcatttccaaggctggagaaggatgtaattttttttcttttcttttcttttggtgagacagggtcttactgtgttgtccaggttggagtgacctggcgtggtctctgctcactgctaatttttgtattgtttgtagagatgaggtcttcctgtgttgtccagactcgtctcaaattcctgggctcaagggatcttcctgccttggcctcgcaaagtgctgggattacagatgtgagctactgcatccagcccccttttttttttttgagatggtgtctcactctgttgcccaggccggagtgcaatggcacaatcttggctcagtgcaacttctgcctcccaggttcaagcgattctcctgccaaagcctcccaagtatctgggattacaggcgtgtgccaccacgcctggctaattcttttgtattttcagtagagatggggtttcacccatcaggctggtctcgaacttttgatgacctcagatgatccacccaccttggcctcccgaagtgctgggattacaggcatgagccatcgtgcccagcctctcagctcctaattcttatgttcatcaatcagtctcttgctggggttcccctaggaggtggtgaaatgaccccagctcgctgttcctcacatgggtgctgccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaaggtaaggaatctgtataccctgcccccttcccaagaccagaccaggaaaaatcatctgtgcagttggcccctcattccacatggggattagctgctgtctggcacctaaaattgagatgcttcatcatcacattctcagccctgacaacacatagaatcacctggtgatgtcaaaaacaaaaacaaacaaaaacccgatgtctatgtcatgggttagacaagggattctctaaacttagtgtgctcagattacctggggatcttgttaaaatgcagatgctgaactgggaagtctcaggattgatcccgctggcttggggactttgctgagtagcaaaaacatagagcaactgaatttgaatttctctctagcaaaggttcccatgaatctaacattaagatgggcctggtatttctaatgcacagtgaatattggcacccattgtaccaaacaacctcaccccagggttgagaagagttgggaatggagcacctatggtgtttgtttctgtgagtggggagagttgcagatattggtctcctcatccatgcgccatgggctccaacagtggtcctggctacagaaaatactatcactctccataactctggggaaaagggacatttaaatgaaaaggttatggtcagcctgggcaaagaattacacctataaatggtggtgggcccctataatgtccctgacactggtagcttctgccctgacacccatgatctctactcatccatctacccatacctgactgtctctctgctgaactatggaggacagagattcaccctgtccaagtcatgtttggaaccctcttcctccttccttgtccatgtccattccctaattcaccattaaatagcaatcaatccctagtcttgactagggtagtcttactgtgatctataaaatctatattagtgatcatatcagttttttgacttgaaggataatatattttgtagatttttttttttcagaatgttctggacaattaattttctctaggccagatcacactgcctcctccatgagaattggcggcttcacctgtcagtcacatacccaatgccttaaattattgacctttgtattttctgcccttattctctacaatcagtcagttatgacagacaactttcaaatacctttctcttggctccaaaatttaccattgttttgcttaaggtctcaccttccatgtaggatagaaaacattctttcatctaaaaggtccccctcctccacctggccttagagcctcctaatgtccaggaccagcatctctgtcatcacattgtcagctgcagagataccctatctgctgtcagaactgtgcacaattaatttgtttacaaacatggaaaacaaaagcctggaatcatgctctatatactgaattggagcaataaaatgtggaagcagaaacatatttaatattgaccacttgcattgtcttaattatcatttatttgttcacacatcaaggtggtagaaaggggggcatggtgtctgccttcagagaccctccactctaaatgaagaaaagttcagtgaagcaaacacgtgacgtaaagtaaaataagaattgctactgtgaataagagtcacgtattgccacaaagcatacctatgaaaatttgaaatagggaagtttcctcatgaaaagttttgattttggaggaagaaacagaattaaagaaactaaagtcaggagatatttgggcctttgaagtagaagagaggcatggggttggcttctgtccacttgctgagcaacttgttttccttttcacagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatcacctaatgcatcatgtgattttctaaatgataggagtgcaatagattttattcatagtaaaaacatgagtgtgtgtgtatgtgtgtgcgtgtgtgggtgtgtgtgtatttgaacggagagctggataaatgcctatgtcctatccagaactgaaaagttatcgccatcattgctcagtgtgggtaacattttcctggatgtgtgttcctgcattaatgaaaattccccccaattagttattgcaattattaattgtaattgcaataaaattaataaattcattttattaatttattaaattaataaattaattaataattaaatctttatgcagagattaataaatatgcaggctaacaaagcaaaaaaagataacacacattactaatatcagaaataaaagaggggccatatctaccaaactgttggtcattaaaaggataatcaaggactattatgaatgactctattcccacagtttgataactaggtgaaatgtatcaattccttgagagacataatcttctcaaggtcacactaggaacacagacaatctgaacaagcctctgcctattaagtgaattaacattaagaacattccaaaaaagacaacaccagaaccaaatgatttctcttacgaaatccaccaaattcttacgaatcccaacatattttcacaatataatccgaaaattgcgctcttaggtacgtactcagttgagatgaaaagttacgtccacacaaagcctgcacaggaatgtttacagcagctttatctataaccacccaaactagaagcgagcaagatgtttaagaggtgaatgaaaaaacaaccatctataaaacacaatattattctgtgatttaaaggagttctccatcaaagcatagaaaagacaatggcatgtatcagaaagactgtgggggcatgcattcatgtggatgagaccacacaggcagcagagcagggtgactttaagtatattgatgagtgaagtaagttcagctgaaaaagctacataatattgggctggtgcaaaagtaattgtggtttttgccagttgaagaatggaaaaaccgcaattactttgcaccaatctaatatatgactccaactgtatgacattctggaaaaggcaaaacaaaggggatggtaaaaataccaatagttggcaaggtttctggagaaagaggacagagattcataagtaaagaagagggaatttttggagcggtgagagtattccttacgagatcgaaatggtaaacataacagtaaatatttcaaaattcatagaaatgtgtaacaggaaaaagaacactatgagaatgacagactttaggtactaatgtatcaatatttgcccattacttttagcaaatataacacagtaatgtaagatatgaatattaggtggaattataaggtagggtgagagaatagaatgatgtgggaactttgtgtattacatgctagatttttatgtcaatctaaaactcccttggttaaacattcagttttaaaattatagctccactgtttcagggagatcacaataatgttcaacaattgagtaacgtctagagattagtttgaaagattgtcttactattaaatgtgaatcaaaattgacttttaaatgtatatttaattttgtgatttcagcaatacctcttgattaggcaaataaaaattttggcacatttaaacatatggcttaacctcctctatagcttcttctaacatatgggacactgaatacaatccacaattgttattcttaaatcaacttaataaatttccacggtaccttcatgtgagtgcacccggtggtttgcccagagtccaggttgtgtcatgtgcctcttggtgtagaggctatatcttcttaaaatttctatcagagaagagcctggttaatctttttgcaatgcagagaactaatgacatgttactgacagaagaccagagggagaattgtgataattggttctaacttc

SEQ ID NO: 16500 - DNA, 11665 bp, Human; identical to SEQ ID NO: 12446

SEQ ID NO: 16501 - DNA, 30635 bp, Human
tgtgattcaatagcttcgctccatgtgggcctctccattgggaagctcaaaacatggcagctcaattgcttcatcagagcaaacaagtgagagatctcgaaactgaacaacacagaaatcatttataacctaatccgaaaatgacatccaccatatttgccgtcttctattcattagaagttgctaagtgatacttctagtgacatctagaagagaagaggatgccactaggccacgaataccaggagggtctcagtgtaatcagactttttatatgaaggctcagggatccaggcaccagtattccagtgacccagcctcagaagttacacagtgtcactctgcaggctactgatcaaaccagtcacaagcccacttttatttcaagggaaggaacaacgaattctggagccatgttttcaaactgccccagctattattatttttgaaactgtgcaaggatcccctggttcagaggtcttatggatgctgtcatctttgctgagatacctgcttgtgccttcagcatggaagaatgcctgtgtatccacctgtacggtaggggtcgctgtgactttgactggtgagggtacagccactggtgcacatgcaaaggtgcctatctgtgaacacgtattgagaggctggataaggctgcgcccatgtgagtgctgggcttgtacgtgcatttttgcctgagtgagcattagtggcagtgtccccagcctacccctttcctgaatcccaggctcatagccaactgcccacctatttccacgtggatgcctgctgagcacctcaaatgtcacacagccaagacagaactctggatctcctttcccagccacaagctgcccctcttccagtctgtaagttcttacggagcatatatatgtgatctgcctacttttctccaacctcaccacagtgacatgagcccaaaccaacttctcaccttgcaacagcctcccaggtgggaaggctgagtattctggcccttaaccagttagaactccccagttatctgtcctgctgatggggttgaaatctacattcctgaccctggcccaccaaagcccctcccttagctcccatctccctcctctctccctgtcttctcctctgctccagacactctggcttcatttctgcgttttttgtaccccataagctccttcccaccccggggcctttgcctttgctgttccccctgcggggaatgccggatctctgctcagatatcctcttctcagatcagcaagctaaagcagccacctgtgtctgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtggtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttctaccagggaggatggcttgctggtgtgtcccccccaggggaggactaccaacgaaggggacccgggagatggcgggtgggggcccccgggaggacagtgggcgagggagggggtccttgccaggcctggggcggccgggggcggtcctgggctcccctccgtcccgcctccaggcctcggggcctggctggccgacgtggcgttggcggcgctgcgcgcgggagggcagggcaggagggacagaggcgggggcgggccggaaagtttgtccggcggcagcggcgttggggactccggcgggggatgcgcgcccggcccctcagcgcccccagcacgccgccgagtcccgctcgccatgggtaagtcccgatcgggcgctgcctgctggaagcccgaccccttcccagggtgtagacaccgcccccacgctcccctaagagtgcgcgccccctggctcccccagggccgccccggccggataccgcctctcgggtggccagcccgagactgcaggcctgcggcgggggctgggacggggctcggtcgcgcttccttccatcttcctttctgccccggaaaagtggcccctcacttgctgcagcgcccactcgggcccaggcactctcccgggcgccctgatccgacagccccaggcaagtgcagctgttcctggtctgcagatgaagaaatggaggctccgaaagaagcaaagcagttcatcgattcgctgagcgcggttgtgccccaggcgctgttgtgggcctggggacgctgtcgcgaacgaaactgcgaacaaaacagacgaaccccctcctctggacgtgattctgcagagaggggacagagaaggagattctaacacagcattggggtgggacgcgtggggaatggctttgttgccactcgggactagggctctatttttctctctgcattcagaagcctcgaaggatcagtcgttgattcttgagtgagcacctactacgtgccagacattgatataggggttagagcttcagcaatgaacaaaatagacaataaacctctctctcatggaggtggcattctgattgagcagctgggtaaacacgtttatgaataacttcagagagagataaggtgttgtggaacccataaaatggggtggcgtgaaggccaagggcgtgggttccttgggtaggtggtcagggtgggttttctggagtaggacgttttggagctgagaacttcctcagaagcgggtcttgctgagatctggagaaagagcttccaggtggcagcaacagtgcaaaggccctcaggcaggaatgagtttgagtggcccaggccaggatggccagagcacagcgggcagggcactgaggtcaaagggatggcagagaggtgtgcagggctttgtaagccgtggtgagaagttcagattttattgcaaatgccacggcaagctggagaagggttttaagctggagcggggccgtgacctgaattatcttttcttttttttttcttttttttgagatgatcactctgtcgccaggctggagtgcagtggcgtgatcccgctcactgcaacctccagctccctggttcaagcaattctcctgcctcagcctcccaagtagctgggattacaggcatacaccaccacgcccagctaatttttgtatttttagtagagagtgggtttcaccatgttggccaggatgtcttgatctcctgacctcgtgatccggctgcctcggcttgggattacaggcgtgagcctccgcgcccggccctgaattaacttctcaaagtttgctctgagtcgttctgtggagaatcacagtcgctaacactggctatgatgtaggtaagcatagaaggtaggcattaatatcccatttgtagatggggaagcccagagaggtgaggtgagttccccaaggtcacacagctatggagaggagaagctgggaaggagccccagcattctgactccagtctgcattcctaaccactgcaccacgtggcctgtcatggtggattaatggtaaaactggtgaccagttccggctctgacaggagagtccatcctcttaacccccacagcacagtgccccagagcctgagaaaaaaatgaggcccagagaggtcaaggtcttcttaaggacactcagcttagccctagccccttgttcctgcacctcctattcctgctaaatcaacccaacagccatttgctgagtgccttctatgggcagagcgagggctgggtgttagtgctgggggaggcataagtcatggctgcgggtctctgtcctccccagaattcttacacagcagggaccagggattgggctctctttatagcctctgggggcagaactgggttctagacccaattcctctcactttgttccaccattccactttgacctgggagagtctgccaacttctctggtcactatcaaatacccttatcacagggtagccatgagaatgatgtgaaaaaatgaattacagtgctcggctcatcacctatatctggtaaatggtgagtgaatgtgagtttttattttatattgcacccaatattgggattctggagtcagactgcccgagttcaagttcctgctatgtgacttacaaactgtgccaccttggggaaatgtcttcacctctcagtgtggtggttatttctgtaaaatgggaatgacaatagtgattgtcataggattgtctagggattaagccagctggtacagatactgccccttaggagagtggctggctatagtgggtactccaagtatcagctgtggctgcaattgctgggacatttggaagccggccatctgcaagaggatattcatacagttcaatttcacttctggcttctccctggagcttcagggaaagccacagcaggtctctggtgcaggagggacccagtgctctgtgacctctggttgagacactactctagtgtcaccaacgggaggcctgggacttgcagctggagatacttgcatcccaaaccagggttctcccccctccccctgccccctgactctgtcccggggaagctgtgccctccacagcgaggggcttagaggattaagggatttcctccagtgtgggacatcttcactacagcctatgttaggcaggttattaatagaaaggatgcacacttgctaaacttaggtcaagccgtcttaatgtgttctccttaattttctttcttttctttttttctctttctttctttctgtcttctttctttctttttttttttttttttttttgacaaagtctggctctgtcatctaggctagagtgcagtggtacagtctcggctcactgcaacctctgcctcccaggctcaagccatcctcccacctcagcctcccaagtagctggaattacaggtgcacaccactattcctggctcatttttgtattttttggtagagatggggtttcaccgtgttacccaggctgatcttgaactcatgaactcaagtgatccacttgccttagcctcccaaagtattgggattataggcatgagccaccgagcccagcctaagacatcttaatttgaggacgaggctttgctctgcttcctgtccatggccacttccaggccctggacctttcagatgttcatgagccaagatcctttctttctggatttcctacatccccacagttcatttggtttttcattcattcactcaatcattcatttgtttaacaaatattattgattgagtgctgagtaactgtccttggcctcagggagacagctgagaagaaacaaaccactcctgttcccttgaggctgactttcaggtcagggagaccaataaatatgtaaaatatgtagttattttggaagatgagaagtgccacgcagaaaaaacaagtggagaagggaatacaaagtgctagatgctacagggaggttgaattttaggtagaaggccagggacagcctcaccgagaaggggatgtttcagcaaagatcagaagggaggaaggaaggaactgttggcatggagggacaggacttcccaggcagagaggctggcaggtaccaagctttgagttgggacgtgcttggagtgagagtagcagcaaggaaccagtgtgactggagcccagtgagagggggcagatcctgcagagtcttgaaggccacggtgaggacgttggcttttcttagactgaaataggagccttggagggctcctagtggaagagtgacgaggcctgacttaggttttcccagaatccttctggctgctgtgtagaattagtttaggttcagaggtatctgacacagccctagaaatgtcatgaggtgaaatagccctggtcctctacccagtcatttgttcattcagcagaaacttcactgggttcctcttgggtgtcagggcagggctggggccccggaggctcaggacgagtcagtctctatccctgccctccttagttgaatatggaagactcataaaggaacttgcagtgtgaaggaaaaagagtacagtggagagttgaggaagatgcatgggaattggtcaggaactccctcaaacttttccactgaaaggcactaagcaaacatcactgtctgctgataggaagggtacttgggtactgagattaaaaaaaaaatgacaggccaaccttcagaaaatccagaaattggcaatgagtatttatgggtcactgaagtctatggcttcaggtgcagttggatctaggggctcatacagtgttgtcaggaatccttcattggggaagatggcccccagtggctccaggcaagtaaaacaccagcttggcacccctggtgagcaaacacacccggtccgactctcactggcccaggttcacccacgtggtattcacctctgcctagggcccaggaatttgctgattgattggatctggatcatggacaccaccctggggctgggcactgagggtggaggtgggggcagtcatctccacccaaaccaggagactgtgagacaaggaaaaggggcggctccctgcaacggaagatgaggagcggatgccaaataacagatgtgtatacctggaggctccttggggaggtggcacaggacctgggactgaagagggagagtagaggaacaaggggaccctttccttggggaacaaggacagtgcacgtaggaggcccagcacgtgcagtggtggagcggcatgaaagcatacagtatgtgccgggaacaaacatgttggcaaggtgtgtggggcggggctgtggcgacagagtccgggaggaggcgaagtggctgaggagttaggccagcccatgaagggccttgcctgtcatgctaaggtggtgggactgactcaggtgatgggaaccatggaaagggaatgttcttcctcgtcttcctaatggctccaactcctttgaggtcctcctttatatctacagtcccatgccacagtatcatttcaccatgctttatcccttggggttttcctgagagctctttcccctccacctctgcctcctgcaccccagtttcctcccaccgcacctatctctgattgactcttcttgctgggaggtcagtgcagcggagctcttaaggacatgggtttgggaggcaggcaggtcagcatttccatcctgatcctgttgcttcctagctgtgagaacactctgagccttaacctccacatctgtaagatggaataattgtagcagtctcacctagggttgttatgaggatgaattgagggaaggaacataaagtcttcacacagaggaggtctccatacatgatagctgttattattactgttttatttcacgtttgtttgtttgtttgtttgtttctattgtccattggccttattgtccatttcaactgaacctgcactgatgtgttttccagtggaacctgtgggtggaagctgtgagccctttggctgggttccctttcgctgcaagaggaacccaggaaatggcaaacaaatcctgggctttcacctcgattgcttcacatggcctggaaggaccttgctttctgggaaaaagcctcaggaatgagggaggaggggcaaaggggggcgaagacagagcaggatctgagcagcatcttccaggatgtttactagtggtgaggaacaggaaggacaggccagccagggagtggcaagggctcgtttccttggaaggtaggagtggcaggggagagggatgagcagaagtgggggtggagaatgattccttcacccatggaactcctccttctgcacaaaaactgcctaacaaagctaagaagggacccaagcaagagaacagagtgaaatcacatttcaccaaggttttataatggagcagtcaagagtagggactgtggacccagacagcctggctttcattctatcctcagctgcttacaactttttttgtttttttattttagagtcagggtctcagtctgtcacccaagctggagtgcagtgtcacgatcatagctcactgtaacctcaaactcctgggctcaagcgatcctcacacttcaacccctagagtagctgggactacaggtgcccaccaccctgcctggctaatttttaaaccttttgtatagagacaggatcttgctatgttgcccaggttgcacttactacttttgaccttaagtgagttgctttacccccctgatgatcactttattcattcgtaaataatacaagagcctacctcataacgttggggtgagaactttttttttttttttttgagacaggatcttgctctgttgtccaggctggagtgcagtggcacgatctcggctcactgcaacctccaccttcccggattcaaatgattctcccacctcagcctcccgagtagctgggattacaggtgcatgccacacacccggctgatttttgtatttttagttgagatgggttctcatcatgttggccaggctgctcttgaactcctggcctcaagtgatccgcccgcctcagcctcccaaagtgttgggattacaggcgtgagccaccacacctggccataaatgtgtttttaaactcaaagcaatgtctagtccagagaaactctccatacatctggctataatattgcagatgtccttgtcaggtccagggtgggggtgcatgacatagatactgctggattattctagatgcttccagaaatatataaatttaagtgtgtgaattaaaaattaagagtaatctgtgcaactgtgctgccaatagggtagccagcatccatatgtggttatttttatatgtacactaatataaataaaataaaataaaataaaaaattcaggctgggcatggtggctcatacctgtaagtaatctcagcattttgggagactgaggcgggcggatcaccagaggtcaggagttcgagaccagcctggccaacatggtgaaacccggtctctactaaaaatataaaaattagccaggcttagtggtacatgcctgtagtcccagctactcgggaggctgaggcaggagaattgctagaacccaggagatggaggttgcagtgagccggaattacgccactgcgctccagcctgggaaacagagtaagactgtctaaaaaaaaagaaaagaaattatttcctgcatcccgttagccacatttcaagggctcattttctacatgtggttggctagtgactatcatattgcacagcatggttatagaaatttctgtcattgcagaaaatgctgtcagatagtgctgctctaagaagaaaggaaaacatagaaaatgtaacactcagatcagtgcgggaaaaaatggaaaaaaaacccaccccataattgatccatcaaaagcagaaatggaggtaaaaagaaatatcctgatagcacagtaaatagaagacaaaaagataaatggcagaagcaatttcaattgtatcagtcattgtaataaatgtggaccagttcacctttttatttatttatttatttttgagatggagtcttgctctgtcgcccaggctggagtgcagtggtgcaatctcggttcactacaacctccgcctcctgggtttaattgattctcccacctcagcctccttgatagctgggattacaggcgcccaccaccacgccaggctaatttttgtatttttagtagagatgggttttgccatgttggccaggctgttctcgaactcctgaccacaggtgatccacctgctttggccttccaaagtgctgggattataggtgcgagccaccacacacggccaagttcaccttttaaaagaagacagtcagattgcatctgaaatcatccagctgtatactgctttcacaaggaacacatgacaaatggttacagatctaacctgttgggttaaagtgctttgaaaatgcagacactgaggagggagcgctcactgtctaaatgtaggtgcctctggggtgaacaggtttcagaaggaggagacaatgtgagttgagaaaggctaaatctaactacagctgttgaaaataccttgactgccatgcatggtgactcacgcctgtaatcccaacactttgggaggcctaggcaggaagatcacttgagcccaggagttcgagaccagcctgggcaatgtagtgagaccccacctcttcaaaaaaatcaaaaagttagcctggcatggtggtgcatgtctatagtcccagctgcttggaaagctaaggcaggaggatcacttgagcccgggaggcagaggcagtgagccatatggtgccactgcactccagcctgagtgacggaacgagacctcatcttagaaaaaaaaaagaaagaaaatgctttgagctttctttttcctgtgtctgttcttatggcgccttcattattccctgtgttgtttggatttctgtcttttctccttatttatgcttaccaaagcattatctgttttcttatccatgtcaaggaaccaacttgagttttagcgatcaactatcctcttcttgtcgtttttccattcccttaacatctgttttcatattcactaattccacttgctctttgggttcattttgttctaattttcctagcttcttcacacaaagacttaattaatttactctcaggttcttttggggttcctgataaaatataattttcacttgattatctctttgaccacatcccacaggcccattttttatgtgggccttttattctcatttcattatttattacaatttttattctcagttatttttatcctcaattattcaagatttttaatctttattttatttattctcattcagtaggtggttatttctattttgtttcttctttatgccaagtaatttagatgtatattttatattttattttattttttaaagatagggccttgctctgtcacccaggctgggatgcagtggtgtgatcatagctcactgcagcctcgacctcctgggctcaagcaatccttctgcctcagcctcctgattagctggaactacaggtatgcaccaccacacccagctaatttttaaagaaaatttttctgtagaggtggtgtctcactatgttgtgcaggctggcctcaaactcctggcctcaagtgatcctcctgctttggcctcccaaagcgatgagattacaggcatgagctaccacattcggctttagctgtgtattttaagtttctccatgtatatttgggcggaggggggtgttgttgttactggttgttttttttttctctctgaatgaaaaagccatggttggaaaaaaaaaatgcttgtctgcaatgccaggaaccaacaggcttagttttgctatttggcctgttccctttgcactagatctgcagcaaagagtgaaatggagtcagcgtcttcttcctcttattctcttagcaccagctgttgaagggttatgttttgaaggtgtattagtctgttttcatgctgctgataaagacatacctgagactgggtagtttataaagaaaaagaggtttaatgaactcacagttccatgtgtctggggaggcctcaaaatcatggtggaaggtgaaaggcactttacatggcggcaggcaagaaagaatgaaagccacgtgaaagggattccccttataaaaccatcagatcttgtgagacttattcactaccacgaaacagtatgggggaaccacccccatgactcaattatctcccactgggtcccttccacaacatgagggaattatgggagctacaatttaagatgagatttgggtggggacacagccaaatcatatcagaagtggagcaggagatgacatcaaatttgtgttttcttaatcaagtctggcattgggcaggactgctacaggtggtaacagcaatcatggtacttctccttgagcatacttcctgagcctcctttctctactgaactcttccaagagccagtgagaaaggatttattagccctgttttacaggtgaggaaacgagttcaaagagaagaagcagcttgcccagggtggcacagagcaagtggcagtgctaagactggtactcaggccttttcagtcctagtcctcattgctttacactgtgctaagctgtcaacacagcagatcatataacaacttagaggaacagcatccattgtttcattttatcttcccactggctctgaaagcaaacaaggtgggtattattgtccccattttacacatgagcaaactgacactgagagatcagaagtaccttggttcaagtgcagctgagaggggcacagagtgagatgaggtatgcacagatacacaagaaagaagcttaagaatgtctttaataaccacagctctcggatcactggattcatgaggactggaaggggaaaagaagcaaatggcaagaaaacagatctaccaaaaacaaaacaaagcaagacaaaaagcctctcacattcttacattcagccaaggattttgtaccttcttcactagtttgttcattcataaaatgggaatattgaaacactaatttctttggatttaggaagaatttttcagaattattatttttgagctcctcctttactacccttttcatttttcatctttagccaatggtccatttggatataaattaaactaatctaggactaaaaacctcacattgtaagatacggaagtcagaattattgtgcagtttggtatttcctaagtaatgaagtagttgggtcatggcgtgctttcctgattcccacaaactgacccttgtgctcgctcgtcatgtactcaggaatctttattccattttaaaggagaaaaatgtttgaatggatgctttatatattggtatttttaacacacagatgttgtaacatctttcattaatgtgtcaggagccctttggaagagactgatctagtaacatttcctcattttatagatttccttattttatattcaagttatctattgctgtttaacaaaacactccaagacttagcatcttctaataataatcatcttatatctactagttctctgggttgaatgggctcagctgggtggttcttctgcagctgtggttggaatcatctggaggcccctgtctgttgcctaagggtctctccacacagtttttccatgtgacagtgtagccagatttcttacagagtggcttggggctccccaaaaaaacataaaatgtggaaattgctcaaggtttagacccaggactgaacagtgtcatggtagccatattctggtggttaaaactagtcacagagctactcagattcagtgtgagagggaaccacataaaggcataacaccaggaggcatgactcattgggagccatctttagagaccagctcccacagcccaaaaagggcaagtgactggcctggtgtcacactgcaagttagttaccaaaacagaaaagaaccttgttttgcaaatctctaaattattgtcctgtcctcactactatatatgtgtaaaaatgacttgggggccctacaaatccctcaattagcaaaaaaaaaaaaaaaagagagagagagacattgcaggtttttccatgagtctggaaattctgttgctcagtgtactaattgggagcttttaaattataatttacagaaaccaactcaatctgactaaaagaacaaagagtattggttggctcatgtaacgagagcccagtggattgggtaagcttcaggcactgctagatccatgggttcatgcaataatattgggatctatttcttgttatcttttggctctgctctcatctgtgttggtttcattttcataaaggccttctgcacagcatgaccaatgactattttgtttctgtaacttgaaattctcaaaaaatgtagttcttttttcttgtctatgtatagcaattccctgagacccacttgctcatccctatgtgtgggtggagagtacatgtgactggtaaccccatcagtggggaaggggctcttcctcaaaggaaaagattccaggcagacagaagaagtaacaaatgtttactacacccagaggcttgtattccttgaagatttgtttccatgtggaagcagttgaaaactggtacctatgggttgcactctgagatgtgttttgtctgactcaaagaatatttttatatattcttggaacagcatttaaaaatcagaaaatagtttataaaaatctggatttatggtttctctttaaaaaaaaaaccagatctggcagttcttgaccttcctgttttccaatttccttatctgtgacatggagatattagtaatacctaactcgtgaggttactgttccatggtgagcaggtctatgcaaacctacctctgaaggctgaggagctgagaggccaaagaaagaggctgacaaatccagtcttgcagaaagaaatttcacagggacataaaaacaggagccatatctcaggtagccacaagaccgtggattcccatacctgacctccagaaagtattcttaatatatcaagcttttagcataaaacatgtgcagctgatcatgtcttcagactttcttgccaagacttgtgaccactggagaggctggataagcatctttatgaagggttatctatgctacaggcatttttaaagaacttactgtagaacaacttggtatgtggggcccaaatatccatcatcatggtggtttcacttcaagatggcctcactctggccatgcaacagggtgttttcctacagttgtgaggattacatgaaatgatgcgtttaaagtttctcacactatgcctggcacatagggatcagtcatgaaatggcagttactcttctaataatttgcctgagattatacagtcggtgtgttaacaatacctggagctgtgttgtgactttagatgaggcatgaactctccagtttggcaatccccaccattctttgttgtctcacatgcagcccgtgttcctcattgatcttaactggcagctccctgctatatagcatttcttcttagttttcgttagcactcttacctggacccttgtactagccttccaacctgggtttgctcttgctctttggtttcactgctaggaatagaaactggaaatagcatagtttcactaagtcagaaattgttgggattttcttcttagcacataaaaatatatggagattgacaatccattgttggtatggtaggcttactgccatcagggacccattcttcttctatatttccatcctactatgtcggtgtgtagcttgcatcctcatggttaccccccatcatgttccaagatggctgctgaagctccagtcatcacacctgcattccaggcaagaggtaagggagctagaaaaaagggcaaaaaagatctagccagctgtttccctcctcaccctcttcttggagagcttttttcaatgtcccaccaaaaaaactccctcttccatcttagtagccaccaatagctgtgggaaaggtgggaaatgtagtcttttagctggatgtagtcctgataccaaagaaaaaggggtgaatggacattgattgggccacattcacctcatttagcatctccatacaacagcaagagcaatattttaaaaattaaaaatagatgaccgatttgtttcctgttgggactcataaaaaatgaaaaataaaagtagatcacctcattcctggctgaagccagcaaaggcttccaaccactgagaatgacattcctcattgtcctcttgacttgcaaagccccacatgatctggcccctgcctatttctcctgcctcatcatctcccatcactctcactcactgggcttcagcctctggcctcctgtctgattacctcagtgattaaaggtcctcactttagccacatcatctctacaacttacttgttatgtgaccatgagaaagtttcttaacttctctgcactttggaggatgatatgttatagggtagctgtaacaattaaatgagaaaatacatataaagctcttaaaacagattctggcatttagtaagggccatataagtactaaccattaatatccatagttgttcaaacaccaagaactgtcctacctcagggcctctgtactttgtgttcactctgtctaggatgttcttctcccagattttcctgggactttcatgtcactcaaatctctgctcaaatttttgctcttcagagaggccttaaaatagtactactccatcaaccttaattctccttccctgcttcattttttatgacatcttcactatctgaaattatatacttatttatcatcttcctatttcttctagaactttagatcctggacaacacatctgtattccagccctaagagcacttcctggcatgttgtaaatgccagataaataaatttagatggatggatagatggatggatggatggactgatgtgtggatgagtatacaaagggatgaaatacagagatgggtggatgaatggatggatttgtagatagactgatcaacaaattgatggatggttgggtgaattaaggtatagataaatggacatgcagatggatgaatatttggatggatgaagtagatgaatggatggaggatgcatagatggatggatgggtggttgaatagatggagtggatggaagaatggatggatagttaaatggatgattgaacagatggtgtagatggatggtggttggatggatggatggatggatggatggatggatggatggatggtttggagtggatggatagatggatagatggatcagtgaatggttgaatgggtggttgaacagatggagtagatggatggaggatgaatggatggatggttgaattgatggagtggatggatggacagatggaaggatggatggatggatggatggatggatggatggatggatggttgaattgatggagtggatggatggacggatggatggatggatggatggatggatggtttgaatggatggttgaatagatggagtagatggatggataaatgaaggtgttgacagatggagggaaggttgaatggatggatggtatgacaaggaaccattctaactctgtccctctcacttttgttttttaggccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccaggtaagtggagttttcttgcaggtgactctggagacttctacccctcctagggggaagtttggggacttcccaccctgatgacctggcagggtgtcagtggggcactagaggtgggttgaccatgaagcctcagggcccctcacttacctgcagttgctcctcccagggccagtgcctaattttatgtttgtaatttgtattccttaaaagcctccccaagtcatttgagcttcaggtcccttaaagcccggatagctcacaactggaaggaatttaatgaatagcgtgaaaaccaatcatcccagttcgtccaagactgttcccatctcggcattgaaagtctcatgtctcagaaaacctctcagtcttcagcaaactgagactctactgtaattcttatagcagaatgggagtgggagtttagtatcaggagcctgacactagaaaatcccattgttgagaggctgcatgtttgacctgatggtgccaggccccaggtcccaccacagcccaggagccctcctgctctcccaccctagtgacctggcttgtcctcagcgagatctaccctgtggagatacgaggaagagccttcgccttctgcaacagcttcaactgggcggccaacctcttcatcagcctctccttcctcgatctcattggtgagtccttcccagacaagtccgttttttttctgtggcccaagctccctactctaaagcagaaatttttggattttcctatgtattagctgcagaactattattctgtgcagaaacatcatcaaatgtccaagacgacatccaggaccctcatatgcactgtaaaactccccaggccagctaatgggtgatggtctacacccagtactggtgagaggtcatctgaggtcaaccggcaggagtaagagtagcaatgtttatttgctccaaactggcttaaactggttcatgacacctgccaggtggaagtttttcttggcttttcttttctttttaatttttaattttttttgagatggaatcttgctctgtcacccaggctggagtgcagtggcacaatctcagctcactgcaacctccacctcccgggttcaaactattctcctgcctcagtctcccgagtagctgggactacaggcacccgccaccacgcccggctaatttttgtattttttgtaaagacagggtttcaccaggttggccaggctggtcttgaactcctgacctcaagtgatccacctgtaatcccaaagtgctgggattacgggcatgagccaccgtgtctggcctggaagtttttctcaaatcaagtttgggtgacatcatctcttcctccctagcattgaaacccattctgaggtgtggtgggatggggtggaaatgatgtgggcccagaacaccagggaatgactctgagatgctgagatgctcatggctccaggccctggtcttcagtgggtattgctcatctgggccagagtacacaggctccttcactgtggtccccaaggcacagttcttagggttcagttattttcctattccctatggccaagagtttccttcccaaaggtgcagccaacttgggaggctggggggcagtgctgtgggaaaccccagtggaagaaccccccctatcatggctgtcttccaaccccagtcttagggaatccaagcttctccctgcagcctcagtcttcaagcatttccctttgtgtggagtaaatgagtgagagaggagaaagaaggagagaaacaaggaagggaggaaggaagggagggagggaggaaggaaggaaggaatttattagaattgtgtcatatatcatccccatttcacagatgggaaaatacatccttaccccgtccagccagggagtcaaaagactagaaccagccccactgccttccagcccattgctctccctgctggcgataggtccagctggtcatgggaggctgcctaaaggaggtatggacgtggctgtcagaggtgagaatggcttccaaaacataatttgtcttccaccttgacaaagatccttcctccacagcctcttctctgtcttgggatgaatgacatcaaatgactcagggtcattcccatcttggctgctggttctgagacccaccggaggctctaggaggaggctgactctgggactgaactgtggcttttgtcctctctcccaaaccagtcacaggtcaaactggctgaaactcaattctctgaatgatcaattcactgaatgaccgattcatggaatttctgggtgtgttttttttttttttttttttttttgaaacagggtctcactctgtcgccctgagtgcagggtggagtgcagtggcatgatctcggctcactgcagccttgacctccggggctcaaacaatcctccagcctcagcctcccgagtagctggggctacaggtgtgtgccaccatgcccagctaatttttttattttttatttttagtagagacagggtttcaccatgttgcccaggctggtcttgaactcctgagctcaagtgatcctcccactttggcctcccaaagtgctgagattacaggcatgaaccactgcaccaagcccaattcatgaaatttctaaggattttttttttttcaaactgagatttgccaaggccgtgtccatgcagctgtttggccactcagctggatccacgatccctcaggccaggctttcggagcccaagcgtgctccacgggatagtgctctagatgtgggtgaggggcctttcccataaacacaagttgcctttgtctctgtgcttgtggacttgcgtcctggctcatccccgcctttgagacaatcagcgagatttccgctttaaggtacttcactgacagcttattggtcactctgcaaattgaccaacgggaacatttgctttgagtgaactgactttccatgcctgacctagaacctaccagttggcccaggctgcggggccagagtgcttggtcctgggcctacactcccgccctcctgtttccaggcaccatcggcttgtcctggaccttcctgctctacggactgaccgctgtcctcggcctgggcttcatctatttatttgttcctgaaacaaaaggccagtcgttggcagagatagaccagcagttccagaagagacggtaggaagctgacagggtgggtctgggggaagagctgtagcacaccccaagcacacagcttcaggattttagtctttgtgctttccttttgcaagcgggcattcctcctgtcttccttattgcctgggcactatgagttttttttttttttttttttttttttttttttttgagatggagtctcgctctgttgcccaggctggagtgcagtggcgccatctcggctcactgcaagctccgcctcccgggttcacgccattctcctgcctcagcctctccgagtagctgggactacaggcgcccgccaccacgcccggctaattttttgtatttttagtagagacggggtttcaccgtggtctcgatctcctgacctcgtgatccgcccgcctcggcctcccaaagtgctgagattacaagcgtgagccaccgcgcccggccggcactatgagttttgtccggtcacacacaaactgttttccttgagttgttttgtgtctccctacagtgccttttcatttgactttaagacccagctcatggggatttaaaaatcatttgattatggaatcacaggaggctagaagagtagaatcttaaaaccataaactatcttagagtcacaggaccttggagtagcaaaatatcataactatggcctttaaacattgcacgcaaaacgcttgtgggcttcatgcattcattccgtggctatttattaagtccttactctgtgccagacagtgttcagagccttaggaaacatgctgagattaaggaagacaaagtgcctgtcctcaagagcttccatttgatgggggagggaagccaacaaatgcataaacaagagcgttttagttggtgatgagtaattaggagaaaatgaagcagagcaaaatatgttgagagggccaggttgacacaggaggaacaaagaagaaaggggttgtggctgaagtagagtgggtggtgagggagggaagtcgtctcagaggaggtggaatttaagttagtgagaaggaggcacccacgtaatgatgaggggaggagcattctaagcagaaggaacagcaagtgcaaaggccctgaggtgggcatgtatctggcatgtgcaaggaacaacaaggaagccagtgtgcctggaacagagggaggaagggaagagcgtggagggtcagacaggccagatgggtaggatcacatcaggtcttcaggttattgaggggagttcagaatcttagcatcatgagaccttaggctgttcaaataaaagaagagtgaaatgggagcttcagaaggaacttcaaagtgctacagtcctaagcatccttggcaaatatccccagttacctcttaaaagcaggtgatagtcaccagctcctgactgcccattctgtttctgggaagtcataaaacgttttaaaaaatcattctattattgactagcatccctgcactggctgctaagccccaccccaatctggatcctaatgtaagaacctgtgacccagtcctccccaccccagaatgttctctcctactttgttgagtggaaccttctgcagtttcggcaggcgcctcagcaacccagctgtattagttaggaaatcgatttggctgcttgaagtcgtccaaatgtcggttgggggtccagggttgggtggatgcagcatgccatgagctcatgtagggtcccaggctccttctgtcttgttgctctgccacctcttccatatcacctttcctgcatggcctaaggaggtgcacccccacatacctgccagaggatgggggaggggaaggggtgggcacagtcctcaaggtcacttccacccacatgactttccatagaacttggctacacctatatgcaggggaggccaagaaatgtggtcttcaatctgggcagccatgtgcccagctaaaaatcgagggttctgttactagacagctgcctggcatctctgccacactggttttcttgggagaagattccaaatccatcctctgggataaaaagcaacggaggcagaaacgctggtgggagccagctttggggtaaggcaggatgtgactgcagctgcggggtgtcagcctggacctggggttacatggggggagccaaggccagcccttggggactggaggctgggtctgctatgactctggagaagacaggaagttaggggtttttgtggagtccagaggcaggtctgtgttttatcatctctgtccctagagttcagggggctcttgatatcagaggccacagagagagagagaaactcgactttaggaacacagggaccagggcatgtccagggattttgacagcaggaactaatgggatagtcttttcagcagcaactattttcactcctgtgtcctccatacaagagccatggtcccaggagaaagtctgattggccaaggctggtttatgtgcccacctcctaacccctaacttagccaggatagggcagagatccttgattgacagtccagtcaagccacatgccacgttccccaaaaatgggaggcagatgccggtagagccgtcacccactgctgtagggctgacttattctgcatccctgtgcctcagatgtgcttgttggaaatggggacctacatcttatggatccagctcctctacctgctttaaggacacattagtaatacaaggggctcaaatcgtcttacatcaatcaatggcaattggttgccgaaatgttgtttattttgccttcttatcaggttatttctgctcaaaagagacctttaccaatccctcaggggatataacaaaaaaaattcaaaaattcctgttttatcccagtttctcaggaatcgattcattcaactttcagcaaatattttcaagtgccgggcactgtagtaggctctggggacagacccatgaccgggagagaccctgtctctggacttagaaggaagttacattttaatgtataggagagagatagactacaaaactcaaaaatgcacaaataagataattcagagtttttatatcatgaagaaaataaggcaggttaacctaccagggggtgaacagcagatttgggaaatggatagtttctttagctagggtgcaaacagctatgggtgcatttgtgttacaagtgtatcaggaattttcaacaagcacggtgatatttttgtgtatcggtttcactcactgccctgtttccagggcctagaacagtgcctggcactgtcatctttaatcatatctctggctgaatgaatgatgctcaaggaaggctgctctgagctgagactggaattacaagaaaaagtcaatggtttctagagctggaagaaatgttcaagcagaagaaacagtttcaagagctggaagaaatgttctaggtggagggaacagcaagagcaaaggcccggaggtggaaacaagttaggagttttgaagggagagacaggaggcctatgtggccaaggcgtgatgagcaaatgggactggaggggttggtgtgggggagggcagccatggtgagaagatgggatgttaggctgagcatgatgatggtctccttctgagcagatgtattagtccattctcacattgctatgaagaaatactgggtaatttataaagaaaagaggtttaattggctcacagttctgcactctgtacaggaagaatgatgctgttgtctgcttagcttccagggaggcctcaggaaacttacgatcatggcggaaggcgaagggcagccagcacatcttccatggcgggagcagggggtggtgctgcacacttttaaatcaccagatttcatgagaacgaactcaccatctcaaggacactaccaaaagggatggtgttaaaccattcatgagaagctgcccccatgatccaatcacctcccatcaggccccacctccaacacggaattacaattgaacatgagattttggtggggacacagatccaaaccatatcagtggagagtgacagatttttgcgtttaggaaggtcattgtagatgcaatggtgacaaggggctataggaggccagggaagacccagggagaccagggaggagctgctagggggtccaggtgagagaaggtggacatttgtaataaggcaggaggcaggaagggtcatggtaggagtgaaggtgggattgggtggtgggaaccccagtggaaggtccactccccagggacggccccaggccctgccaccccctgatcccacgcattctttgtctgacaggttcaccctgagctttggccacaggcagaactccactggcatcccgtacagccgcatcgagatctctgcggcctcctgaggaatccgtctgcctggaaattctggaactgtggctttggcagaccatctccagcatcctgcttcctaggccccagagcacaagttccagctggtcttttgggagtggcccctgcccccaaaggtggtctgcttttgctggggtaaaaaggatgaaagtctgagaatgcccaactcttcattttgagtctcaggccctgaaggttcctgaggatctagcttcatgcctcagtttccccattgacttgcacatctctgcagtatttataagaagaatattctatgaagtctttgttgcaccatggacttttctcaaagaatctcaagggtaccaatcctggcaggaagtctctcccgatatcacccctaaatccaaatgaggatatcatcttttctaatctcttttttcaactggctgggacattttcggaagggggaagtctctttttttactcttatcattttttttttttgaggtggagtctcattctgttgcccaggctggcctgatcttggctcactgcaacctccacctcctgagttcaagcgattcttgtgcctcagcctcctaagcagctgggactacaggcgcatgcaaccatacccagctaatttatttttagcagagatggggtttcactgtgttggccaggctggtcgtgaactcctgagctcaagtgatccacccacctcagcctcccagagtgctaggattacaggccttttgactcttttatctgagttttattgacccctctaattctcttacccagaatatttatccttcaccagcaactctgactctttgacgggaggcctcagttctagtccttggtctgctggtgtcattgctgtaggaatgaccacgggcctcagtttccccatttgtataatgggaagcctgtaccaggtcattcttaagatttctcctgactccagtgagctggaattctaaatgctggtctaggagctgtctccaggatggtgcaggatggctttgcggaaaggagatgggtttggaggccaacaaacctgcttgtcaatattgcctttgcctcttggcagcccttgaacttgagtaaataacaactccctgaacctcagtttcctcatctgcagaatggggataattatgtcccaggggtatatttagaccctgtttcctttcaggagggtccccagctggtccagggcctgggaaatttctacttatcctcattacccaggtccctcctttggaccctgtaaagggtcagggtgaatcagatgggggactgagcaagtagctatgactgcagatcatgtaaggaagggactgacaagaagctcccagatgctggggagaatgaagagctaaaatagatcctaggtgctggatgctttgtcatccatgcgtgcacatatgggtgctggcagagcccccaaggactctggcctctcgagttctcctatcttctccattctagatgcttcccttgtatccagtgatgtgctggagctggctttgccaagcttgtgagagctggttgctacattttcaggatttttacaagttggtaaacacagccattataaaaaattaaatgatttaaatttataattaagtaaattacattaaaacaaaaaaattatactcaaaattcattacttaattttactacctgttactattatctgtgcttttgaggctatttctacatagtaactcttatggagacctaggggagacaccgcgcatctcttcctgattccccactcaatgacatcatgttagtctttggttgcttaactggctgtggggagtgtttttgtatcacaaagattagagaggactacacatcagggcttgatttattgtttgttgattttctagacttcagaacatgctggataaaatgtcagtaatgcaaattaaactttaaagtatgtcttgtttgtagccaatacatggtgtatagcaccaaaaaatggagggattattcttccagtagttgaacactgtcatccgtttcagctgacagctgctcaaatcatttaagaaggagttctgacattcattttcattgttttacttttgtcttcctcactagtgtaaacaaaaatttcaaccagcattcatgccgaacctatacccattcttcagtgcctagctgtacagttatcagggatttttatttgtagtctaattttgtcaaatcatggccaaatcgcagtgatagttgactttggatacaaggtttggcaaaaaaaaaaatattaacaaaatattctgtaagaatcaattgtctatatggaatttaggataaagaatatttacaataaagaatatttacaataaagagtttattattatttgtaagttgtgtgcaacaaacataccctttatctctgtaaaatttatacacacaaaaattaacaaaagattctgtaagaattaattggctatatggaatttaggatagaatatttacaataaagagtatttacaataaagagtttgttattatttgtaaattgtgtgcaacaaacatatcttttatcatagtaaaatttacacacacacacacttttcttccctggagagctgttgttaaacatttaccagcacactactgcttagagctgtgcttgtggccccttcagatctcttctctctccagggacccataaacctcactcaattctcctttcctctcctatcagcctggaagaatgctctcctagtcctagggtgaattctccactttcttgctccaggttataaacttggggttcaggtagggaatataaatgagtgaagccatttaagacattagggagtagtggggtctgtggaaatggggaaacacagggtctgtctataagggtgactgaccctcaattccaactggtggctgccatgtgaccctcaattccaactggtggctgccatgtaggaatgtgggcccaatgtggcatggccgtctgtgttttcaacaaattccagaaattcacactttggtgcaaattttattgatttttaagttttggcagttgattccaaacttaaaaatagcttggaagttaaacaaaatactccgtggctagatcacagacctcagtctgtgcctctaatctctatgtttttccctctgagacattcctttcttctgcatatttgaggcacttggcttaatctccttaaagaatcatggcttttgggccgggcttggtagactacacctataatcccagtgctttgggaggccgaggcaggtggatcactttaggccaggagttcgaaacaagcctggtcaacatggtgaagtcctgtctctactaaaaataaaaagattagctgggtatgatgacactcacctgtagtcctggctacttgggaggctgaggcagagaattgcttgaacccaggaggcagaggtcacagtgacccgagattgtgccaccgcactccagccagagtgacagagcgagactctgtctcaaaaaaaaaaagaatcacagtttttgaaaaataaaatgccaagcaaactgaatacccaagcacttgaattgggtgagtgaaggggctattactgaacctgaagtataagacacctggagggaatgaaaatagtccacacctcaagcatcttatactggcacaattaggtgcgtgacttggggagttgttcatctctattatggggatgacactacttaactcttcagaaatgacacatgtcagtcacttagtgcagggttcatagtgggtgctcctaaatggctaactgtcccaacagcctccagggccatctggctttaggtaaggataatgaggccaaagaccaggtggtagtctggaaggggagaagggggcattaaagaaagctaaaaatttgggggacaccaactaggtgctcagttaggagggttttttgtttgtttgtttgtttttgacagggcttgctctgttgcccaggttggagtacagtggtgtgatcttggctcacagcaacctgaaactctggagctcaagcgaacctctcacctcatcctcccaagtagctgggactacaggcatgcaccacaaagcctggctaatttttaaattttttgtagaaatggagtctccccatgtttcccaggctggtctcgaattcctgggctcaagcagttctcccacttcggcctccgaaagtgctgggattactggcatgagccaccacacctggccaatgctcaaagatctttagcaccaaccagaggagagagacagtctgttcattggtctgcagggagagcactgggaaattcttctccttcccgcaagtaactccagaatcgcttcagggaagcagttcccaaacctcagtcttgtgcacagtcctttaataaaatatgcccatcacttagcacctttggttatttgccagattgtactacacagacttcttgctgaatgcttttcttcacatttatttgctattccacttaaataaatgtattttaaa

SEQ ID NO: 16502 - DNA, 157032 bp, Human
  misc_feature (1)...(157032): n = A,T,C or G
tttttagcagagacggagtttcaccatgtcggccaggctggtctcaaactcctgacctcaagtgatctgcggaccttggcctcccaaagtgctgggattacagctgtgagccccgtggctggccaaaataaatacattttaaaaattaaaaaaaaaaaaatacagtctttataaatgtaattttcagtaatcatcttagtaatgcaaaatatggctttggagttttttccagttgaattttaagggaaagtgccatttgcctctaatcactggaattcattataaaaatactgtgcaacagaaaacatgctataaggtggtttaagagctggaaaataaaaatatcatttgttgacagcactaccacaagagattagtaaaaagcacaggtgatatgagatgtaatgtctgcaggtaactatttcctaagactgaatattttaatgaaggaaaaaaaaaccattcgtgagattctgccatcctttgatgattccatgtatctcattataaatggatacaattatgatggttttgaaacgtccgtttttgagcctattaatgttgcagcaaaactagaatcattcatttctcaaactgagaattaaagaagactcttatggccaggctcggtggctcccacctgtaatcccagcactttgggaggctggcgggcggatcacctgaggttgggagttcgagaccagcctaaccaacatggtgagaccccgtctctattaaaaatacaaaaaatttgctgggcgtggtggtgcatgcctgtaatctcagcaacttgggaggctgaggcaggagaatcgcttgaacctgggaggcagaggttgcggtgagtcgagatcacaccattgcaccccagcctgggcaacgagagcgaaactccgtctcaaaaaaaaaaaaattctcttcacttatgttaatggtaataaatggtataaaatatacaggtaacagtataggaattccagtttattacagtatcaataacattaaggccgagcgcagtggctcacgcctgtaatcccagcacttgtgggaggccgaggcgggaggatcgcttgagttggaggttacagtgagctatgatcacaccactgcacttcagcctggcgagacagcggataccttgtctttagaaagcaaaacaaaacaatttacacacacacacacacacacacactctccctaattcggcttgagttggaggttacagtgagctatgatcacaccactgcacttcagcctggcgagacagcggagaccttgtctttagaaagcaaaacaaaacaatttacacatacacacacacacacacgcacacacacactctccctaattcggcctactcaagcacgataccaaatagatgaagaatatctaattaaatggccataaaaagttctagttcatgacatccaagtttaaagaatcaaaatgagttacgagaaaacaaacacaagctttaagaagttggggagaagatgtgcgtggattcgcttcaaagatgtgacagagagaaaagaggacattttctggactggagattcaagacagtctggttcaggttgcatgcttttgcaaaggctaaagccttagtctgtgacataaatttgtaaagagctcggaaaattacatctcggacatggtgtctttttttcctgctgcttgaaggtctttgcatttatgttcgcatcactggggcagctgccgctataattactgcttgttgggactttttgtttacttggtagctgtggtgcaccaagagaggcagaaaaagaagaaaaaaaacctctgttacttgtgactttaagaagtcgaaagcagccctgcttacatcttccacggaccattttagcccaagggaaggtcctcagcagctctaacacgtagcggagcactatctccgcgtaggagcgctcccgccccggggcgggaccaggacaaaccccgcctcccaagcccaatcccagctctccgccggcggacaggaagcggcggcaggcctagcagcacgggaaccgtcccccgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtgaggcacgactgcgagcgccgggggcgccgcgaccacggcggagcggcggccgggccgagcggagcccagtcgcgcctcgcggcgtgcgcgtcagtcagcccagccggccagcggcgccactctggcgggccgcgctccccgctccctattgtcccccgcgccccgaccgctttcccttcggtggcgggccgaggaggctcccaagcctccggcgaggccttccccgccccccaccgccctggcggccccgggaggcgggggtcgcctcccagagaagcgaagtcggggcatccgcgtcgcctggtgagagcggtggaacccaggctggtggctgcatccctccagtctgctcggcgggcgccggtgcaggcagccgcagcgaggctggcggtctcgccgtcctcgttcagcgctcatcctgctcaccattcctcccccagcccctgcccggtggcggattccgaagtcctctccgccgccgagacccgccgcgcagactcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttcttcctgtgtcctgtgtttggagagagatcacaggagggtgtgttggtgttcttgaaaacattctgtcgcccaggggaaagggtttggtcgggagaagggtaaaccatttggggatgttctttgatttgtaggctggattgggtctcttagagtagaagttcggtccctgggtgacccaacttgaagagtttcgttaaactttcaggtggagtagatgtacagtgtagttagtggattgtcaaaacagtgccccctcccccctgcacatgaaagtcaaatttgctaaaagcatgtcatttcttgtttcgggttttgaagacaacgatttttatttccggtgtgttctaggaccagctgcatcattttattcttgcttaaagtgctttattttaggtaagctttttgacttgccccagagtaaacttaaaaacctcaaggtgtgcctaaaagcaacgattgaaaaaatttgaggaatgctttggatgagtgtctgtagcctttgataatttagaaaatatctatttcatgtaatgtattgtttctgtttttttctttgccactttgacttatgactgcaggaccaagtgtatttctgtcctgtattctaccgagtccgagggtggtactgcgtaggcagacttctgttatagtttgtagtgttcatttttttgttacacgttttatttaatttttttcaatccaattcatcaagcaagacacacattatagattaagagctgataatagatgtttagttttaaaaaggattatgtgcgggagactctctgttagaggagcctttttcatctgacatttgttatttctgttctaaacgtggctttcaacaaatcgttttcctatcttttttcactttttgtgattaaattcaggagttaagacactgttctctataaggtaataaaaagtaagacaaacacatgaggcactttactgagtagtagtatactaaatgttcttttaaaaataatgaaaacagtaagaaactgatgtagtcttatatttgaagaaaaaacaattgaataacatgtttgtgggttaaaactcttatacaaaaattttctaaattcatatttccagagtcctttattgcattaagcattggttaaaaggctaatttttggtgtttttgttaagcagaactttttcaaaaaacataagacaagttttattagttttattttaaaattagtatcaagattctagcttttgggtacttggagatacttgtaattttattgtaactatggggtatttttatctactaatctgagctatttttggtcacttgtaagatctttgtatgatgatttgtagacttcagcacattgagattgaatgtatttgttttagcatatgagagaaaggagaaatttgtgtagattagaagttgtggtggaaatttaacttaaaatgtaaatcattttcaggtagttaataaatcctttttgttgcttccacctccccaatttgtcagtcactgttgtgtgtgaaatttttcttgctctgtatattactaggatgggaagctggaaggaataattaaagtgtttagaatcataaaacaaactttcctaatggtgtccatttccagcacagccccatcctatgttgtagttgtaggagcaaaccatgtttttttattttatttttaaaatttaactggtgtgtttgagagcacaaaaggcatttcagctgtagcagtaaattccataatgttttggtttgatgaaatcatgcccgaaatgaacttcagagtatgatatgtctcttacatttaaaaatctgatgtaagtgcttagctttgtacattactgctcaatagaaataagttttctggaaacttgaccagagctttaaaggtagtagagcttaagcagttaaactttctctgactctgagtcggaatctaccagcaaataagaatttaatgaaagagacagactaattttgtctttatccttaaggatctctgactcttcatctttttaaaacttcagtttgagtccagttaactccatcatcttttttaaaaaatgttttattttgtttatttattttaaaaagtagtgatggggtcttaatacgttgcccaggctggtctcaaactcctcgtccctagcgacccacctaccttggcttcccaaagtgctgggattgcaggcatgagccaccctgactggccaattccttgtcttaagacatttttcttaacaagaaaaatttacatattacatattactaggatgggaagccagaaggaagaattaaagtgtttagaatcataaaatgtaaactttcctgatggtgcccatttccggcacagtcccatcctatgttgtagttgtaggaaggtaccattgcctacattaatggtattttctgtgtgtatgtgtacagcctctcccagcaggcatggcaggcacttctctgatgtgcttttagtaacttgtttaagatcttcaaggatgtgtattatctgatctctttaaaatttttctaaggaccttaagggttgtagggcttggggcaaatggaacatttccatgatgccttttgtgtgtctaatactgtgttaggagtttcacttttcaacagttatgagagaggggtgataggcagttgaagaaacagacttggaaatataatttttctagcatcatccaccacttagtggtgaattggacattcgaactcaagctggtttgaccttaaaccctaataagctttttatccattgccccttcatgccttttttgaaagcggctttcatacattagctcaaaggtggcctctggactaaactaccttagagatatgttttattcacagtgtctttaagtttgagctaatgattaacattgaaaaattgggatatttctcagtgaaattcatggatttctggattttcggggaagacttggaaatccagatactagtgggctgtattcctattgtgcagagctgagcagtagggcagtagccaccctctttaaactgggtatgtgcttaccggttactgcagtccccatcattcctaatgatacacctggcctttttcactcatttttgttacctgcttgggtactgtgggtatgttgttcccatctctgccttagctttatcttgtatagatggctccaacttttaaaaaatgtttgactgtgaccccttatccaacttttaatatttttttgcaatgttttctctgtagtcttaaagatttgtttaaaaagaacatggtatacacaatactttttattcagcattaggttattagatgttttttaaaaaaacccgttttcataatagtagcagcttgaaggtctttaatatagaatgatcgttacagtctctccacatttctttatctaaatgggtaagtaagaaaccatttctttttctactgggatgagaaccacagaaaaaattagttgagggtcatattaataaaaaccaatttaagaataggatacaaacataaactctgcttttgaaattaaggtgatgaaatggaggaacaataacttcagcaattagctacattttcctaacattgttggcagatcagtggttcagatatgagatgatgtccatataacaaactctgggaatacacttttatttttttgagatggaatctcgctctgtcacccaggctggagtgcagtggcacgatcttggctcactgcaacctccgtctgccaggttcaagcgattcttctgcctcagcctccagagtagctaggactacaggtgcgcaccaccacgcctggctaatttttgtatttttactagagacggggtttcaccatattggccagactggtctcgaactcctgacttcaggtgatctgcccgccttggcctcccaaagtgctgggattacatgcatgagccactgcgccccgctgggaatacaattgtaaattttttgtgtttttgttgttgttgttgttggtcttggttagagatgaggtctcactaggttgcccaagctggtcttgaactcttggctttaagcaattctccaaccctggcctcccaaagtgctgggattacaggtgtaagccactgtgcctggccagttttgggtgtttttgatggaagtttttctaaaatgtggaaaatttactgtagacacatttactatctccttaaaatggactgaatttaaccttacatgattgaagtttaatatggagaacagttgttattctgggttctattgtagtttctgtttttaatttttccagaaatgactgaaatggcctggtagtttattatttttctaaatttattctagatgattgtggattttattcttggatctagttgtagcaatatttccaactttttggttaggtttctttgctttcttgtaaactttgaagatgttaccttctaattggttgtttctagtatgttttatgtaggaaaactaaataattatatttgagaaacatgcttgcatgtgaaatgaaataaataaattctaaatcttctgtggaatgaagtacatgggctttaggtagttttttctttctccctgccccccacccctacccctcacctttcaatatgtatagcttggctttgtagagtttagcattgaggttgcctggatcgtaactttctaaacagttggaatgatgtggtactaatgtgttttgctagttacagttagacagggaagaatggagagaaaaaactgatgaataaccaggcaggtacagcaaataaaatgtattctcattaggttgcagatagatcgtgtcctagagctaaatcatgagtactctggttttatactaatatactagattattggtattaaacatactctaaaatgtccaactgtaatattttctacaggaatagaaattgtgaattaagaaaaagtgttggccagacacagtggcttacgcctgtaatcccggcactttgggaggctgaggcaggcggatcacctgaaaggtcaggagttcgagacaagcctgcccaacatggcgaaaccccctctctactaaaaatacaaaaaattagcttggtgtggtggcaggcgcctgtaatcccagctactcaggaagctgaggcaggagaatcgcttgaacccgggaggtggaggttgcagtgagctgagatcgcaccactgcactctagcctgggcgacaagagtgaaactccgtctcaaaaaaaaaaaaaagtattttgtttaaaggaaagtcagtgaaaggtagatgacaggggcttatggtactgtgctggtttctagtaagtagctgtgttacagcaactgtgttaccattttggtgatttttacatttgtataaagttaaatttcttgtctgtctttaattgtattacattataatggttagaaaaaaatttgctaaagttggggcattgttttggaagggtctagcttaaaatatggtctatgtggagtaccagaaatgtagtttgtgtggagaaggttgtgggcaagggcagtcattggccactgctgccaacacaaagtttcagtgagaggcctatgtgagataaattgtggataggaaaggctgcagacagaaaaacacatagtgatttcaaatctgaacccccgccccccgccaccgaagcccaaaatcacaggggcaggccttccaaattgtaggaatgatttgcatttcatttggtttttacacgggcagctctatgtgacatgctggggtaaagaggcccaggtttttgttgttgttttgtttgtttttgagacaaggtctctttctgttgcccaggttgaagtacagtggtgtgatgtcagctcactgcagccttgacctctgcagctcaagcaattctccaacctcagcctctccatagctgggaccacaggcacacgccaccatgcctggttaattttttgatttttttgtagagatgaggtctcactatgttgcccaggctgtgttgttgttttctaaaggagtaattgatttaattaatgatcgttaatgctcttccaagcaaccctaaaaactctgcttgttctgaacaaaaatctagcagtggtaattctaagtagtctagctgttgatttttatattaggaaaaaggaagcaatgttaaggacaagtggaaaaactataataaccctaccacttggattcctgtaagggcagtgacgttgctgtccagcaatgtgaagattttgcgttagtattaggatagcctgacccagctagtttgcaggaaatagcggtgctgagaatatttctcagggaatgtagtctccctttgatgctgagtgaattcattttgaagctactacagatgctccttgactcatcataagttgaaaatatcgtaagtcgaaaatgtatgtaatgttggcaacagagatgatggttcagtgtatgatttttcaactttgtgatggtgagaaagtgatacacgtgcagtagaaactgtaaccccatttaagttttaaggagctctcctccacttaatgtggggttatgtcacaacccatcataagattgaaaaatacgaatcatagtaagttggttaacatacatacagtccacttgtactactgcaagtaaacaatgtgagatgtatacagtgagaacattgctgtttagtcaccaggatttattatgtgtctatgactgttaggagtcgtgaagccacagtattaagtgagaagaaaagtaaaaaatactgagtttgttggagtaaatgaaatgccaaaatataaaaatatacttccaattatatattgtagttgcacctgaaatgaggatttgttaagcttgagggacatcagcaagcggggaaggctttctgaggtagaagagaatgacacataagatgcttgtaggtttacttgcctggaatcgatagtctgtgtcaggaaataaggagaattgctaactgggccatgataatcaggactgattattctaggccatgataactatgagatagaatattatggactgttgggtggagtccctgttgaggagttaggttatgattgacaaattgggtgattgagtcttggattagaatgatcgtagaaataagtaaggatagaacaagaaatgacatggaagaaaaactgataaaactgggcaaatgtttaacgtgaaagtaacaaaacttatagagggctcactctgttgaatttaaatattaggctgtttcattggagtgagtgtggttttataaaactttgaagacctcagtcgttgaagttgaaaatgtcttaagattttgagtctggatagaagcttataggttgggatgggtgtcagcgtctgggattttattttatttgcatgctaatacttgggaactggataaaactttgcatagatctttaatctctggctagttatttgggaagcagtgctttaggtagctggattatagaagtttagtgaatttggagtggagatagagattagtttaaagatatactaacacttttttttcttacttaagttggaattaggctattcagttcaaaaatatgattgacactcttgatttcatgtgaactatgaacttctgtttccaagacaaataggggaaaataatgcgatctttgcattttaggcaaatttgcatatgtgatttgtggagcagaatttgcttaccatctgtttttgcttgtattgatgatggcaggacacacgtgtgcatacatttgaactttgaatttagctttcaaaagaacacatagaattctctatgatttgatggggtattaatttactaccccttttcctaggaattaagtgggataatttgtaaaagtgctaaagactttaaagtactatataaatattattaaaattatgtcgtttccagacctgctttcatttggaatctattagttacaaaatacagatggataaaatctatttttagtagttggaatattagaacatcattaccaaacattagaaaatagaattaaagaaaatccgtaattcctccttcaacacaattttatcactttttaatattaatcatgtagtcttttaaaatgcctattacgaatttatagtatttgtgtagttctgtatacctttaaaaaactaatgtatagttaatggctgggtgtggtggctcatgtctgtgatcccagcactttgggaagctaagctcggaggattagtttaggccaggagtctgagaccagcctggttaacatagcaagaccctgtttctatgccaaaaataaataaataaatacaagaaaaatgtaaagtgtagttaaaacgcataagtatgcaaagcagacactgagatatgtataagtagtaaaaaatgaaatcatgtcattcctgtttataccatattttttctattttatagatattgctgttcttttttttttttcttccctagagacagagtctcgcgctgatgcccaggctggaatgcagtggtgcgatcttggctcactgcagcccctgccttctgggtttaagcgatttttgtgcctcagcctccgagtagctgggactacaggcacttgccaccaggcccttctcatttttgtatttttagtagagacggggtttcaccatgttggccaggctggcctcgaactctagacctcaagtgatcctccttcagcctcccaaagttttgggattacaggcatgagccaccatgccgagctttgatattgctgttctttatttcaagctttatagttaagttactgatctgtgtcttcactagaaagacaatgttaagagggaagtaactttattcttagtcttcatgttttaggacctagcacagtgtctcactcacattaggattttataatatgtgttattaagactacagaattgttaaatacattgcttaggaagtggactggacttctggatacatgttatgcacccgttttcattcagcagatattggcattagtgaagcagccttcatggtactggctgtcagctatattatggaaatagtctcattacatgaaactgaatgtcataatgatttttgttaaaattggaatattgctgtagtaaaattagaaagtgacctcctccaattagtacagcatattatcagaaccctcaaatgtgtattataaaggttaggtattctaatctagcataacggagaggacagttttgttgacagctttggagatggattggcactgatgcttataaattggttcggaaatcagaatttaattttggcaagaatttataaaatttaagaatttatttttttaaaatatttatttatttatttatttatttttttgagacggagtctcgctctgtcaccccggctggagtgcagtggtgctatctcggctcactgccagctccgcctcccaggttcatgccgttcttctgcctcagcctcccgagtagctgggactacaagcacctgccaccatgcctggctaatttttttttttttttttgtatttttggtagagacggggtttcaccatgttagccaggatggtctcaatctcctgacctcgtgattcacctgccttggcctcccaaagtgctgggattacaggcgtgagccaccgcgcccggcccaaaatttaagaatttataaattttcttggtagcccataaaattcacttgtatccatccagtagcagaaatctcttagtaactccatgatctctaggagcagtaggccatttagtagggaggagccctttttctttaatgtagagcaagctttggcatagtggttctcagctaggggcagtggcggatgttttgggatatcttatgggaaaagggtgagttaatgacaatgggtttaagatgaaatgcagggagtgggacagatgtatatcaaaagtgaggtggtggctgtgtgagtgtgaaagtgatgtaggcaggttgaaagtcatactctattactgtctgtacttgtgtcttattagaaattgtataaaagattcaatataacccacaggttcagaaaaaaagaataaaaaaagattgtataaaagaatttcaaatcagcatagaaatcttacgtacacatttcaattttttgatttttaaattgtatttcataagttagtggtataaatttaatacattcaatagattttaatcattcgtgttttcagccctttgtatataatttataaaagagctacttagacttctgagccagcttgtgttatttttacttcttagagactagctgatttcaaaaagtgggtatgttgaaatacgcttttaattgtagacactccctcctatcttgaactttaacttgtaactgttaggtgtagctgtttgcttctagaagatgatttgactgatttctagtgaaaaaataggtactggcttaagtttgaattcacattgtagaagtagcttttcaaagagtgcattaaaggcacttaaatatattgctggaatatagggcatgatagttcctggaagcctacctttgtcatacaggagaacagttttgttagtggtatttagtgcctgaagatctgagtgaatatgtattatcaaataaaggaagcattggtcaacacagtatgatgcctatgacatgtagttgatgactcagtaggaaggaaatatatttttatgttggggaaaaatgctgttggtacctcattttgaaattatgcaagtgaaaagtctgttgaaaacaagttgattacaagtaattttttttgaggaatgcaaatatgccatgcttagcttactcttatatcctctcatttattgtaattgagtttttctgtaaataggaagatctgtaatatcaaaacattattgcagattttcctctcccattcttaagattgtatagccaactttttgggtatagataggaaaaaacttgcttgttatatgatatttctgtctcacaccaaggtgatgatggtgacccactatcagagagttattctttgttttttctcctgatgttaatgaaattttcattccgtatttttttgcacaattctttaatttagtagattggaacagaagattgtaagttttgggttcaaggattgggaaggaagcttttgcttagaagggtacttgggaagtaagatgctacctacccatggaatatggaaaaaaatcacaatggctggcatttgttggggtacttaatgccaggcactgttgttagatcattttgtgtatcatatattaacttggtcttcacagcatctctatgagatacgtgttgttattttcattttataaatgagagaggaggatcagggagggttacttatccagagtcaggaaagtcaaatagtagttatcagttgagggaagccagatcttgcctttacatgtaggctaattttacccttaaagcgtaatttaggttctttgtacttacagtatttgaagaatttgccttttagtcagtcaggttctttatagaaggtattttattttttggatgtgaaaaaatgtttacatttgaggggagaaaagcagcttacagaaagaacacgcataaaaccatttcagttttgtcatagataaatatatatgtaatcatttttagagaacagataccaattttctgggtagtaagattcataatgcacttctgtgattaggaaaaataattttttaaaaggcggattggtaaataccagtatcctggcgactttgagaaaaattaagggaaataaaaatactgttctcaaattgtaaaaagggagagctctcctaagctctcctgtgacaaggaggccaagttatgttttttctatttcttagaacctgctggtcatttttctgccactcttgcatgtgattttttggtattacttagtcttcccccttaaaaaaaaactagagatggggtgttactgtgttgcccaggctggtcttgaactcccgagctaaagtgatcctcctaaacaatcactttcgacttcccaaagtgctaggattacataaaatttgataaaggatctgttttctctatctcgtagatccaatctagttattcttctggcagttttacatagaggcttttttcgatatactgtgtttctttttttaattcttgaaaatttttatactttctaaaagattgcaggtatgctagtagttaatatttgtatgcctttcacctgaatttatgaatggttacctttaccacatttactctctttttaataatatattatttttttccctctgtttcatttgaaaataagttgtactctaaatacttcagtatgcttgcatttcataaaagtaaggacattctgctacataactaaggagatttttttcttaagtgtggagatgttcaaatttcccatggggcttataagtattaggtgccatgtgactgtagtatatgctttgtagtatatgcttttcagatttcccatggggcttataagtattaagtaccatgtgactgtaatatatgctagctttttggcaactaaaactgagaacaagaaagttaaatgctgttggtgcgcttttctgtgtaggtgaaataaagtaacagaagagaaaggagaagacgttgactttgcagagtaactatcttgtagggtggagctgtttttatgtaggaataatagcacaataacatagccttgaggttactgcatcattatggcctcttctggtgaagatgttaataaggataagcctggcttaacaagaacatgttagagtaggaggaaaattaatcatccatcaaatagaaagatatttagcaagatataattacctagaaactgtccttagtggaagctgtcattttccattgatgtcagattagtaacattttattgtcctctaggttaaatgtattttattttcatcattgtcaggtagcatgtatttctccactgttaaagtctttatgtgaaaatgccttttgtaagtatgtataaaaccatttcagttttttcatagataaatatatatgtaatcattttagagaacagataccaacttgctgggtagtaagattcataacgcacttctgtgattaggaaaaataaatttttaaaaggcagattagtaaataccagttgaccctctgtgtctgtgaattttgtattcatggattaaaccaaccacgaatgaaaaaattcaaaaaatgaaattgagtctgtacttaacatgtacagacttttttcttgttattattccctacacaacacagtacaacaactatttatataggatttacattgtattgtgtattataagtagtctagagattatttaaaatatacatgggtatgtgcataggttgtatgcaaataccgcgtcattttgtcagggatttgagcatcaatggatttggatatctgtgggaagtccttgaaccaaccccccagggataccaagggacaattttattttattctttatcaggagggataaaattaggaattaagattggcattctttgagtccttacttgttgttcgttttgtcctgcgtaggtaatatatctaatagtgatgaaagaacctggactgggagagtctagcaagtagtaaggatcaggatagagtaggtgataaggaatcggagtaaacgattaggcagcttggaactagggaatcaggaagatctataacaaggagagattcccagatacaaaggtgagtgggtcagaggccaagctgtgttcagatagagatgggtgaatagttaacatgtttcagtgagatttgatgataccacatgctctatctatactttctgagctcttgactgattgctaaagtttagaaataaatctcagttgataggtccagtctctgcatgtgggaacaggcaattttgtgatgtctgactgaggtagtaagcagtacaagggttgaagattagtcagggctcctgtggagtaaaccatgcccatttcaatcactagctgtggaaatcaagggtatatgtatatgtatatttttctgtctataagaagtatattcttctttagtattgcattgcttgttttccccatcttagaggtagacgtcagtttagtttttgaaaggtttttgccatgtgctgtattttgataattttttttcttttcagttttttttttttttaattttgagacagggtctcactttgtcacccaggctgcattgcagtggcacgatcttggctcactgcggcctctacttcccaggttcaagcgatcctcccacctcaaccccccaagtagctgggatgacaggtgcatgccaccgtgcccggctgatttttgtatttgttgtagagatggcgttttgccatcttgcccaggctgtcttttcagttttttgtcatatcagaaatatggtgacttaccttgtttatgatgaaggtaattcgactcatcgtagattaacatgaaatcattgaaatcaaagttgagttcttggcactgcctcctgtttgctatgtgacactgggtttgttacatatcactcaaacctcagttttctttaaaatgggctaatagttctcacttgattgggtggtttaaatgaaaaaaatgtagagcagtacagagcctggcagatagcaagtgcttgatacattttaattatcatgacatccaatttataagcattattgtttaatttagttaaacaagaaattgatgtaatcaggatattgttctgtacatggtaagatttcagggtacatttaagaaattaggatacttttaaaaataaaataggatatatagtttgggatttttaatttttcccctttaaatatgtgaaatgtgaaacttaaaaaatcatttaaaaatgtttgttagccagattttaatgtgaatttgaatatattggatttctaaaacaagaatgagaagcaacagccttagtgtaatattatttttatatatatatatataatgtaatgaaaaactaaagatattctattaaagtcagggacaaagtgaacatgcctacacttgttattcagcatggtttggtactcctagttagtgtagtaagttaaaaaacagataaaattataaatagatgaataaaagatttaaatatgcaaagcagaaccaataaaaggccaagaaagaaaataaagaatatttttggaattttgcctgcaaaatttaggggctcatgaatcccctatagaggttatgcagtttctccctcagtatctatggggattggttccatgaatgctcaagtcccttatataaaaaggtatactatttgcatataacctgtgcacatccttccctgtactttatttttgttttaaagggttaaacaataaggcctttatctgcacaaatcagggtagaatgaggcaggcagttccaggattggctgattcggaaactggctagacaaatccatctcagctaccattgtccacaaaaaagggggacctctggaaatccacagcagaccccaacccaggtcttttgggcaggagctgggtcatttccacactgaaaccactctgagggaggggatgaagaaccaccaggttttgttcactcacctagttgtaggtaatctctacattgtggatagatggagcagttcaacttctggctgacagctcacattcagaggtcactgtcagctcttctcttttatgatcatgctattttgaacaatgagacaacatctgccatgcactcttaaggcctctgtccagtgtgaactctaatgcctaatgaggttaggccttgactgtatgcttttttacatccgctacacttctacatttataaggcctttctctgtgtgaactttcatgtgccaagcaaggtggaagtttctgcattcccatatttcctgcatacataaggccttgttccatcacgaattctcttatatgctgtaagataggaattgtggctgaagaattttccacatttacaacacttagaagtctcttttccagtgtgaactttctggtgctcaacaaatgtgtctttatagataaaaagacttgtcacatgatctgcactcataaggcctttctccactatgaattctctgctgctgaacaagataggatcttctaataaaggatttatcacattaagctcactctttttttttttttttttgagatggagtcttgctctgttgcccatgctggagtgcaacagcaagatctcggctcactgcaacctccgccttcctgggttcaagtgattttcctgcctcagccacccaagtagctgggactacaggtgtgtaccaccatgcctggctaatttttgtatttttagtagagacggggtttcaccatgttggtcaggctggtctcgaacccctgacctcaggtgatctgccctcctcaacctcccaaagtgctggaattacaggcatgagccaccatgcctggctttaagctcattctttgtatgacctctttaaagtatgagggttggaggtggagccaaataatttcccgcaatcactgcatttataaggtatttctttgctgtgaattcttctttgtactgtaaagtaggagttgtgactaaaggttttctccacattcaccacactcctaaggctttactccgtcatggattttctgttgctgaacaagtttatctttgcagttgaaggctttcccacatcactgcacttgcagcccctttgtccagtgtgaaaggcctccctactctcagtactttggtgtggcttcttccccattgggaggggcctggtgcttgaaaacttcaaagctattcaagaagtattttccacccttcctgctagtgaaaaccttctttgacatgtaggatctgcagatcttcacaaacaccaggctcttttccttctagaagatttctgtctgctgcctctgaatctggtctaggttacagtgaaccagaagtctccaccccatgactcacatgtgtgtggttgctattcagagaatgttccccttgtccagctagatggaaaaacgtctttcaagaccaggccgcacatgtcatggggtgggctttctgacctgccttaggaattctcacctgtgacactcttaaagaaacaccctgcttggaaggtgcatgttcatcctccactccataccagttaccttgggtggggtcacctcagggtgcttgttgccttctgagcctcactgcaaaatgccctctcatacttgaattttaatttttttatttttttgagacagggtctcactctctcactcaggctggagtgcagtggtgtgaatacggctaaccccagcctcgacttcgtgggctcaggtgattctcccacctcagcctcttgagcagctgggacaacaagtgtgtgccaccacacctggctagttttttgtattttttttgttgttgttgagacggggctttgctatgttgcccaggctggtctctaattcctgggtttaagcgatctgcccgcctcggccccccaaagtgttaggattacaggtgtgagccactgcacctggcccctcccatatactttaaaccatctccagatttcttataatacttaatataatgccagcacttcatttgtgtggattcagcatagtactcagtgtacagcaaattcaggttttgtcttttggaactttgtggattttttttccccttcagtattttgaatccacagttggttgaattccactaatgcagaacccatgaatacagaggactgactctatcagtgagggttttccagagagacagaaccaataggatatacatatgtacagatagatacatgagagaggatttattaggggaattggcttacacgattatacagactgaaaagtcccatgataggcagtctgcaagctggagaccctaggatgctggtagtatggctcattttagtcttaatgtctgggaaccagggaagctgatattttaactctgtctgaggctgaaggccgcagaggctggagtcctgatgtcccgaggggaaagagagggagaattttcttttcctccacctttttgtttttttcctggcctttagccaattggatggtgcctgcccacagtgcaggtggatcttccccagtcagcccaccactccacccgccagtcttcactggaagcaccctcagagacacatccagaaataatgctttaccagctctctaggtcttccttaatctagtcaagttgacacctaaaattaactaacacagaggtttgtggatttcaggttagtattcctcttgtagaggaaaaaaaggtgaattataaccaaaggcagatgaaactaagtgtttaagtgacttaccaaagatttgatacctgttctgtaacattttgtaggatgaaactaagtgtttaagtgacttaccaaagatttaatacctgttctgtaacattttgtaatacttcgcttattcaactctgctgttgtgtgaaagcagagatagaaaatatgtaaatgaatgagcatagcagtgttgtaaaaacaggtggccagctggaactggcctttgggtaacagtttgccaacccttcttctacgttatttggaaactttttctactcagtatattgcctgagacatcagttgaggtattttttgcttaaatggtagcacccatggtgtacctatccctattaatgtattgttaaatgcttacattaaagcaagtgtgtagaaataaggatatacaggttgagtatccttatttgaaatacttggaaccaaaagtgttttggatctttaaattttccgattttgggaatatttgcattatgcttacgatttcctaatgtgaaaatctaaagtgcttcaatgagtttttttttttgtttgtttgtttgttttgtttttgtttttgtttttgtttttttttacagagcctcgttctgttgcttacgctggagtacagtggcacggtcttggctcgccgcagcctccgcctcctgggttcaagcggttcttctgcctcagccttccaagtagctgggattacaggggtgtgccaccactcctggctaattttgtatttttactagagacggtgtttcgccatgttggccaggctgtctcaaactcctgacctcaagtgatccgcctgccttggcctcccaaagtgctgggattacaagcgtgagcccctgcgcctggctgagcttttcttttcagcatcatgttggagctcaaaaaattttagattttggaacattttggatttcagatttttggatactcaacctgtatagctgctggtagaagtcacggaatttctgaatgaagaaaggttacagtgcttctcaaacttgaatgtgcatacagatcactctggggtagtctggggtagagcctgagtcatttgtggggtcagtagatctgctgggagcctaggattctgcattgctaacactttccccggagatacctatgctgttagtcgctgaaaaacagtttgaattaacaagattctgtgttcagaaaattgtaaaatgctagatacggaaaaagatttaattggataaagacttaaacatccataaacacaatttccagtctcagtgatagtagttgaaagaacttgttagttgaacacatagtgagtagtaggcctccatattttcttttctttcttttttttaaaaaatagagacagggtctcgctatgttgcccaggctggtttcaaactcctgggctcaagcagttcttctgccttagcctcccaaagtgctgggattacatgtgtgagccactgcacatggctcatattttcttttattttagattcagtgttgaattggaccttctggtcttctaagaagttcttgaaaatggcttagttgctgttttctcaatggatattttgccttgatgttggtttcccccaatgttcttttaagacctgtggtcactggttgtcatttaatcttttatttccccatctcttactacttatgtcctattagcaaactacagttatgtaggaatattgaatcattacaggctgcttagtattggaagtaggtagaatgttaattcatttattttactgagaagataacttggaatattttgaattctctttttgatttgtctttgtttttgatcctggattttaaaaaattttgtaacttagggaaattttataacttttgtaactttataaattttatatcttagggaaaaagtaggaaggccagaaacccatatacctaccactttgctgcaacatttttcttttttcttttctttttttttaaaaaatagagatggaatctcgctatgttgcccaggctggtctcgaatgcctcaccttaagctgtcttctttggcctcccaaaatgctgggcttataggtgtgagccaccacacctggcctcaatatttttatttaaaaaaaaatctagtcagctttattgaggtatagtttacatacaataaaattcaacaattttttaagtgtacgaattcataaattttgagaagtatatttacttgtataactacctccataatcatagaacatttatatcaatccaaaaagctccctgggctatttgcagtcaactcaaaatactttctaatttccatttgatttcttctttgacccatgaactacttagaaatgtaaattcctaatatttggggattttctgcatatctgttattggcttaattctcctgtagtcagaaaacatactcttagattttagtcttttaaaatttgtggaaacgtgctttgtggcctaggattaaggtctatctttgtgactgttccatgtgcccttaaaaagaaatatattctatctatctagtcaagttctttgtgtttaagtttttaataatcttactgatttttttgtctgcttgttcagaaaggagtggtatgatttccaactctagttacagagtctgcttttttctgttctatcaactttttcttcacatactttgaagctttttttatgtacataaatacttaggcttgttgtgttttcttcttgaattaggaaatgtccctctttatccctcataattttttttgttttgttttgaagtttgttttttcagctattactgtagccactccagctttctttggattagggtttggatgttatatattttcccgtcctttttactttaactcatctttatttttgtgtctgttagcatatatttacattttccttttttaaaaaataacaaggctggcgtgtcatctcatgcctgtaatcccagaacttcgggaggccaagccagtaggattacttaataccaggtgtttgagaccagcctagacaacatagcgagtccccatttctacaaaaaataagaaagattagccaggctgggcgcggtggctcacacctgtaatcccagcactttgggaggccgaggtggttagatcacttgaggtcaggggtctgagaccaacctggccaacatggcaaaaccctgtctctgctaaaaatacaaaaattagctgggtgtggtggtgcatgcctgtaatcccagctactggggaggcttaggcaggagaatcacttgaacctgggaggcagaggttgcagtgagccgagattgcgccgttgcgctacggcctgggcaacgagcgaaacgctgtttttgggaaaaaaaaaaaaaaaaaaaaaaaaaaaaagattagtcaggcatggcatggtggtgcaccagtttccagttactcagaaggctaaggtgactgggttgcttgaagctaggaggttgagggtacaatgagctatgatcacgtcaccacactccagcctgggcaatgagtgagaccctgtctcttaaaaatcaaaaagcgaaatgacagcttttgccttttaattgttatgttagatcatttactttcccttctgcttgctcttccccttccccttcgtcttctccttttccctctcccctcccctcccctcccctcctctcccctccccttcggagatggagatctctctctgttgtccaggttggaatgcagtggccgttcacaaatgtgatcatagtgcattgcagccccaaacttgggctcaagcagtcctcccacctcactctcctgagtagctgggaccacaggtgcacactaatgtactcagctggatcatttacttttaatgtaattattcatatggctgagttttaaactgtcatctttctatttgttttccatctgttcatagttcttgtccccctcttttcttgcatttttcgggagtaatatactttttttttttttttttttttttttgggagactgaggtctcgctctgtcgcccaggctggagtgtagtggcgcgatctcggctcactgcaacctctgcctcctgcgtttaagcgattctcatgccttagcctcctgagtagctgggattacatgcacctgccaccatgccccattaatttttgtatttttagtagagatggggtttcaccatgttggccaggctggtctcgaactcctcgcttcaagtgatccacccgccttggcctctcaatataaacttttaaaaatgattcaattttatctctgctattggctttatgatgatatacctgttgtattttttagaggttgttcagtgtacaatatctataacttatcactgtatactttcaaataatattacttcacttcatatggagtatatgtacactgtgtttctcctctgttttctgttgtgctgttattgttacacattttaattctgtgtgtcataaattccacagtagattgtgtgtttaaaaaatgtattcgcttaactttgaaagagattaaaaatgagaaaataaatcctttttattttcttatatattcattatttctgtcacttttattatttgcatcagtgtaggtttccatctggtattattccttctatctgaaaaactttatcatttctattaatggaggctactagtgatgcattgtaagctttgaagcccagaagggcttcgtttcacctcctcttctcaccttcatttgtgaaagttattttcactggctatagaatcttaggttgatagagttctttttttcttgtagtactttaaatatgtggctgcattttcttctgacttaacatagagtgtgctgtcagttttatctttgttcctctgtttataaaatgtgtcttttttttctggctcctttagtgcttccctacccacagatgattttaagaatttttttttctccctagtttttagtcattagcttatgacatgcctttatgtggtttttgtttatttatttatatttttaattttaatttttatttttgagacagggtctcactttgttgctgaggctgttgtgatcatagctcactgcaaccttggactcctgggctcaagcgaacctcctgcctcagcctcctgaatagctgggattacaggtgtgcaataaaaagtattcctggctaatttttactttttttttttttttttggtagagacaaggtcttgctatattgcccagctgatcttgaacttcttggccttgaacagtcctcctgccttagcctcccaaagtgctgggactgcaggcatgcactaccatgcctaattttcttttattttttatattcatataataaatacgatttatttatttatttattttgtttgagacagggtcttgctctgttgcccaggctggagtgtggtggcacgatcatagcttactgcagctttgacttcctgggcttcaagcaatcctcctacctcagcctctcgagtagctgggactgtaggcatgtgccactgtgcccagctagtttttatatttagtagagacagggtttggtcatgttgcccaggctcgtcttgaactcctgggctcaagcaatccacccgccttggcctcccaaagtgttgggattataggtatgaaccaccgtgcccaggctctgtggctaatttcactccactagtaaggtgttatttttctgaggactgtagcaatgctccatacattacaaggtctttcttctctagatggtagaaatatgaacattttccagccctgtgtgagctttgaggattgttttgcttccttctactggtggttcattttttctgaggcgggagtttattttctcacatgcttagatcagtagtcagccaaacccttagggaacccccacttgaggtggctggagctctctctctgttcagcttcctcctttctgacactctggcacatagattctaaatacctgatctccctgaactcagaggttgtctcaattaagtggaaacttcaggctcttggtttcttctccctgtcatttggcctggagactgcttacaggcagtaagctgggccagttgtagtagatctcacttcatttgtttctcttgtcacatcttttatctagttttctaattgtttatggtggtaggctaaattcagtctctattactcctgaagtagctagtgatttaataatttgcatatttttttcttttttaccctgcctcccaccctagaatctgtctagtgtgagttatggacatcgtgtcattttacccttaaatatttaaaatgaacctcccaaaatttagaaccttctccttataatcacaatgttgttgtactaaggaaaattaatatgaatttctttctttttttttttttgagacggagtcttgctctgttgcctaggctggagtgcaatggcacgatttcggctcactgtaacttctgcctcccgggttcaagcaattctcctgcctcagcctcccgagtggagacagggtttcaccatgttggccaggctggtcttgaactcctgaccttgggtgatccacctgcctcggcctcccatagtgctgggattacaggtgtgagccatcacgtctggccaatatgaatttcttaatataatctaagactgattctgctttgtctaggattgtttccaaatgtcgtttgttttcttctcaattggattctttttctattttccttttattgtttctttcatggtttttttctccagtgtgtttttacaatgttatgttcatggttgtgtgtctcttctctacccagatattctttttgctatgatataaagtgggtgagtttattttttattttttattttttgaggtggaggctcactgttgttgcccaggctggagagcagtggcgtgaccttggctcactgcaacctccgtctcccgggttcaagagattctcctgccttagtctcccaagtagctgggattacaggcgtcagtcaccacggcaggctaatttttttttgtatttttagtagagactatgggtttcactatggtttcaccactctgttggccaggctggtctcaaactcctgacctcaggtgatctacccacctcagcttcccaaattgttgggattacaggcatgagccaccacacccggcttgtgatttcttttttcttttctttctgcctctgagaccagtgtattttttttccgccttccaatcttagtttgaggggctgattattttgtgttttattcacgtttctgcagtcacggggctgtgatcatatataatttttttgagaattccaggactcccattctcttgagatttttaaataagtgaattgtgtggcatctgagggctaggggcaacatcagaagtccagtgtgccatgctttcctacattttcattaaaatattatttcattccttggctgcctgtttgaaagattatattattaggttatgaccagtgttgtatttagcacactgtcttgaaaaaagaaaaaaaaaatcctctgatttggctgggtatggtggctcacacctgtaatcccagcactttgggaggctgaggcaggaggatcgcttgagcccaggagtttgagaccagcctggtcaacacagtgagaccctgtctctacaagaaatacaaaagttagccaggcatagtggtgcgtgcctgtagcctgagctactgggaaggctgatgtaggagaatcacctgagccctggaggtcaaggctacagtgagccttgatagtgctactgcactccagcctgggcaacaaagtcagaccttgtctcaaaaaaaaaaaaaaaaaaaaaaagttctcaaatttgtagccttttcaatgtcagtttccatggtggtgtaaatactcccttcatggctgatttcaagctacaaacataatgttacagagcatgaagttgggaagggaactgacactcatgagcatgtatcagccaaattgcttatctttttttatttgatttcagttcttttcttttttttttttttgagatagggtctctgtcatctaggctggagtgcactggccgttatcatagctcactgtggccttgaactcttgggattaagtgatactccctcagcctcttgggtagcttggattacaggtgcatgccatcattcctggctagtttttttgtattatttatttatttatttttacttattattattttttgtgacagagttttgctcttcttgcccaggctgaagtgcagtggtgcgatcttggctcactgcaccctccaccttccgggttcaagtgattctcctgcctcagcctcttgagtagctggtgttatagatgcatgccatcacgccaggctaagttttgttatttttagtggagacgggggtttcaccatgttggccaggctggccttgaactcttgacctcaggtgatccactcgcctcggccttccaaagtgctgggattacaggcatgagccaccgtgcccggcctattatttacatatatatatttattatttcagacagagttttgctcttgtcacccaggctggattgcaatggtgcggttttggctcaccgtaaccttcgcctcccgggttcaaacgattctcctgcctcagcctcccgagtagctgggattacaggcacctgccaccatgcccagctattttttgtatttttagcagaggtggggtttcaccatgttggccaggctagtcttgaactcctgacctcaagcgattcacccccctcagcctcccaaagtgctgggactacaggtgtgaactaccacacccggccacctggctaatttttaattttttgtagagacaggggcctttctatgttgcctaggctggtcttgaactcctggactcaagtgatcctcccactctggcctctcaaagtattgggattacaggtgtgagctactgcatctgacctgatttcagttcttgaagtttgttctatgtgtgtgtggggtgggggcagaggggcaggtaggctgctttatcctctacccatggcccccttatttccctcttcattaagtattagggaatagaaattatgtaattcaatttcatacattatcttaatataagtttttttcccacagtactgagattacacaaatactgatatttaggcataattaagataaacattcataggtcttatatagaagatgataatgagatggacttggtaactgtgtgtcccggggaagtgtttttagctttcccaattaaaccctatgaatcatgttctatctcaattacaaagattcagaaaatcattactcaggtcttttgccagtgaaagtgaatagtatgttgcttttataaaatttgtgtgtgggacagagaaaagatgactttgtttaataactctcccagtagaatttcagctgtgtaaatcgttgagcttttgtcatgagtgcttcagaacagcaatagttattgttttaagttatcaaaagtgacagaatactttatctgaactgcgacttaaaaacttgactttttcctgatttaagcagcagagacagaaataaaaaccagcttgacgcctttggtgccgaaaaaggagtggaatccacagttctgcaaagccaagcttgtgctatggcaactcagaccacttaaatccaattcagtaatccagtggaaattttcaaaatgaaagaaattattcaaaagttctcattcttccccattattgatttcttcttttttgctaaactcaattatactacatttataagtatgtttaaaggatacagaagatgcattggtatatttgattccattatttagtcttgatttttaaaagttccatgctaggccgggcgtggtggctcatgcctgtaatcccagcactttgggaggctgaggtgggcggatcacgaggtcaggagatcgagactatcctgactaacatggtgaaaccccgtctctactaaaaatacaaaaaattagccgggcgtggtggcaggtgcctgtagtctccagttactcgggaggctgaggcgggagaatggcgtgaactcaggaagtggagcttgcggtgagccgagattgtgccattgaactgcagtctgggtgacagagcgagactctgtctcaaaaaaaaaaaaaataaaataaaataaaataaaataaaataaaataaaagtttcatgctagtgggttttattatctcttagacattggcttcactgaaatttctttgctacttgtgaagatagttttggactcattcttctcacctctcttgggaggagtgtgttcaagaggagaaggaagtaactcaatagtagtttaagttgaattgtccttttatgccgctctttgtgctcgtaagcattttgcatgcatttaaggtaggcattgttgtctccattttacagattaaaaaaccacctcctgagatttaaaaaagttaaataattacttagctcatgtggttatggctaggaagtgtcagaattcaacccagttttgttttttcttcctgaattcttggcttcagtgtgtgtatattggtctgaaaggcaaagtgtgggagaaggaagaaaaggaggaagggggaagagatgatgatgatggataatttattgaaccttgcctctttggtaggctctctaatattaattgtcacacatggtttaaatcatttaatctgtgagtcttaagagagagctactctagtttcttcattttatggacaggagactgaacctgagtagttttctattcgatctgggaaacaactaatgattgaaggtagtggtattcaaacccagatcatttttttttattctagtaaaaaatgcttaaggtaaaatgtactgtcttaaccacttctaagtatacacttcagtagtgttaagtatattcacattgttgtctaacaaatcttagaacttgaacccagataatctgacatcagagtttatgcccttaaccacatagtgcataaacagaaaatttagtgttggatcacagaatttagtgttggataatagatgaaccatttttagacaacttgttttataaaagaggacaatttagttaaaaattttacttgatttgtcaaagaatcacttttttttttcttctcttgaagatggagaaataaggattaaatttactttcctgcatgaaaggaaacaaggaaaccaggaaaaatacagaaagacaatttttttttttctttgagacggaatttcactttcgttgcccaggctggagtgcaatggcatgatctcggctcactacaacctctgcctcctgggttcaagtgattctcctgcctcagcctcctgagtagctaggtttatatgcagccaccaccacacccagctagtttttgtatttttagtagagatagggtttcaccatgttggtcaggctggtctcgaactcctgaccttaggcgatccacctgcctcggcctcccaaagtgctcggattacaggcgtgagccaccacgcccagcgaaacaatggtttttaaggcattggtcatcaggtagtgaaggaccctgagaggggaaacagtaaggttggcccttcgattgtgccagctttctgccttgagagatttatgggttgtggtactatgagagggaacctaggtagagtccagggaacttcctcagttgaagagatgaagctgagggtcaggggagaccaaagtggctggagttcacagacagaatatcagggtgaagagagagctgcacagaggatccctgagatctgcagaggcttccactgtagtgttcagcagagctctaatcagcccatatgtggaaactacctgaggctaaagaatcatcccaaaagattagattgaacggtacctggtgctcagatagggctataagtagtgccttttcttaccaggtagactggaaaaactcagttcatggagcattgggtagactactgagataggtcttgcctcagtagtgggaaataattagccccagactgagcactcattctacataaatttgtccagagaattgaagaagaggtaatacttctcaacacattttttttttaccccaataccaaaacttgacaaagatagtacaagaaaagaaaactgtaagccggtatataccctgaacacagaaaacaaaattctaaacaaaattacagtaaattgaatctgacaacatgaccaagtagggtttatctcagtaatgcaaggttggcttaacgttcaaaaatcagtaaaatttaattcaccatattaatacattaaaaagaaaaaatatgatcatcttaatagctgcagaaagagcaggtacagaaataagcatttgttcccgatagttttttaactttttatttatttttatactttttatttatttttattttattttttatttttattagggatgaagtcttgctatgttgaccaggctggtctggaattcctggcctcaagcagtccttccatctcagcctcctaaaatgctgggattacaggagtgagcccctgcacctggtcctgatagtttttatcagcaaaatgtgaatagaagagaacttgctcagcttgataaaggacatctaaaacaaacctatggctaacatccaaacttgtgtgtgcggttggaattaccctcacaataagttttaataatatatgtgttaatattaatgcagaattcataatagtgctgggattagggagaagttgtttcatacatattcatagatacttgaataatcgtgttagaactagaaggggtcttcaagatgatactaattcagaatgttgttttttttttataggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaaggtaagtaaatttattgctgactgtgtctgaagttcctctatattcaatctaagttaaagaggagatttatatccttaattttccttctctaatgcaaggtcttcatttggaaattccatttccactggaatttggtatatgcattaaaaaatgacttattttaaaatggattgcccttttatattgttgaggaaacagtcaaatttaaatgtttttgaatttatgaatcagatcttacattagtaaaagatatgtctttaaagaagattctgtgtacatagtttctgactactttttatatgttttatggtcaatatatctatctactggtgccagcagtgaaggtaactacttatatgccattgaatacatcatttactcagttttaccagttctaaaatgacagctggtagacagattacctgctgttttgttcagttctcaaacagaattgttaagtgataaaggggagtcaagggagagaggttaaaaaaaatcacttattgagtacctgttgtgttctagatgctttatatgcattttcttgtttaatcttctcaacatccagacagaggtaaatagctttttatatccgaggaaactaaggctcagagaagttaaataacttacacagcactgattttaccgagacctggctgaacaccccttattttttctctatctgttagggacacttacagaatcttggggatctttgtgaagccctctctgtcttatgtgtaattattaaatctattccttttgtactttttgtactgatgtaaccctgattgattactgtagtgttcacttcctaataagtttccccgcttctgctctgtttatcaataaagctattctactgctatgagatgacttttctctaaatacttcttttttcatgtcagcttattgatctaaagtcttcaattaatgattgttagccagattttcttaatttgacttttaagtttctctgtaaattaatcctagtctattattctaaacttactttgttttacttgccagcatcaagtgtgtatttcacccagaatgatcttctagtctgtgaatataccatgtaaactttgttctgtgtcatttgtcctaaatcctgatcatcttttaatgtacaattcaacttctgcctcttagacactttactttttaattccgtctaaactttaaagttacttatctgaatcattggcatcatttgtgccctcttcctttttgtgggtacttcttattaatttttccataaccgtgttttctgttcctcacagcaggcatcctggctactatttggtattatccattatattgcacatatggtacacgtgcttaaacattttaatggatgaaaaatcagataattaggaatgctgtgaaacttaaagtattttgtacatgaaaataaatgtgtcacttaaattaatgtattttccgtattacaaaagtaatgattattgttgaaaaaattacttttaagttataaaatcttctttatctgaaggagggaaaaagatttatttcagggtcttttcttctagataaacattttagtgtatttatgtactatgaaattacaagcaatcattagtcttactgtttttaatgagcatctcaaaatatacttagtattattaattatattaatctataccaaatatggtttgactgccaaaaggaaaagattttagctgcttttggcttaaatatctattcctattatataattagatttttgttagctgtgtcatgtaattcatattgaataaatggcaaaactaaatccctagctcctttgtgtgtgtgtcagtgagtgagagagagcagggaaagcgagagagtttgcatgagtgagtgggctgccatgtagttgtccaaaaaatgtttactgactgctagtgaaaagttacttagtatagactgtgggtgatagaaacataaatcaaacatagatctcataggagcagttagatgtgcctgttattgtataaggcacatgtgatgtgttacattacagataaaatgctatagatattcaaaggagggagaacttcttgctgaggcactaaaaaaggacctgaaaccaggaaatctcatgtaatgtggtctcatttatacaggtcattttagggtactttttttttttttttgagacagagtcttgctctgttgcctgggctggagtgtaatgatcctctcttggcttattgcaacctctgggttcaagtgattctcctgcctcagtctcccaagtagctgggactacaggtgtgcgccaccatgcccggctaatttttgtatttttagtagagacggggtttcaccatgttggccaggctggtctcgaactcctgatttcaagtgatccgctcacctcggtctcccaaagtgctgggattacaggcatgagccaccatacctggcccattttagggtgcttttaacacaaatctgcttaattaactatacaaacttactgtattttctgtaattcatccaatttcagatattttagtttattttcccaatttttatatattcactctgtctcagaatttctgccctaaaccgtggtcattttaattaccttttaaaatactttacttaaaaatgtaaagggctgatgatcttgttcctccctttccttgaaaataggcctacaaaatgactggagtagtataattacagatttcctgctaggtctttcttcctcttctatcgtctaacaaatattagtcttggtacactgtaactcctcctaacaggatttctatctgtatataaattatttattatttgttaataacattttgtattttatttttataaatttttattttttgtatttaatacgaatatgttttatttttatttttaggtagattggctcaacacataataaatataactttgaaatgactttgagttagagttacttgtagcccagcctataagatgtgtactatcttgtagcccagcctataaaattgtactgtcttatacattgtggctagaattgttttctgtatttcaccctttaaaaaatatcaagtagagtttattttttttattcacataataggctttagtcccctagaatctgatcagtatactttaacacataatagaatatattaaatactgtgcagttaacttagacataccaagaagaatatacttggaaggggttttgcttatacagttgtgacttacatttctgggtagtagcacagcttctgtgtgtgtgtgtgtgtgtgtgtgtgtgtgtgtgtgtgtatgtgtatgtataagtattaaagtaattttttgtggtttttatgtctaagcacatgaacacactttcagcatggcttccaagttttctgattaacagagtatattatatgccatgtttacagatgttactgttaaatgaagaaacgtttatatttttccaaaccaaaagtccattcttaagaattctatggccaggtgcggtggctcatgcctggaatcccagcactttgggaggctgaggcgggtggatcacgaggtcaagagatcgaggccatcatggccaacatggtgtaaccccgtctctactaaaaatacaaacaattagctgggcatgcgcctgtagtcccagctactcaagaggctgaggcatgacaatcgcttgaaccagggacacagaggttgcagtgagccgagatcacgccactgcagtccagcctggcgacagagcaagacttcatctcagaaaaaaaaaaaaaagaaaagaattctatgaaaagctgttgctcttgaaataaagcttaaagttgtttgaaaataaaagtaccatttgagtcagtgccatagtcgttaaggaaacaactccagtaatacttactagaagattaaactgttttgataatagatattagggtaaaatacatctcttagcttggctgagaaattaagaatcagttttctgagtttcagaaatcactgaataagttctgatgaattggattgctcacttagcaatgctgtatatatgtcagttatggcatttattttattataactttatttacatgcatatgtcctctactccttgtgaacttgaagtgcagagtgtgaatcttactcatctttttgatgtcgatgatggtcattttagttatattgagtgagtgaattgctggacatggtggctcatgtctgtaatcccagcactttgggaggctgaggtgaaaggatcacttgagcccagcagtttgagaccagtctgggcaacatggcaagatcctgactctacagaaagattagaagaaacttagcaaagtgtggtggtgcatgcctatagtcccagctacttgggaggctgaggtgggaggatcacttgagtctaggaaggttgaggctgccgtgagccatgattgtgccactgcgctccagcttgggcgacaagagtgagaccctgtctcaacaaacaaaacaccaccaacaaaacatttaagtacatagatactaggaaacagattttcttcttaaatattttatactctatgtcatcctcatcggtaattgttcttaatgactaagtagtaagcagatttgtcatattgtgggatgcaggatttttgttcgaaatttgttttctctcagtcctcgtgttcatgtgaaagtgcgtgatgtatcagggactgtcttgtaatttcccttctcttgttcttagataccatgttgtcctgccgttcctgtcttgttcttttttttgaggcggagtctcgctgtgtcacccaggctggagtgcagtggggggaacttggcttactgcaagctccctctcctgggttcatgccattgtcctgcctcagcctcctgagtagctgggactagaggcgcccaccaccgctcccggctaatttttttttttggtattttttagtagagacggggcttcaccatgtgagccaggatggtcttgatctcctgacctcatgatccgcccaccttggcctcccaaagtgctgggattacaggtgtgagccaccacgtctggccttttttttttttttgaaacagggccgggctctgttgcccaggctagggtagagtggtgagatcttatttcactgaaactcttgcctcctggactcaagccatcctctcacctcagcctcctgagtagctgggactacaggcacacaccaccatgcctagctaattttcatatttttttttggtagaaatggggttttgccatgttgcccaggttcccttggcctcccaaagctgggattacaggtgtgagccaccgtgcctggccattcctatcttaaccatcatgtactttagcatactataatttccagaaatttttcttacgtggtttttgtaaaatgcaggttaatattgtttatgttttgattctatataacatgttggaatatctctgtatcacctatattgatataggtgaaaataagaataaatatctgtcttagatttaacaaaggttattaatatagcatgagaaaaacttcattgcaagattgatcgcttttatagcttttagtatgattcttacgttgtatgtatatatatattttaacttatgccttttgtttgcacctgtcattgaagagaagcataagggatcactccactctttcttcttcctaatagagcttgtaggaattttctgaaacaccgtttcaaagtgataattaaaaaaataagtaaaatgaagtatctgagactcttacttaaaacgattgtctgttatgatatagtttatctttttggtaggaagtatatatacactattatattgaattatttttgtggttgtatgtatatgtacgtttaaaccttttcattcttcatatcttgttttccaaattatgtactttggggtaggcatcttgtctttattttctggtcttctcgccactttgctaacttgactgtctttgatagagttggtagcttacagccaccaactttgcatttgagtaggaagccacttagtaaagaattttgtgattttatatatgtattggagtagtcataaactggatggagaaaggagtagtgtggttaattcagactaattgactttccttctgacttgacatgaaatctagagatttcttctgagcctcagtttcctcattagtaaaaccttgaagtttagacaagataatatttaagctcctttatgctttaaaattctacaaaatatattagtatactaagtttaaaacattaaaacactagtcagtaataaaccatatttttctgcctgtgtatttatttgggtacctcagtccatacatcagaaatgatttttatgtaatatgtgatttgtatataatatagaagaaaccaaaaactttccttaagtgcaatataattgtttggagaatatacaactttatttttttctgaattgacaaggtaattcttcctgtagccttaagagtaaatttccaaactgtttaaaacaaatgattagacatttggttggaagttttctttgtggtttgggatttgagttctccctactcctgaaatatgaaggtttcaagaatatggcccaggtaacctgtaaaaggcataaatattcccttcactggttcttgcctggagttgggttagtctggagatgtctgtgacttaatctctgttatatcatgagtcaggtagcagaaatctagggcacttttaaatctgtagacaaaccagcagactttgagaagcagaggtaagaatctagggaacacaaatgaatgcctgatcatagagaagagctagggaataaatttgaatggtgtaaaaatactattgttatagatgtttaaaaacaaaaatttaaaaaatactgatggtagttaaatctcttccaacaaaatttgagcaaaaattcccaaaggaaaataatatttatttagtacctacttcgtgtcaggtatagtgcaacatacgttagttaaagtacattttacattgctttttatctcagtattggattttctaggatatggtattctttattcttgcctgattccgctttatacggaaattaaaatcccaagaaagctgtttgtaaagaaatctgaagggataatggctacttgaattacttactgaagcataaggaaaaggaaaagctgatctgtgttcatgttatttttgtatgactaaaagtaactaatattgctgacaaaagggtatgtgaattttatatgactaaaggttattaggagctgatcattgctttgagtttagtgtcttagatataattttaatatgaaatatcaattttattttccacatttttttccaggctggggtgtagtggtgtgatcttggctcacgcaacctctgcctcctgggtttaagtgattctccagcctcagcctcccgagtagctgggactataggcgtgcaccaccacacccagctaaatttttgtatttttagtagagatggggtttcaccatgttggccgggatggtctcgatctcctaacatgatccgcctgccttggcctcctagagtgctgggattacaggcgtgagccactgcacctggcctattttacatgtttttaagcactaaccaggccttacctggaagagagggaatgagggtttttgttgttgttgttgttttaaaatataaactcaactttctccctcctcctttgaaaagggtatggaagtaagagcgtgaaagtatttttctggctgtttttaattctttggagaaattgtttcctctaaaaggtaatctaaaacaggcttatatctgatggcttatttagtggtgtattttttattttttatttattttttgaggtggagtcttgctctgtcacccaggctggagtgcagtggtgcaatcttgtctcactgcaacctctgccacctgggttcacgcaattctcctgcctcagcctacctagtagctggcattacaggtgtgcaccacgacacctggctaatttttgtatttttagtagagatgggggtttcactatgttggccaggctggtctcgaactcctgacctcagatgatctgcccaccttggcctcccaaagttctgggattacaggcgtgagtcaccgtgcctggccagtggtgtagtttttaatgccagagtttctagagttggtgacctagacagtgaatgtcagaaattacgtatatgcctagtagaaaagcctatatattgtttttcttaattatgttatatttcatgctaaaatgtttcatgttcagttggatcttttgtgagataagtaccctagctcagattttatctagattcatagtcaaccttggatttttctgttgttcaagtggttaagctccttataaggttgttgtggcgttttcttaaaggtgcagcaaggattttatgtgactaaaggttcttttaatgtttatcctatttcattatacctgaaaatcttttatagtaactgtgttgaatatgtttagtttattggtttgaatatgcttgtttggtgtgttttattaagcatcagggaaaccttgtattatagtgtaatagctttaaactgattaaaaattctttggtcatcatatatacagttccttttagatatagcttctgaatacttattcttcagttaattgtattataacctgtttaatttcttaaagtcattctgtacctctgcaggttgacatacatttttgatacttgtatgcaggaataaagttgttaatttgtgtgcatctctgaaatctgaaattataatcactttgcactagtaagtttccaaaatagtctatattgaaccaacaagtcaaatataaacacaaggtctagcaaatcaagaatcttagttatcatggtgtgggacagatagttgtgttatatgccagtatcaattgccaggttggtattttattatttatttaggatggaatgaatgacagggtcttgctttgttgctcaggctggcctcaaacttctgagctcaagcagtcctcccacttcagcctcctgagtagctgggaccatagatgtgtgccattatgctcggctaatttttaattttttttgtagatagggcttcttgctgtgttgcccgggccggtctcgaactcttgggctcaagctatcctcctacctcagcctcccagaatgctgggattactggtgtgagccaccgggtgtggcctcaattattttttttttatctgtcaccaggaagatgttcagcattttgccatcctgggggctcccttatatatcctaagcaaggaattatagtttgatgtgacggaaagactgtttcagatttaaactctgattttgtgtgctcttggtcaagtccacttcatcagtttgttaaattagtaaatttaggtgattgttattttatacagttggtttacattagatacctgaacagtggaagtctccctctattcttaaatcctgtcattgttttattgttttgtttttgtttttgtttttttttgagaccgagtctcgctctgttgcccaggctggagtacagtggcgcgatcttcactcattgcaacctccacctcctgggttccagtgatccttgtgcctcagcctcctgagtagctgggatcataggtgctcaccaccacgcctggctaatttccatatttttagtagagatggcatttcaccatattggccaggctggtcttgaattcctgacctcaagtgatccacctgcctcgggctcccaaagtgctaggattacaggtgtgagccactgcaccaggcccttaatgttttatacatagtagtttacttgccaattatttaattacatagttgtgcgaggttggaaagtgtttatagaaaacttttttcttttcagtagataaatcaacttattctgtaatcatgtataataggtgtaaccatgtgttctgtaattatgccatcatgacaggttctttccattggccctcctttacgtgagactcacgttgttgttctgtttgtcttcttacataggatgaagttactcattttaagttttagttttacttttatcttccttaggaactcttgtagatttgtgtttatgtatttttgcttattttgaggtaattcatttacttcagggccatcggttaagcctggaactgtgttttccttttcctttttcttgttcttgtttttttttttttagatggagtctcgctctgctgaccaagctggagtgcagtagcgtgatctcagctcactgcagcctccacctcccaggttcaagtgattctcctgcctcagcctcctgagcagctgggattacaggggcacgccaccacgcccggctaatttttgcatttttagtagagatgggggtttccccttgttccccaggctggtctcgaactcctgacctcaggtgatctactggccttagcctctcagagtgctgggattacaggcgtgagctactgtgcctggctgagctttttttcccccccccaaagtttatagccctagaatttcttttcttttctttttctttttatcttttcttttcttttttttttttttttgagatggagtctcactctgtcacccaggctggagtgcaatggcgcgatctcagctcactgcaacctctgtgtcctgggttcaagcgattctcctgcctcagcctcctgagtagctgggattacatatgcacgccaccatgcctggctaatttatgtatttttagtagaggtggggtttccccatgttggccaggctggtctcaaactcttgacctcgtgatccacctgccttggcctcccaaagttctggaattacaggcatgagccaccgtacctggccgagccctagaatttctgtggaagatgcctggtggggtgtacattggctgactctctaccctttcccccttcctcctctgcagacctgttcctttcccttccagttcctctcctcttcccctcctcctctccttttcctttcccttccctatgataacttgaaaaaatgacttttctattttaaaaagtatactagtggaagataattggctcaaaataatatttgttgttaatattggcaacttatcttaaaaaataatttgaatggagactctctcaagcatcttaattaggaaggtgaaagttaagaggaaatgagtatctggaaacatcagaaatgccttagttaagtacagttactcctagtaaccactaacccaggcctgtcataggcctgcttcattttagatatgatagaactctattcatgaacacactgcttgtctctgggactcctggattactctgatagtacctcgaagcaaggattttgccctcaaatttcctctctgtattggcaacgtacttcattagttggggctttatgtcccattatgacttcagttaaaaggatgcaccctgtattttgttttcttctgagtattagaaccatactgtctttagctaaaatagcaaccccttgggaaaaggcaacttctttttagtctacagtagtccatccttgtttgcagaggataggttctagattccccaatgaatgcctgaaactgtggatggtactaaaccctaaatatattaaattttcctttacataaatacctatgataaaggtcagtttacaaattaggtacagtaagggattaacaacaataacaaataacaaaagagaacaattatgataactactgtaagttatgtgaatgtggtctctctcaaaatatgttactgtcctgtactcacctattttcagaccacagttgactgtggataactgaaacaatgtgggtaagaggggactactctatattctaactattctaacctatagaaagtatttctgtatattaagatgtaggaggtacataaccttcctgaaaacttatggaatgacatcctaacataatttattttgttgctctgcaccaaaggtggttctggtatgtctattatttgtctggtttggatgtaaaatgcttttctaaagcttgagaaagaaaaaccagctattactacgacgtggtaaaactgcatattcagagcactaagactagggactcagtatctgtttggtgcattttaaaaatttgctatcatttgttaaactgattttgtcctcctataacttcactccattctttacaattttactacttagccaatgccaaaaaaagaatcataatagaaccgctataatcaagatgagaaacataatacttactgattcataaaatcaatacagtggttaaatctgagggtaggaaaacattcccagtggaaataatgttctttatacaggacatcttacctcctcaaggaaatctacagtttatttttgatgacggtgtagtatattataaaataataaaaactaaacttgctgaaagaaacatagtagtggacagagtttagccatagtcttgaaagtggctcaagcattaaaaatcaaagagagttttttgtggtaatattgtaaagcacaattttcagtgaaagccaaattaggttataatttttatttctatatcttacttgcatttgttcagttttcaaagacttgctggagactaatgatgttactttaagactactacaacactccgcatgtgttagcttgactttttccatcatatgcttgagaggcattcttgatacagtagaaagagcaatatgcggcaaccaaatactagagttctactcctaattttagtcttacgaccttgagtcataccctttgattaaaatattcatcgtgtctcctttgtactgttactctgagggtaagatgcagtaatatatgtaaaagtgctctgaaaactgcaagcctctatgctgtatacatttaagaagaatgttgtaatctcatcattatcttcacataccatcttcccaaccaaatcccttgagactttaaccattatgaaacatggccacacaatttgattttataccccagctttttggaatgcagtgatttttaaaaatttatttttattgtagtaaaatgaaaagctaccattttaaccatttttaagtggtaaagagcaagatttttgccctgtggtttcctctctgtattgccaaagttcattggttggggctttatgtcccattatggcatcagttaaaagaatgcattaaatggcattaagtacatgcacaacgttgtgcaaccgtcaccatatccatcatcacaaacagaaagtatgtactcattaaacagtgactccccatttttctctccctccagtccctggcaaccaactattctactatctgtcccagtgagtttgctattctaggtacctcatatatgtggaatcatggattatttatgactgacttatttcacttactgtattagtccattctcacattgctagaaagaactacctgaggatgtgagggcaatctggctgcaacatttgtcaccccattaatctccagcgttcattcgactgatctggctggctagatgggtgtccccttcctccctcactgctccatgtgcatccctcctgaagctgcatgcttggtcgaagaggacgaccatcctcgatagaggaggactggtctttggtcaagggtatatgggtagctgtgctcccctgctagaacctccaaacaagctatcaagaactacctgagactgggtaatttataaagaaaagaagtttagttgcctcatggttctgcaggctgtacaggaggcttggctggggaggcctcaggaaatgtacagtcatagcagaaggagaaggggaagcagggacaatctcgtgagaactcactcgctatcagaagaacagcaagggggaaatctgcccccatgatccaatcacttcccaccaactcttcccccaatactgggaattgcagttcaacatgagatttgggtggggacacagagccaaaccatgtcactcaccataatgtctgagttatttcactgacttatgtctgacttatttaacttatcatgatgttttcagggttcatccatgttgtagcaaaaatcagagtttggttgctttttagggctgaacaatattctattgtatgtatacatacatactttaaaaaaacctattcatctgtttgtgaacatttgggttgttttcattttttgtctgctgtgttgctatgaacattgatgtgcaactatctgagttcctgctttcagtttctttgggtatatacctacaagtggaattgttggatcatatggtatttctgtgtgttttttttttttttttttttgagggaataccaaattgttttcctggaatacagtgatcattataaggcaatatatactgcagtttttctgactgttgagtcgaagtctaaacaattaaagaatctggttgttttcagatagctttttattgagggcttgttaaaaaactaaaaaggtagtatgtggttgggttgttcctgtcagctactttttattattatttcatgacatgttatccaacaggaatattgcaaagatttacattttataaaatgctaaaatagcataaagatgtggactgtcaaacagattgtagtagaattaaaattagaaagctataatccagtcgcttggttaacggaataaattatgtcaaattcctgattattcatttgtggttttactattttatggattgtgacaatctttaatttgttctggcttctttctactatttacctgccttctgggctctccctcattccttcttctgttcatgtatgttttagatacaagttaattttgatgttaatagaagcagtgaattttgatatgtgatttaaatttgatttttaaattatctgcactgctacttgactgcatatatacttgagaactgattttatatgtggttttaatccaatttaaatcaatactgggaatgttttgtatcttagacattattttgttttaaaaattattttaaaaaatttaaatacataatacttgtacatgtttctggggtacttgtgatattttgttacatgcatacaatgtgaaatgatcaattcatagcatttagggtgtccatcacctcaagtattcgttatttctatgtgttgggaacatttcaagtcctctttttttaaactattgtgaaatatacaatgtattgttgttaactgtagtcaccctactctgctatcaaacatttgcactttttacttcgatctaattgtatgtttgtacccattaacaacctctcttcatctcccctcaagccccacccactcacccttgctagccactggtatctatcattctgctgtctaccttcatgagatcaactttctaatctcacccataagagtgagaacatgggatgtttgtctttttgtgcttggcttagttcactcaacataatgacctctagttccattcatattgctgcaaatgataagatttccttttctttttcttttttttgagacagaatctcgctctgttgcccagtctggagtgcaatggtgcgatctcggctcactgcaacctccgcctccctggatcaagcgattcttctgcctcagcctcctgagtagctgggattagaggtgtgcgccgccacgcctggctaatttttgtatttttggtagagatggggttttgctgtgttggccaggctggtttcaaactcctgaccttgagagatccgcccacctcgtcctcccaaagtgctgggattataggcgtgagtcactgctccgggccttattattattatttttaatagtcaaattgtactccattgtgtatatatgctacattttctttaaacatttatccgttgattcacacttagttgattacatatcttggctattgtaaatagtcctgcactaaacatgggagtgcaggtatcctgttgacatactgatttcttttcctttggataaacacccagtagcaggattgccggatcatgtggtaattctatttttgttttcttgagaaatctctatgctgttttgcatagtggctgtactaatttacattcctatcaacagtatagaagagttactgttgcttcacattctcgtcagcatttgttatttattatctttttaataacagccattctaactgcggtaagatgatatattgtggttttgatttgcatttccctgatggtaagtaatgttgagcattgttttttataccttttggccatttctatgtctttttcttctttattttttcatctcaaaggacacaaaccaacatttctgtgtcttcttttgagaaatgtctgttcatgtcctttgcccactttttaatgggatttttttttaaactattgagttccttgtatattctgggtatttgtcccttgtcagatgaatagtttgcaaatattttcttctattcaacaggctatttctgtttttttttcttgattagcaagtggtcattgattttatttatcttttcaaaaaaacttggttttgtttatccttcctattgttttttgagtgtctgttttgttgaattctgccctgtttttttttttttgtttttttgtttttttttaagttggaattttgttctgtctcccaggttggagtgcagtggcatgatcatagctcattgcaagcttgaactccagggctcaagcagtccttccacctcagcctcccaagtaactagaactacagggctctgggctgttttttttacatttttttagggatggggtcttgctatgttgctcatgctggtctcgaactcctagcctcaagtgatactcccatttccacctctcagggtgctgggctttcaggcactgagtcactgagtcaccttgattattataatttattttcttctactaattttgggttttgtttgttcttgctttactagttccttgaggtgcttcattatattgtttatttgaaatctttccatattttttgaggtaggcatttattgctgtaaatttccctgtaagcagtgcttttgttgtatcccatggattttggtatgtcgtgtttcaaattttcattcgtttcatttgttttttgatttcttccttaatttctttcttgatcagttgtctttcaggaggatgtttgtttaattttcatgtatttgtacagtttccaaagttcttgttcgtggtttctagttttattcttttgtagtctgacttgatatgatttctatttaaaaaaatttgttgaaacgttttgtttcctaacatatggtctatcctcgagagtatttcatgtgctgatgagaagaatgttgtgtactctaactgttgtatgaaatctgtaaatgtcttttaggcctatttggtccaatgtgcagtttaaatccaatgattctttgttaattttatgtctagatctgtttaatgctgagagtggggtgttgaagtctaccaactattatggtattgcagttgatatctccctttagatctaataatatttgcattacgtaatgggtgctctgtagttgggtgcatatatatttagctactcctgcttgcttttggtttccatttgcatggaatatttttttccatctctttactttcagtctgtgtgtgtctttacaggtaagatgagtttcctgtaggcaacatatagctgagtcatgtttcttttatccatttagccaatctttatcttttaagtggaaagtttcatccttttacagttaaggttattactggtatgtgagcgcttattcctgccattttattaatttcttgttgttttgtatattttttggttttctttggcttttttgagatgggctctcactgtgttgctcaggctggagtgcagtggtgcaatcacacatggcttactgcagccttgacctcctgggctcaggtgatcctcccacctcagcccttcatagttgggactaaaggtgtacgccaccatgcttggctaatttttaaaattttttgtagagatagggttttgccacattgctcaggctggtctcaaactcctggtctcaaactcctggcctcaagtgacctgcctgtttcggcctcccaaagtgctaggattacagatgtgagccactgtgcccagcctgtatattctttgttcctttctttttctcttattgtttatcattgtggtttggtggttttctttagtggtaacatttgacttctttttctcatttgtgtatctgctctaccagttagctttatatttctgtgtgttttcatgatggtgatcatcatctttttgcttccagatgcagaattcctttgagcatttcttgtacagttggtctagttgtgtcaaattacctgtttttgcttgtgtagtaaggactttatttctccctcatttctgaaagaaagttttcctgggtgtaatcttggctgccaggtatttttttcttttagcactttgaatatatcatcccattttctcctggcctgtaaggattctgctgagaaatctgctgttagtctgataggagttcccttgtaaatgatgagatgcttttctgttattgtttttagaattctctctttgtctttgacttttcacagtttgactataatgtgccttggcagagaccttttcgagttgtatctatttgaaggtctctgaggttcctatatctgggtgtcaaaattgctttctagatttgggaagttttcagctcttattttgttaaataggttttttatcccttttgttttttctttgccttctggggcactgaaaatttgaatatttggtcactttatagtgtctacatgtcatgtatgctgtgtttattcttctttatttttatgttattggattatttcaaaatacctgtcttaaagttgtgaaattctttcttttgcttgatctagtgtattgatgaagcttttgaaataatttttgtatttcattcaatgaattctttacttccagtagttgcatttcgttcttttttatgatatctgtctatcttttttttttttttttgagacaaggtctcactctgttgcccaggctagagtacattgatgcgatcttggctcactgcaacctctgccttctgggctgaagcgatcctcccacctcaaccacctgagtagttgggactacaggttcacgccaatatgctgggctaattttttttttttttttttttagagatggggttttgccgtgttgcccaggctggtctcaaactcctgggttgaaacgatccacctgcctcagcctcccacagtgctgggattacagatgtgagcctagccctatgatatctgtctttggtaaatttctcattcgtattctaaattttatgatttcttagtattgtgtctgtatattgtacctcacttagctttttaaatattattttgaattctttttctgggatctcataaatttctttttcattggaatctattgctgcagaattatttaggtcatatttccttgctttatcatgtttcttgggtccttattgcgcatatggtataacagtcacttcttcccagttttttgaattcgctttctgaggcgagggctttttcctgaagatgtgtttatgatgttgattgggtagggcattttggcatgaatctgggtgcatgcagtggtgtagtctccgtataaattattcggctgtttacagcgttaatagtgtctgattttctcagtgatgtagggtttggtttgttagtggagtctgtggtgaggcttagctggggacaggttcaccaagtgggcctgtccttgggccttagggcaacatatgctggcactggtgttagcaggtccaggtgggctgattcttgggcctccaggtggcttacttgggtgttggtaggggcagtggttggccagttgggtgggcagattctcaggctcctgggcagcgtatgtggcatggttgatagtgggaaaaccctctgtttcccaggtggtctgtgctgataatggcagtggctgcaatgggctgggcaggccagtctccaggcctgcaggtggtgcatgtggttggggaccagctgtggtatgtaatggcagattgagtgggctaaatctcaggcccctaggagaagtgttcacatgttaacggtggtggagggggctgggtagacctgtcctcaggcccactagtaatgtgtgtgggtgttggctgtggtaggcaggggtggggtgatccccatggccccagtggagtgctcgagtggggccctgccactggggagggaagggttgctttcagtggcaccagacataaacattcagctgatgagtgggtctttgggccccaggtggcagctgtgggcagggtagtctgtcctcaggacacttgtaaaggtgtagtagctccactgcttggggcagcagggtcactgccaatagtttgtggtttagcaccagtggcagcagccagcaggagtggtggctttgggtggtgggagtcttacagtctaacttaggcctccttggggcacatgaaaatgcatagcagctctgctgctgggggcagtggggttgctgccagtggtttacactttggcttgggggcagcatgggatcacaacagtggctgtaggtggggatgtaagtggactccagggatatggagatgccggggctgtttggccccagggcagggtacagccttgttggggctgggctctcaaaacgtgctgtgctctagctgcttaggactaaggagtggaggggaccgttcatgagcagtatcatcgtgtggtccccaggcagctccctttgtcagtatgagatgattttcttattatgaaatcgatattggccaggtgcggtggctcacacatgtaatcccagcactttcccaggctgaagtgggtggatcacctgaggtcaggagttcgagactagcctggctaacatggtgaaaccgcatctgtacaaaagtacaaaaattagctggtcatgatggcagatgcctgtaatcccagctgctcaggaggctgaggcggaagaatcacttgaacctgggaggcggaggttgcggtgagccgagatcgctgcattgcactctagtctgggcgagagagagtgagactcatcttgggaaaaaaaaaaaaagaaagaaagaaaaaaagaaatcagtatcaaggctgtaaggggcctacttcaagtgttcttaacttctgttttccttctaagttgtttatctagcttgtacttagacaccttaatagatacataaatatttctttgggtagggtgtatagcatacaatgtttttttttgttgttgtttttgagacagggtctcactctgtcacccagacttggagtgcagtggcgtgatcttggcccactgcaacctctgcctcccgggctcaggattctcccattttagcctctcgaagtgctgggagtagcgtgtgccactaccgcccggctaatttttgtatttttattttaatttttgaggtggagtctcactcttgttgcccaggctggagtgcagtggtgcaatcttggctcaccttaacctctgcctcctgggttcaagcgattctcctgccgcagcttcccaagtagctgggattacaggcatgtatcatcacacccggctcattttgtaatttcagtagagatggggtttcaccatgttggtcaggctggtcttgaactcctgacctccggtgatccacccgcctcggcctcccaaagtgctgggataacaattgtgagccaccgcaccctgcttaatttttatatttgtaatagagacagggtttcaccacgttggccaggctgatcttgaactcctgacctcaaatatctatccgcctcagcctcccaaaatgttgggattaccaccaataccgtgccaggccagaatgttcgttcttttttttttagacagagtcttgctctgttggccaggtcttatattaaaacttaaatatctttttgtagcttttgccctcaatttttttttaccatatagaatactagtgctttcatttaacaggggtttcagggtgcaattttgctgaataataaattttaatgacgatgctgttttgagatagtgtttttatagtaactgtaaatgtgtaaatatgataatgatttttcaaaatagtgtgtacctttataaacataatttatgtatttacagtcacatatatggcctagaatttcctatcagtttgcaaaagtaattttatgaaaatacatgataggcagcaaaagttgaggcaggatacttgtttgttcaggagagtctatttttaagtttgtggagttctcatttagaagatgtgttgggctttgttgattacttaacagcagtagcttgggtccttaaggctttaagtagaaagcctggagttcttgtacctgggaagccctgggagttatttggcaagaggaatgtgagtacagcctcaaactaaaagggtgccaagactgacgtgaaatgaaggaaaagagaaaatagacaatgtttaaaaatgtacacagttttcaagctagtaaatgtatgctactgacccctacttacataaaatatattcatgttaggtatatagttagaggtgcattttggcaaatgtatatacttaggcaactgccattgaaatcaagataaagaatgtttctgtcgtatcacaaaattccctcattactttttactcttagtctccaccctaggcaactactgatttgcttcctgtcactactagatagattttgactgttccagaattacatatcaatggaattagactctgcattcttttgtgtcttaacaaaagtgcgtgttttcaatagttggcttttttttttttttaatttctgagtagtttgccattatatgaatacatctttctctttacttgttgatagacatttaggttatgttcagtttttggctattataaataaagctgctgctaacatttgtgttcagttatttgtgtggatatatgctttatgttttcttttttcttgagtagaattgctgggtcataagctttttttgtttgtttgtttgttttagatggggtttccctcagcctcccaaagtactgggattacaggcactagccaactcgcctggccttgtttgtttttgtttttgttttgaaagggagtgttgttctgtttcccaggctggagtgcagtgtcgtgatctcggctcactgcaacctcctcctcctgggttcaagcaattctcttgcctcagcctcccaaatcactgagattacaggcacctgccaccacacctggctaattgttgtatgtttagtacagacggggtttcaaacatgctggccaggctggtcttgaactcctcaccttcagtgatctgcctgtctcggcctcccagagtgctgggattataggcatgagccactgtgcctggcctggtttttatatgtttgactttgtaagaaagtgctaaacagttttccaaagtgatgttgtcattttccattcccatcagcagtgtgtgagttccaggtactcaacaccctactaatatttggagatgttattctagcaaagggtatgtgataatatattattctagttctgatttacatttctttgttgactaatgatgttatgtaggtttccatatgcttgtttgccacctgtgtatcttctttgtgaagtattttttcacattgttgtttgtctttcaatggttgtcttattattgatttgtaagaggtttttaaaaagatattccgaatataagttctttgtcagaccatatgtattgcaaatgttttctcccagactgtggcttgcctttttttttttttttaaagctatttctcagcggaagttttgaatttttaagaagcccttttaatgaaaaaatttttttcttttatgatttttgcttttgtttcttaaggtagcattgactaccaaggccatgacagttttcttctagatgtttccagttacagttttacatgtaagtctgtattgcaattcaatttaatttttctttatgatagaggtaagggtcaagggtaatatttttcacatggatataaattttttagcatcactttttgaaaaacctatcaattctttgaattgccatgatctatatatgttgagacctatttatatattcttaggtctttcatttcattgatctgtctatatttttatgccactgtttggttactgtagctttatggtacatgtgctaagcaaggtccatttacgaggcagaatccatacagtaaattgaagaatgaaattttagtataaagaattagctcttgagtcacccctgtgcagccttggtgccgtgtgcattttggacactcagcccaccttgctctctagtacttgtaagccttttcctttcaagatgcctgcagaggtgtaccatggagaaggggaggtggcgacttttgccttttaggcagaaattgcccaactcatgtctctcataatcaataccttctattccaacaaggagattttccttcaggagttgatctctaatgcttctgatgccttagacaagattcgctatgagagcctgacagacccttccaagttggacggtggtaaagaactgaaaattgacatcatccccacccctcgggaatgcatcctgactttggtcaacacaggcattggcatgaccaaggctgatctcataaataatttgggagccattgccaagtctggtactgaagcatttatggaggcttttcagtcttgtgcagaaatctccatgattgggcaatttggtgttggcttttattctgcctacctggtggcagagaaagtagccatcacaaagcacaatgacgaagaacagtattcctgggtatcttctgctgggagttccttcactttacatgttgaccatggtgagcccattgacagggataccaaagtgatccttcaccttaaagaagatcagacagagtacttagaagagaggtgggtcaaagaagtagtgaagaagcaccctcagttcataggctgtcttatcgccgtttatttggagaaggaaccagagaaggaaatcagtgatgatgaggaagagaaaggtgagaaagaagaggaagataaagatgataaagaaaagcccaagactgaagatgtgggttccgatgaggaggatgacactgataagaataataagaagaaaacaaagaagatcaaggagaaatacactgatcgggaagaactaaaccagaccaagccgatttggaccagaaaccctgatgacatcacccaggaagagtgtggagaattctacaagagcctcaccagtgcctgggaagaccacttggcagtcaagcaattccctgtagaaggtcatttggaattcagggcattgctgttcatccctcatcaggctccctttgaccttttttagaacaagaggaaaatgaacaactctgtgtccatcatgtgtggatcatggacagctttgatgatttgatgccagagtatgtcggctttgtccgtggtatggttgactcttaaggatctttccccaaacatctcccgggaaatgctccagcagagcaaaatcttggaagtcatttgcaaaaacattgttaagaaatgccggctgggcatggtggctcacgcctgtaatcctagcactttgggaggctgaggcgggcagatcacctgaggtcaggagttcaagaccagcctggtcaacatggtgaaagcccgtctctactaaaaatacaaaaattagctgggcacaacgcctgtaatcccagctacttgggaggctgaggcaggagaattgcttgaacctgggaggcggaagttgcagtgagccaagatcatgccactgcactaagcctgggcgacagaagaaggctctgtctcaaaaaaaaaaaaaaaaaaaaaaaaagaagaagaagtggcttgagcttagcttctctgggctggcagaagacaaggagaataacaagaaattagatgaggtattctctaaaatctcgtggcttggaatccatgaggactctattaactggcgacacctgtctgaactgctgtggtctcacaccttccagtctggagatgagatgacatctctgtcagagtatgtgtcttgcatgaaggaggcacagaagtccatctgtgacatcattggtgagtgcaaagagcaggtagccaactctgcttttgtggagcaagagtggaagaagggcttcgaggtaatatatatgagtgagcccattgatgagtactgtgtgcagcagctcaaggaatttgatgggaagagcctgctgtcagttaccaaggagggtctggagctacctgaggatgaggaggagaagaagataatggaggagagcaacgtaaagtttgagaacctctgcaggctcatgaaagaaatcttagataagaaggttgagcgggtgacaatctccagtaggcttgtgtcttcaccctgccgcattgtgaccagcacctacagctagatagccaatatgaagtggatcatgaaagcgcaggcattttgggacaactctatgatgggttatatgatggctaaaaagcacctggagatcaaccccaaccaccccattgtggagacactacagcagaaggctgaggcagacaagaacaacgaggctgtcagtgacccggtggtgctgctgtttgaaaccacactgctctcttctggcttctcccttgaggatcctcagacctatccagctgcatctaccacatgatcaagctaggttagctattgatgaagatgaagtggcaacagaggaactcagtgctgctgctcctgatgtgatgtgttcctgaggatgtgtttcacatggaagaagtagattaagagtttatacctgcaaaccttgtgcccttgcatagtgtccccatggctcccactgcagctttgagtggtcctgtcccacctggcgctctctgctgatatctagtattttttctcttctgtccttgtgtctaaggcaggaaacaagggcatcaagccccattccctctctactttgacagcagaattggatgttgtatatcctgtttttttgttgttgtttattttgttctgaaagtatgtaaaataaagaatatgctgtttttatacagtaaaacaacacaaaagattaccatttctggggattagcaactaaaagaggattatttttcttggcttgttgtggtatctgtaacatcatacttaatgttacagagttgcataaaagtggcaagtgtgaatatctttaccttcttcccaatcttaggggagaagcattcagtctttcatctttaagtatgatgttaactggagtttgtagatgcattttatcgggttaaggaagttcctgtctcttcctagtttgctgagaattttatcatgagtaggtgctgaaatttgttagatgctttttctgtacctaatgagatgattttgtggcttttctcccctttgaatgcggtgaattacattgatgattttagaatgttaagccagcctcttattacttcatttgcttatgatgtattgtcctttttatttattgctttgttcagttttctagtttttggttggatttttttgtttatgttcataaggaatatcagtcttttttttttttttttggggggggtctgtctttggttttggaatcagagtgagccacataaaatgagttgagtactcttccctcctgttttcttaaaatagttttataggacatcaggggaaccatctggccctggtatttttcttgtggaaaggccttaaatcatgaattcattttcttcagtagataggggcttattcagattttctatattttgtgatagttttcataatttgtaccttttaaggagtttattttatctaagtaattgaatttattttcattatgctcataatattactttatcactcaatgtctgcagtactggaatgatgttttcttttttattcttcattgacaatgtattttttaatgatcttttttattggctgtagaatttggattgacattgtttttctttcagcattaaaaaagttactccaataatttctagcttgcattattattattattatttttgtggagacagagtcttgctctgtggcccacgttggagtgcagtggcatgatctcagctcactgcaacctctgcctcctgggttcaagcaattctcctgcctcatcctactgagtagctgggactacagatgcacaccaccatgcccggctaattttttgtattttagtagagacaggctttcaccatgttgcccaggctggtctcgaactcctaagctaaggcaatctgcccaccttggcctcccaaagtgctaggattacaggcgtgagccaccacgcccggcctgcttgcattatttctaatgttaaatcagcagtcactctgcatataatcagtctctttgatggattttaagattttctctttaacgctgattttcagcagtgactgtggtgtgttttgtgggtttttctttgtgtgtatctttcttggtgtttgttgagttacttagacttgtgtttatagttttatcagtttggaagttttttatcattttatcaaatttttttttctgtctcctctcgcttctttatttatttactgtttgataggttactgaggctctgggttttttttttttaaactctttatctctctgtacatcaagttagatagtttttgttaccctgtcttcaagttcgctgatattctttcttgcagtatctcatctgctcttaagtcagtccagtgagagagagagatatatatatatatatatataattttttttttcattttagaaattatattttccaattctggaagtttcctcccctctcattcctttccctctctcctctcttccctgtccctccccttccctcccctctttcgacagtttttggtttctccttattgtgcttatattttccccataattctttaacatatttacaatatatagacactaaatcactaaatccttgtctgctaattccgttatcattcattctcactttttttgggggggactaattttcttcttctttgtcacatttctttatagttagtggtttggtttttttaccccttgttttttttaatagtttgtggtttttaattggatatttcacattttgattaatatttagtgtctttttgtcgttgtttgttttttttaaaattagagatggagtcttgctacattgcccaggctgattgaaaactcctgggctcaagcaatcttcccaccttgccctcccaaaatactgggactacaggtgtgagccactgtgcccacctgtgtctggatttttaaaaaacttttaatttaaaaataattgtagagtcacaggagcttctactgggaagtcctggacatctttcccccagtctccctcagtgttcacaatttatataactatattacaacatcaaaaccaagattgatattggtacaatgcatagagtttatttgggtttcatcagttttacatgtacgtgcatgtgtgtgtgcctgtgcataattctgtgcaattttgtcacatgggtagtcttgtgtaattatccctacaatcaaagatactcaatggtagcatcaccagactcccttgtgctatccctttatggccacattcatcccctcccccatctataatcctaaacaaccattaattggttctccatctccataattagattatttcatgattgtcgcatgaatcgtattatgcaagtagtatctttgagattgacttttccactcagcataatttttttgaagtttgtacaaattgttgtgtttatcaatagtttgttcctttttattactaaattctatcctattgtatggatataccacagtttaactgttcgtattttttttttaaaaagtatggagttttgtttgttagatagttgagtaacttgtggatcagcttgacccttttgagccttttttttttttatgattaattaagcagaaattttatttccaagctcttcaaagactgttacaaacacaaataatgtatccttctaaaaaagtgtcccaaattaaatcagattcacatcatcaaagtaaaacccttgtgaagttaagaattcttttaggttgtaatgtttttatgttagtttttaatcatttacaatgttctgtgggtcacattttaaacatttttaaatatatgaaattctgtatttctttaagtacagccacagctacaaagtagaggaacgtaagaatacaaagaccaaatctgcttcatttatatacacgatggggcagcctaatgcacatcataacattaacttttccaaacaagtttgctaagaatctgctcccataattagtgttaaaaataaaacaatcttcccatttagaaaaatcaagacatcagttgattagtaaagcctattcttcctcccagcaatttgtactttctggtcttcatttaggaattgtaaattcatgagaaaagaacaaattttttatggtataaatatcttccaggaacaacagtttacaagtattcgattgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagctattactatttaaaactctattccttcacccagtttcctcactcaagtagaaactcatgaatttctgtgattttggctataggacggggccacaggaaagggctgaaatatctctaaaagttagggaaaagtgttttcttgagacttgaaggcagtcattcatcactttgtgcttgaaggcattcctcagcaaacttctctcttagagtcttcagagtaaagcacaggatctgggttcccagaaggggttacttccagctagaacacccaccagcagggcatccttgcaggcattctgcatacagtactgttgaagctctgcggctgcctgagagacattgatcctctccacgccagcctccaacttgagctgctccaccaggcactgcagggcgctcgcgctagccccagaggacatggtggcggcgctgggctccgagggcccagccttgtttttaagctttattaggataggtttgaagtagcctttattctaggaatagtttgttcctatttccaaggagtggcttttctgggttctctattaaatgacaacaaagtctgtcttctgtgcttgatcacaacttcgatgtatccctgtctcttgtaagatccagtaattggtcaactaacagctccttaatagttgtttttgggcccacctttgtggagtctctctttatgcatccacgatagtattgagccacagactacaggtgaacgcctgtgcagatttctggagttctttctcattgttgcaccttccttttttcttaaatcatagtccttcactgcttgttgtctattgtctgaaagcagttgtttcatttatgtaactgaaaaactgtatttttgaggtgggtaggcaagtccagtaatggtttctccaccattgtggcaacaaaactttttgtttatttctaagttagtaatttgaaagtcaaaattgattcatctgtccaaagagcagtagtttttgttttgtgtcttaagatgttattttaacttacattttattttttgaataagaaatatgctcgtatgttttaaaatttaaatgccacaaaagatatacaatgaggtatccttccctcccttatttcccagtcacccactttccattcttggggacaaccattgttactagtttattgtgtatctgtcaagaaatttgatgcacattcttataatgtgtatcttactcagaaattctctacacagaaatgtggagatatgtatatatacatatatatatatatatatatatatatatatatatatattctccttcatattcttgtttttaaaaaaaggtaacgtactatattcttttttgtatcttatttatttatttatttatttattggagatggagtgttgttctgtcacctaggctgcagtgcagtggcgtgatctcggctcactgcaagctctgcctcccccgggttcacgccattctcctgccttagcctcccaagtagctgggactacaggcacccgtcaccacgcccggctaattttttgtatttttagtagagatggggtttcactgtgttagccaggatggtctcgatctcctgacctcatgatctgcctgcgtcggcctccccaaatgctgggattacaggcgtgagccactgcacttggtctttttttttttttttttttacttaatataacttagaggtctatgatttgattacatgtaaatattttatatatttttttcagctttgtagtatacagttatatgggtatacccataaatacgattatgtaccataagcaaattaactagttctgttgttactaatcatgtactatttcaaatagtgctaaggtgaataatctttctgggctattttccaacaccagcaaccaattctcttgattctccagacaccaagtgggtgttcaacaattcagcgtaattcagttctcacagtaaatatctggagctagtgcagaccccacagcttaagggcccattcctacaacactgctttccacttcagacaccatttgtaagtcctgcgccacctgtacttcggaccacctgctataaattgggggttccctcaacctcctcctaaggttagataatttgttaacctggctgacagaactcaggaaaacagtttacttactcttgctggtttattataaaggatacaactcatgatcacctaagtggaagagatgcgtaggaatgtgggaggcagcacagagtttctgtgcgctctctgggttcactaccctccaatcaactcagtgtgttcaaccctggaagctgatcagatctcattgttcaagagtttctatagagcttaatctcctgtctctcccacctcactttctggggtggagtcagtggctagggctgaaattccattgctcttattatttgatctttctggtgaccagctctattccaaggtcatctaggggccccactctaagtcacctcattagcataaactcagatgtgagtgaaacagactcattatgaatgagtgaagagacacctatcactgaggatattccaagggttttaggagcactgtgccaggaactggggacaaaggtcaaatagatttggccctctatatctgtggattcagtcagccttggattgaaaataattcgcatggttgcatctgtactgaacatgtacactttcttccttgtcattattccctaaacaatacagtataagaactatttacatagaatttatactgtgtgaggtattataagtaattttgagatgatttaaagtgtacaggaggatgtatatatacaaatactctacaaatacatttgttatatacaaatactgtaccattttgtataagggacttgagcatttttagattttggtatccttgggggtcctgtaaccaatcccccgtggatactgagggatgactttatatttccttctcttttttttttttttttttttttttgagatggagcctcactttgtcacccaggctggagtgcagtggcatgatcttggctcactgtagcctccacctcccagattcaagcagttctcttacctcagcctccccagtagctgggactagaggtgcaagccaccatgcctggctagtttttgtatttttagtagagacggttttgctgtgttggccaggctggtcttgaactcctgacctcagatgatccacctgcctcagcctcccaaagttctgggattacaggcatgagccactgcacctggcttaactttatatttcttattatgccacattctttgtagtatggaagtaatttcacttacatgcaagtatatgtaagatacatttctagaaatggaattcttgtatcaaaggctatgtacatttgtaatttggattttttaaaccagttttcccaccatagagattgtaccaacttattcatgtcacaaatgtgtgaagtgactgtatgtttccccatacaactttatgttacaaatttttattaagtaatttaaaaaacaaggttcttatagtactctgcaaaacatgtatatgtaaaaaaaaagacgtaatactttgttgtaattgtcaaaaaaattaagtagaaattctattatgttcacaattataaaagacttgatatacttttaacagagttgagtaatgttagctaatttgttgccattttatcatatatctccaatgtgccaggtactgttatgactttatatacgttataaaatctctaatatttaaagtaattttacaaggtgtatagaatttatattacctttatttcacagacaggaacctgagctagtaaattctaggcttaagatttgattccaattcgattctaaactctagatttttgtcatatctttaattaattttactttagtattttgatctttcccttttttgtgtagaggactaaaattcctctgatttcagccattatcctggtctttcggcattcccaaattgaattaaggaagatttctataatttgcaagaattagaagccccagggtaaaacaaagagcatacacacttgtctttctgagaagagatgttaaataccccatatagatgctgctttcttctgtattttcttatttaacttgtagaaagtaagggagaatagcaaaatagcagaattactagagagagaagacaggcagtggtagataatagtaattgggtcaggaagcctgttttaatctccaagtaacttatttgctgtttgaatatcttgttttaccatgtaagaatcagtctataggcatttatttttaacatcctagacagttactgtttaattttatctcatttagagtcctaccacagctactaagttgacttttagagcagaatatgtctttaaaaatcttggtcagcgtatttcacaaatagacaaatttcataacagtccacattttgtagactttttaaaataaaaaataattgtttaaaatttggatctttttaatttcagttgttcccccttcccatcccattttacagacatttcaacctacgaatgaagagggacacttcccttttcagtgatgaatttaaagtagaaacatcaaataaagtacttgattatgatacctctcatatttacactggacatatttatggtaagttggaccttaacagaacccttttcttccatttttttttttctacacaaagatactcattttgaagtgtaagcaaatatttcagaaaaggttataaatccagaggaggttgaattcatatgaagggtaatggtctttgagaaatgaagtaatgtttggacctatctttacatgtatgtttaatagtgaattatgaaatatctggcttctgaaaggggtgaaattttgactcagtacctctaaactgttagagttttcaaaagttttaacgacttctgtaattttctgattttccaagtaagaaattaatagtaactttgctgtgttttataagaaaacaggaaaagtctaaaaggaaacagtaaagatgatcttagccaaaaataatgtgacagagtcatctgtaggaaaatcctcccaaggcccttcttcctcagaatctatttgctttattcacaattctaacaaatttctcttgctgcatcaaattgaaaatgcatgttggggggcatcagtggcacacttaacccaatagaaagttacatctactagtagtgttgaaagaacagaacaactatagaagtcataaaaaagcttaaaaaatgaaaatcttctgggggtgttggagagaggcaaaatgtcattgttttataactgtacattagtaagtactcaagatgattctcacttaagacagtgttaaactgtttgagattatttctacacgagtgatttctactgaaaatagtaacatgaaaaattaaatgcttaaagaattttttctcatttttcgattgtgccagataaatgaggcatttctatacttaaactttctcatttgtagaataaacctaatcattaaattctttagcttttttgtactcttacaattctgtaaccaaaatgaagcgtttttcatcagtagattttcaatgtcagactttagtgttatattgtcttcttgattatttatctttctgggcaaataacttagtagttcctgccctttttcgctaggtgatgagatcaagaaaagtccgaggccgtaaatgagattgcagataaaaatcatgttatttaggccaggcatggtagcagttacacctgtaatcccagtgctttgggaggctgaggcaggaggattgcttgagacctggagtttgagaccagcctgggcagtatagtgagaccttgtctctaaaaaacataaaaatttagttgtggtggcacacctgtagtttcagttagatgggaggctgacgtgggaggattgctgagcccaggaggttgaggctacagtgagttatgattgtgccactgcactatagcctgggggacagagaggggccctgtctatttaagaaaacaaaacaaaacaaaaaactccaaatatcagcgtcttgggctcttacctccagtctatgattaattcagaggcaactaattaatgttattctacaacttagaaattgtggaagtcctgatttttattttaatcagagaatcgtaatgggtaaattcaaggtttaaagccctctccctctactttcaccctttatgtcatttgattttggtgctcaccttttcgttgtgattatattaagaaccaaaagtaccttttttcctattatttcctttcactggagaagtgtaattgatgggatagtattacaaatctttgtccaatatctttaaaagtactgttggtatacttttgttcaaagtgcccatgaaatatttgacactgttctatttaaaaatgtgtttataggctgggcgtggtgactcacgcctgtaatcccagcactttaggaggccgaggcaggtggattgtttgagcccaggagttccagaccagcctaggaaacatagcaagtccctgtctctaccaaaaatacaaaaattagctggaggtggcggtgcacgcttgtagtcccagctactagggaggcggaggtgggaggagtgcctgagcccaggaggttgaggctgcacagagccatgagctcgtcactgcactccagcccgggtgacagagcaagaccttgtctcaaaagcaaaacaaaacaaaacacaaaacaaacccctaagcatagcgcagaagccaaaaggcctggcccatgcacaatatatcggatggaaaaggagcttttttcttgtggtacctgtagcaaaattttcaaaagatgctttggatgtctttattctgaaagtgtgtattttatcagtgggtttgcttgcttcttttaagttaatttaacaattaattgttttgttttgttttgagacaaggtcttgctcttgtcacccaggctggagttcagtggtgccatgtcagctcacagcaacctccgcctccagggttcaagtgattcttctgcctcagcctcctgagtagctggacttacagacatgtgccaccaggcccagctaatgttttctgtgtttttagtagagacagggtttcgctatgttagctaggctggtctcgaactcctggcctcgagtgatctgcccacctcggccccccaaagtgctgggattataggtgtgaaccacactgtgctgggccaatttacaattattgatgactactgcatacatgctaggcactcagctaggtgcaaggaatgtggttggtaacaaggcagatactctatttttcattgctgttattagtaattgtatatattttaactaaatactagttgctgttcacatctcacattctgcttgatatattttatgtgaaaatttccatagtaaatttatattcaagatttaaccatatatatgtgtatatatgtatgcatgtgtgtatatatatacacacatatatacatatatatgaatgaatttaacattcatgtgcaaattaaattgtcaagaatttgttgctttcattaataggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtaagtacttaagttttatcaagtagcctttttcaaaaggcatatgatagttaaaactgtgtggagacaaatgaagcattagctgttttctttcctgagttactaatcaggctagaacatagtttttactagcaattgctatttaaggaatagtagatatatgtaatgaggcaatttccttgtcagtccattgccagtactactttgctgatatgacataactaattctgtttgaactgtgtgagtcaaccaaatctgacggaactggaaatcgtatattttgacatcagccagtctgtgtaatgctaatacctttgtgtgtatgacctattgaaggtagaagagcatcattactacttacataaatttcagtgtggatatttgtgtagtgtttaaggaatattttaggtatttttgtaatttttaagtccattgagtatttctttttagaatcttaaggtaatgacttgacttcaagagtccacgtttatcatggattttgttctctaccatctttatatgatgatatttttctaagaatagaaaatgtatttagactttaccttttaattctattgtccgtatatccacagttatccagttattgggaatgcttctttgaagtaccacagaaataaatttctctaatttatatagctcttgaatacccatttattattttttgactgtaattagactagtctctcaatttttgcctgctttcctaacttggcagcttcttcctacatacgttttcctttgtatagacagaaatttattgtcaatgattttattcttacccctagtaatacactgacaagcattaaccattttgactttttgctccatcagctctgacagtttttgtacttcatctgtccaactgcttgttatctctgctgctagattgctatagaaaataacatatgtatactaggtaggatgcatttatgatttttagctacttgttaaatcataagctcattaatgctacttccctgtattttcattcaccactatttgattccttttccagttttaactcctggtatttcaaactctacctttcttttcaagctctaagctatcatcctccttcataagtaggaatatgaattcctttgctttcgtttctttctgctgacaaaattattatttacctggtttgtgtcttgctttgtagctttcttagtaatttaacctttttttgcagggttacctcccctatcagggtatgtaagttcttcaggtatagtttctgtttcttttgctcctgtaatattgcaagtatcatttgtctgtgcagcaggcttttcataaatacttaatgaaatactggaatatttttctagaatgttttatcaaaatcaaagaaaaccttttgaggaatgaaggagaggaaaagcgtaatctgccagattattttttcctttctatcatattgtaattatactttctccattgctttctacttgctatcagtgccctctactgtatttgttctgcctgttttgacttctgttattgtgcctctctcatgttttccttcttctgttatctacttgtgtgtagtttaagaatattcttttttcccacttttctttctttcttgtaatataattgtattttttgcatattgcatccaacagtaatttccaaatatcttaataggtgtcaatctttttttttccccaaagatgatgagttagcttggaggatgaatgacactggatgttacttgattttttgttctttttggcatttaaatgctttatcattgatatcagcttttattttatacttgtttaagtaaatatatgtttgtggtaaggagaactttttaacattctttttattattacatatcagtagtggggttagaatttaaaagcagcaatctttaaggtgattttatttgtagcttctcaggtaattgaaattgtaggatatgaggatgggagtacggaaggagttcccttaaacagagtttttaatgtttgcaaatttagacaattacttgtgaaaaactatctaaaaatctgtcaagtgaaccatggtttaagacaagaaaacattcatgtattagtcttttattctaaatagttgctatatttatattctagaccgtggttcgcaaattctctgcagagggacagagagtaaatatttttggctttgagagctgtatgttttattgcagctactcagctctgccattgtagcacgagaacagccaaagaaacacataaataaataagcatgggtgctttttttaaagaaattattatttatttatctatttttttggagacagagccttgccctgttgcccagtctggagttcagtggtgtgatcatacctcactacagcctcaacctcctgggctcaagtgaacctcctacctcagctctgtgagtagctgggactccaggtataagccactgctcccagctagcatggctgtttttaataaaacttcatagacacttaaatattaatttcatatatatttcatatgacataaaatatcattcttttgattttttctttaaccatttaaaaatgtggaagctacccttagttttcatgtcaaacaaaaacagatgggagggctcactaaatttaataattactttaattggttctttaaattctctgtgtagaatatgacaggttctagaagtagtagtagtagcagcagtagtaagaataattattatggcttaatatatacctgacagtgtataaaaatctttacttgcattattgaattgaattctcaaaataacgttatgagatactggcacacctattattcccactttataggtgaaggcttaaactgaggcttagaaaacttatgtcacttgattgtggacctcctgttctttaccctgtgctcttctgcttcactcatggaagaaagctgtaaattctcactgcctttacttcaaggatttctggggcttttctgaaatctgtaagcctctctaaaatcatacatttgcatctattgctgttttaagccaaactctctccttaatatatttagcagtgtttattttataactaaatggcaaaggatgccctttaatgtgtattattatttttatataattggtttaagtactaataatttattttcagaagtaaagtactgcattattgtatcactgtgaatgttcttaattggatttggtatcgttgtatatgttatccttaccaaaaagaagcaaatggtaggggaggcatactaaccttggatataccttttgatgagaatttggctaccctcttcttaatactgtttttgcaactgaaggcataaatgtatagaaccatcatgaaaaatgatactgctattctccagaaccttggggaatggcttctgagactgtaccagaacacagggatagttttcactgaaaatacttaataatttctctagatgtgatagtgataaatatatattgttatcagcttaaaatgcatacttatttaattctgtacttagtaaaaaacactctctcctaggacatggtagtgtgaacagttaatgacaaggtaagaataccacttagtcctctgccccttagcacagtttattttaaagaaactgagaaaaacattgttccataaactagaatagtattgttattaacatgaacaggttttaggaatatctgactatatgactgcttgcaataattcccttacaccttttttgtgtactacctatccaagagctaaaggtctgagtaatttttttattctatacttatagagaaatacttaatctccaaattaaaaaatatattttaattgtatatgaagagctgcagaataatttatttgggtttattgctttcatttcaaatttattatttattttcctttgtggggtatagaaaagcccagagaggttgaatttgcctatacctccgtcgcccaggctggagtgcagtggtgccatctcagctcactgcaacctccgccttctgggttcaggtgattctcctgcctcagcctcctgtgaatagctgggactacaggcatgtgccatcacgcccagctaatttttgtatttttagtagagacggggtttcaccatgttggccaggatggtctcgatctcttgatctcttgacctcgtgatccgcccgcctcggcctcccaaagtgttgggattacaggcgtgagccactgtgcccggcctgaatttgtctataccttatagtagtagggcacccctactttagaatgtgtgttagccatacctatacttatttcttctttctcttgtgcttcaatgggaagacctcctatttcttgttctgaaaaattaagattgttaaactttattttaccatttcaagatggaggcctcttcattcatgtagaagcttcctcatttgtggaaatgtcaggatgttgcatctaaaacttttaaaatgtcaattagttccatattgtgtttttgaagttgttttctgtcactgttagtgacagggagagacaaaaggaaggaatacaagagggaagaataattgaattggtaagtattgataatagctagcattgtttgtatcattcacatataacaggaaaactgttttagaaagcattctggctatacttaggtccagtctggagattggaaatctgcataagcatattgagttgtgacaaactatgtagccaactggaaaagttgagatgtggagtgctctgattgtttgacttctgaactcccacagtgcatacaagtgtattggttaatctctctactatatgttttgaatttgtatgctttactaagcattgatgttagatactgaacttatttaagcacagtgatagtatttgaaagaaatataaaaatttagtggtattgttgactctgtcttttccttttttctgagttaatctcttgggaagtataaattaatttttctaaacaactcacaggcacagaagccgaaaagttgagaaggccacagatatgggagttattttaagaataatatttaattagaaatgtaggatactaaattggaaagttaaaaaaaaatcacaaaaaaagaggcagtggctgggtatggtggctcacgcctgtaatcccagcactttgggaggctgaggcaggcggatcacgaggtcaggagatcaagaccatcctggctaaacagtgaaaccccgtctctactaaaaatacaaaaagttagccgggcgtggtggcaggcgcctgtagtcccagctactcgagaggctgaggcaggagaatggcgtgaacccgggagtcggagcttgcagtgagccgagatcatgccactgcactccagcctgggcgacagagtgagactctgtctcagaaaaaaaaaaagagagagaaagagacagtgaggggcttaattctttttagcagaatctggaaaaaatatgcttagacttttcatattatgcatattatgcatttcatattacgtaacgttatataaataggataacagttgaaaattttagatcaagttcttttctgattagttatatatatgtatgtatatgtatacatgtatattcatatatatttatcttaaaacatcaatataaaatattttagctataatgaaatacaatgaattatttcagaaatataagatttttaaaataaaaaattgttattagaagcatttacagtgtcaaaaaaacagctgcagcttttttttttttttttggcaattacagagtggtattcagttaagagtaatacttattttgtataagctgcatcagagagaaatgaaggtgaaaaactaccatctccatatataactcatttgtgctgtgcaccaataagaacctgctttagattttcatgctggcttacagctctcatactgtttcaggcaaagttagtggttattgaaaataccaccaggatgggctgtctgtccgtctgtctgtccttccatccatctgtatttttttttctttatgctctctcatcaactgactgtcaaggatgggctatctagagacacatttgatagtgtggttaactgttagtgtgttaactgtacagtttaaaaacaaagccttacctttaaaggtttttctttaaaaggagtgagttgtgtacaggggtgctaaataatttataaacaaggacaaacactgcactagaaccaacttattcattatgatcatcttcatctttcttctcttcctcatcctcttcatcttcctccttttccttcttattttcaacttcctcaccttcctcttctttttttttcagcattgacatctcccttttttttttttttttttttttttgctgcatgaggccttcctttagctcagtatgcagcaatatccatttcttagtttttcttcagcttcacagccttttcataaggctgcttgtcatatgcaccatatccacatctttcccagtttctttgaaacatcacgaatggataggtttggatattctccttagatttttgggcagtactcagggcaaaatgaaaagactgaaggagccctcttgggtacattgggatccctaaacttttttgtttcttctttaggagggatgtaagtttctctttaatagccatccttgtccccctttgccatgtcttcagattttcctttctctttagcagatacggctttccacctctctgagcattttttagaaaattccgagaagttaactgaagcatgagtgctgcttcttgttctcctcctggaagtttgcacaaagaatgcatatgatgaccttttgcctcttggcttcttaggatcttcttttaccaagtttagttatttttcctcagagaagcacagagtcacctagtgcacatctggctgccatttgccccagcactgtctccatggaggtcaatgtactgtaatggctatcagaaatacatgattatatgaaaataaaaaaagctttcatgttgtaaagcaactttgaaagtcaccctaacaagtaaaattatatttgaaatttttgttttttcttttgagaactatcttctcatgattttgttttacaaataaattgagtaaggaattttataattttagtattgtaaaaggcactagattcaacactctaaagatgacggaaactgaagtctagagttataaaacttgtgcagtatgacatggatccatgtcttttggctgccactccagtgctttatttctgttacattctgagttaggagagtttaaaggctgctaaaaggccaagaacttaatgacaatagagacaatgacagtaaggattaaaaaaaaaaagttatttttggtatcattgattttgaaggtgagccatatttactactgaaaaagcaaatttatattttaggctcactttaaaaaatatatatatttattaatagagacgaggtctcactgtgttgccaggctggtctcgagctcttgagctcaagtcatcctcctgccgcggactcctaaagtgctaagatgacaggtgtgagccaccatgcctggccaaggctcaactcttataagtgatgagttacagaaaaactagaagaaatagcatttaggagtatgtgtgcgtgtatgtcctagagatactcggagctaaacctcagcctttcacatctctgatagcataattcatagatttatgtttgtaccagtgaccttataagagtgcctgaggacattggtccaggactctggccctctaaaaagctgcttctaaagaggcattgtgagatctggtttattaaagacatgttatattctgttcatgatttataaattgggggattagataatctccataagcagtcttgctatcttgtatttatatttgaacataaaagtctagaatttatagatgtggattttactggttttagcttctagagacttcttagaatcattttttataggcaagcttgtagatctactagttaaaactgttttttggtttaatttgtttgctcaagatcatacaagttagtggtcttggtacatggtagggagaaggcacaagaggtaatatgtcaaagaactgaggcatggcatatatatgaaaagagttagaaatgaaatcaaggtgatatgttagaatagctttataaccttatacaggtaatgtactttttcttggtctcattttcttcaggtataaaatgagggtgttagatcatggtgctaatatctcttatctcttctaaaagttaatggttctaaactacttttcctttaaagttggaaatatcttgattgatcatggctgacaaataaaaagtaaaaataaaaatatttttgtgctgattgggaaatgactatataaaatggctattcttgtatgtaaattaagtatttttcttaagtaaattaagtattcttgtatgtaaattaagtatattaagatgaaatgtgtccaccaccattaacatttttatgaatagcccttcagatctcatataccattttaaatttcatgtacagttatatcttagatctctttctgtgtcaataaacatagctctacatttttcctttaaatggctacataaaattctgctgtttccttgataaatgtattatttaccagcctgccaactaatggatgtatagattgtttcctcttttttactgttaaaaattgcaacaggtaacattcttgcacatattttctcccctcaatatttttatggttatttccttaagattaatttcctagaagtagcattgtcagacatttgcattttgatacatattgccagatatctctttaaaaaggttacacagatttatactcttacacctataaattaaatattgacttaataataccttcatgtatagtctgtggacacacttccccaattacttcacaaaaatgtctcctatttttttttttttaatacaggatttaatcagggtctacacattgcctttgagtgtcacatctctgtagtcagtattactcttttaacagcttaattgaggaaaaattgatagcaataaactgcttatatataaagtttataatattgataacttttgacatatgtttatgtctgtgaaactatcatagcatttaagataataaacatgcccatcacccccaaaagctttcagtgtaattcttctctcctctactccccgctaccctcttgcactaatctctaggttagtttgcactttctgaaatgttatataagcacaattatacattatgtactctttaagaaagtctggctttaactcagcataaatagtttgggattcgtccatgttgtatgtattaaaagttaataactttttgttgataaatagtagtctgttgtgtggataccatgatttgttaatacatttgcctgttaatggacattttggttgggttattacagacaaaattaaggtttttaatattaactcatcaagtattggtcgattaaagagaagataaattttgaagaggcaaggggatgaaataactactaaggaccaaaaaatcttgctctgttgcctgagctctagagagggggcatttggaaacaagacaagcaaaatacccaaagaattttaatttaagctagtagcatatacagcatgtacattctctctcctccaagctgataatacaacttaggtgtaatctcctagaattttttcctgacctcacagttctgggtatcctctctttactgctgtttatgtgttgataagtcttccctatcttttgaatccagtggtttactggtcattgatcatatgactgacctttgagaggcatggaaggaaaccagctgttgactggatgagtaaattaaattcaaccagtgtttaataaactgtggatgattgccgggagaccttaacacttgggaagttggtacttaaatgcctgcttgtttacatgtcagacacctcagctagactgacagctcttgagagtgcatgttctatgtcatttatttttgtatccctttgtttggtatataataatttttcttaattgtttgcttaataaattaatgcagttaaaaataacattgacatatgattaggagatttatgtgtacacagctgttaattttgaatgttctgtatgttatagtcaatctgtaaagcagttaggaatttagaacacactttgccgtagaaacaatttaaagtgttagacaattcctctttattgtaggtggaatgaaggctaaaaggaggttatgggagccagcagtttataggtctttggttaatggatgacctttgaaaagaggcatagaaaccacatactggctgaaaaattaaattcaacaagtatttattggtttgtgaatatacaggaaagagaattttaaaatttcccctgaagattaaaaaccttcaggggaattttcagtaatagagagtcaaaatgtggtaaatgctataacaaaaatgttatcaaagccctggggtagtgcatactacctcagtgagggagctttagggagatttaggaagacttccctggggaggtggaatttgacttgaaccttgaagataaggggtagacttttgattgctagaggagagaatctgtgatcacaggagaagcctcagccctattactctggctgcaacaatatttcttttcagttgtcacagcttgggaactaaagaaaggaaaagagattcgcatgttctttggcctagtcacccattcacccctgtgtatagctgtatagtcccaagtcaaatacacgtaaataatggtcacttaaagttagtatgttacaagttttcattccaagtgtcagttgtaagttttacaggtttaacaactgattaatttgttaataaacattttttgagtgcctaatctgtacaagacacttttagaaactatccatacaataatgaatagggcaaaggttctgccttaaacactttagagtctagtaattctgtttgtcattgatcagaataataaagcaacatttctctggttgacctgactcccattatcctttggctgccaatagtaaccctttctttctaaaacccatggggtgagaagggacatgtctggccctcttcctcatctctgtttccagagagatcagtgttgtgagtgcttgtggaaagtggggtcattttcaacttcctcctctttctagggacaatcactctgtgcttttcttatgcccacttaccctcccaaaacagaaattagacatggggattgggaagacatgagaattggtacccgggagaaacggcctcccatccactggaattaggaggaagaacatttggagttctttcctgtctccaaacttttcatttcttctcaaaagaaaaaaaaaaaagcctatcctttcttctactctccatcagtgaatccttgttgatgtaggcaactttgggaataaatgacgattttcatggacaaggcccccacctcatgatactctggatactaacaaaaataatttttatgcataataatattattctatagaagtcattctattttaaattcaattaatgcagatttttaaaaattggctttggtgattcatggcatattattggagggattaccatccagttttgactattagagggtcatctcatagccaaggccttggatgtttgcagttaagtttctgagctgctagtcacataaggctgaggggtaccctgctggaggtagtgagggtgcaaaaagtgagtattttatgcctagttctgttgacagagaatctgaactgtaaatattcctccttgaaagagtggatgattgagagttaactagagctatttcctgcttgagttagagtcacaatatatgtactatttatatttgtgtcttgaacaacaaaacaaaagcaagaggctggcagaggaactggaagaaaggcaatagatctaaagctgatctttgttttaaataggccgaatattctacacccatgactcattgtttgtgaaagaatatgctgtttggccttttcaggggaactacagtgcatcctatgatttagcatctcaatgagggcttattcattagttgaacaaaggctttttctagaaatgaggattatattgttagtaattttagagggaaaatgtcattgtccatttttatagttaatgtggtgtccaaggaaaacagcatcttttagaaattttgaaagtatatgggaaaaattgcatgcttgaccctttctattgggagagttttgtgctgacagaatttgaagcatatataaatactgttttgttgctttggaaatatttggaaattttttttaccctaagtttcaagctttcaaaaggaatttatatttttaattcgtgatatataaaattcagtttgcgaagaaataaaacactaattcttttaaaatcccaatgttttaagtaacaatgtactaaataaatgtttttttttgttcccctatacattaataaccaatggtaagtgagttttagggttttgacgaaagattttaaaggtcacagaacagttgtaattttttccccattgattattaagatcattttgcatagtttcagcttgcatggtcagttttatgactggcacttactggtgtggcaaagcaaggactgcctggtgttaactaggtgaatgaaattgagaatagactctggaaattcagttgctagctggcattaaggaactgcttgaggttatagatcatgacttttgaatgagactggaattactagtttttctttagcctcattcagcttcaggaggagcttctctctttcatagttacacttctgaagtaagtaagacaccactgcattcaccatcaactcccttcaggggcgttggggtggagcacaagggagttgatggtgaatgcagtggtgtaattataataataattgactgtgggatttaaactgaataaggaagagaaagaatatctggtgatagacaataaggtggtagcattggtggattaaagggtctcactgatgttaaagggttgatggaacctagagggaatgtgctgaaaagataagtggtggaaagaaagtagaatactagaagttgagattatgaagtgctttcagttatcaatagtgacaagttcagaagagtaactatggaaatgagaaactgaggtaggaaaaaatcattggagaaaagaactgagtgtagtggaaggatcatcgtcatgaatgatgaatgatgatgaatgaatgatgaatgatgtcatcagtcatgatgatgaggtggtgtcagagagactgacagtaagtcaggatctaaaaataaggaaataagggcagtaatgacttgggtgacaacaaatgcctgtaataagttggggtagtcagtgatacagtcacgtaactgtaaaactgagctactatgagaatagtcttaatggtcctaagggagaaagtggtagatagttgtgttttgtgaaatgaggggtggggagtatcttcccaagagtaggaagagttttggggttctcttttatatttgctagagtcctcctgatggagctcaggaatactgcagaaggattctcttgacccctgccagatgatggtccagaaacatagatattctcttggtgacagccgaatgcaatatattggtgatagggtcagaataatgagtggttattgcccttttttagaattcacaaatcatctatatgacaaaaagctaaagaccagtggtttttattgagggagagcttaggaacctgctaggttttagcattaaaatgcctagcataatgccttttccataggtgcttaataagcatttatggttttcattagttaagacagttaaatttttacttgtaattctcatttataattggttatacctaaatgtgtgatagtaatgacgtttcttctttgtattttagactatccccataaatacggtcctcaggggggctgtgcagatcattcagtatttgaaagaatgaggaaataccagatgactggtgtagaggaagtaacacaggtaaggattttaacactagcttgcatttaggaaatggaaatgaatttgaggatgtatatctacatttaaaatatatgttctaggatttctgaaagacttaacaccactgtggggaatgttttttaatgctcaaagaggccaggtaacgtgccaataataaagagataggactgaggtttgaatacaaatatatgtgacccaaaagacattacaagtctaaaatatactatcctttacatgttttgttataaaagaaaacaaatgttttatataaatgtaaatatttttattagcattaaaattagagtgaccacttgccttggtttgccaaggtattcctcatttttaacactgaacgttgtgtgtcagcagacaatctggttggtcatgttaataaaaatctcaggacttttcgtattttaattatttttttcccttcctttttctttagtcataggtgacaggttatagttattcaaaacataagttcaaaatgagaaaacattttttcttttatgataaaacatttatcatatattttggacatcctttctaaaagtagtatggtagagttatgtttcttgagccatgaatatttgtattcagatctattctttgatctgtaaaatggcataaacaattctgtttcaggtgggtctttctagtgttaagtgagattttattcttatatgtattgaagaagtacatattgatcttctgccatatgtcagagactgtggaaagttctgggaatatgtggagattaagatgaaggctattctcaaaaggttatcgtttaattggagacacagagaaacaatttagagtagtaggagagggttaagtataggatgatattctacacacaagaggaatagctaatctagccttataagtatttgaaggcaataatcagaccttaagaataagtaggagttaggttagccatgaggatatggaaagactattccaagcaggaggaacagtacatacaaaggccaaggagacagaaagatcagtaaagaatttttaacatgagggtagagtttaagagtagattttaggagactaatgagaagttgttgtagttattcagttgagaagtgatagtggcctgtactaatgtattggcaatttggatagaggggttgagattatagactgttagatatgatagaatttagcatggtgcttgataaaatattaatatacaaaagtaggttgcatttatttataccacgagtagactaccagaaatataatgaaagggtggacattgttaataatgtcagagaatattatatattatagaataaatgtaacaaagaattataagacctatgtaaggaaaatcaaaactttataaaaatattaaggaagattgattttaaatgaatggagagatataccatattaatgggaaataataatattataaaattatcagttctccctttattgatttgtagattcaatggtagtccaatacacattacaacaggcttattcacaacactcaatgggtcaaaaatgttatatggaaaagtaaggactaagaagaagtagggcccatttaaagacgatgaacaggaaagagggaaagagggatttaccctaggaggtattaagacttgctataataattgagagtgtgatagcacaaggatggacaaattaactagcggaataaaaatgagtgcttagaaaaagacccatgcgtatatgaaactttgttatgtggtagagatgcaatctcaaattagtaaggaaaagtgaggaccattgaataaatggatccagaaaaaaatgtttatctatttgaaaaaagatgaagttggatcaccatcctacaacaataaagtccaggctgtaaatgaagtccatatttacaacaaaaaagtctagatggattgaagttttaaatgtctaaaatgaaaactttgaaacttgtagatttccctttcaagctgtgatagagtaactgatatctaactaggctttctacaacaaacaactagaaaaccaaacaaaatatttcaaacaattattttcaaacattagaaaacaagcattgcaggattgatatctgagtgaggaaataaatatctctgtgatttccctgccttcttggctggagtcgaaatttcagatatgacacacagaaggagatctcaagaaggataaaaacacagcagtgttgctgagttgaagagttagaattaagagttcaggaagactgaggtgtctggacttacgggcacaatacctgagaggagagagctgtgttgagaaaaagctccagatatctgcacaggtgttgctttccttgagtcttagctgaatactaagctgtgcctgcctgcacgggatgaaattctttgagaaaaccatgagacaaagaaaaactacctggactctgtgaaatgaacaactgtcaaaaacaatacttgggccaggtgtggtggttcatgcctgtgaatcccagcactttagaaggctgaggcagcaggaccacttgaggccaggagtgcgagaccagcctgggcaaactagccagatctcatctccataatagtaataattattattatttttaattagctgggtgtggtgatgagcatctgtagtctcagctactctggaggctgagacgagaggatttcttgagcccaggtggttgaggctgctgtgatccatgattgtgccatggcaccccagcccgggcagcagcgcgagaccctgtctctaaaaaaattacacttattagatatcccaagccgtggtagtagcagggctaacctagccctagagtagaagctacttcagacctgcccttcctaagcagaaaaacaaacctcaaaaatgtcaaactgcttttcaaataaattagctgtctgtcagagaaaagctcaataatatttgttaaaggaggacactaagtccagttactcagcagtataacattcagtgttcagcattcaaagaacattactagatgacaagaaactgaaaaacgtgattcataataaggagaaaagccacctaaatagaaacacaacgtctgttaattacagatgttaacaggcaaggactttaaaacaactattattagtatgttcaaagaattaaagacatgaacacaaaaaggagagaatggaaattctaataaagaaccaaatggaacttctagggtgaaaaatatattatctgaggtaaaaaatttagtggataggcttaaaagaaaattaattactgcagaactcaatatgaatatacttgagtaaaggaaaataaaatagacagtatccatatctaagcacagagggaaaataattgacgtccagcaggaagagatgcagaaaaaaatatttaaaaattaatgcctccgaatttttagatactaggaaaaatttcaattcatggtccaagaaactcaatgaaacacgtgcaggataaacacaaagaaaaccataccagggtatgttacaattaaattattggaaacacctgaaaatcataaaaaaccataaaagcaggcagagaaaaggagatacatttacatacaggggaacaaagataagtataactggtgacttctcattacacagtacaaactggaagacatagaataacatcttcaaagtgttgacagaaaacctgccaaactaggattctatattcagtgaaaataattttcaaaaacaaggcaaattaaagatctttttaaataaaaattgagagaatttgtgtctaggtgacctacactgtaagaaacattaaaggaagttcttcaggcagaaaaagataccagatggaaactcggatacacacagaagagtgaagaacataaaatagtaactatatagataaatattaagcagttttttctcatttaaaaaaaccttcaagagattattacctaagtccaaataataaggtataatggattttgtaatatacagagaatcaaaatttatgacagtagtgcaaaggacaagagaaagaagaatagaagtatgtttcttaaacaatttgtgaagtgatgtaattttgacaggtaaactgtgccgtgataaagatggatattgtaaaccgtagagccggggtcagcaaactacggcctgtgggccagatgtttgcttttgtaagtaaagttttattagaacacagccacacctattcattgataggttgtctatggctgcttttacattatagtggcagaattgaagagttgtgatagagaacaactacatgttgttcaaaagtgtaaatgtttactattaggccttttcagaaaaagtttgcaggaatttcctctgcccttggagcaaccattgaaaaaagaagaggaaataatttaacatgttaataaaataaatcaaatgtatttaaaaacagttaagagaagttaggaagaagagaaaaaggaacaaaaaactgatgggataaatagaaaataaatagcaaggtggtaagtttaaatctaaccatattgatgactgcattaaatataaatggactgctgaggtgtgaagattgcttgaggccaagagttcaagaccaacctggccaacacagcgagaccctgtctcaattttttttaattaaaaaaatataaatggactaagcacgttaattaagaaactgagatggttagagtgattaaaaaaaaaagaccaaatgagcgtaaaagaaatgcaatttaaatgaaaagacacagttttaacatttaaagagctaggtgagatggttcactcttgtaggcccagcttgtcaggatgctgaagtaggaggattacttgaatgtagaaggttgagactgcagtgagccatgattgattgcaccagtgtactccagcccaggctgcagagtgagaccctatttaaaaaaaaataaaaagaaaaaaaagaaaagaaaatagctaattgttttggatttgggtcataaaatgatggaacagaaattgggtttagttaattatgctatgaattaatttatggatccatattctcagagtttatccttaaagacagtcttaaagtccttaagaaaataaagagagaacggccaggcgtattggctcacacctgtaatcccagcactttgggaggccgaggcaggcggatcacaagatcaggagatcgagaccttcctaacacagtgaaaccctgtctctactaaaaatccacaaccaaagttagctgggtgtggtggcggacgcctgtagtcccagctactggggaggctgaggcgggagaatggcatgaatccaggaggcggagcttgcagtgagccgagattgcaccactgcactccagcctgggcgacagagtgagactctgtctcaaaaaaagaaagagaaaacttcataacacattttatgagggcagtgttactttgatagtcataccagagacattacaagaaaactaagctacagggcaatattcctcagaaatataaaagtaaaatttcttaaaatattagcaagtgaaatccagcaatatatataaaaaaacacattatgctcaaatgaagtttataccagaaatgcaaaattgattaacattagaaaatttgtgtaatccaccacataaacataataaaggatgaaacccctctgattatctcagtagactagtaaaaaagcattgccaaatttcagcactcaacacatggcaaactaaaaatagaaggaagctttcttaggctagtaagagctttttataaaaaacctacagctgataccatgcttaaaagtgagagactaagtccttttcctttgagaccaggaataaaagctttttttttttcttttttgagacggattctcgctctgtctcccaggctggagtgcagtggtgtgatctcggcccactgcaacctccacctcccgggttcaagtgattctcctgcctcagcttcctgagtagctgggattacaggtgcgcaccaccacgcccacctaatttttgtatttttagtaaagatggggtttcaccatgttggtcaggctggtcttgaacttttgaactcatgatctgcctgcttcggcttcccaaagtgccgagattacaggtgtgagcccactgcgcccagccaaggaataaaaacttctactcagcattatacacaaagtcctagccaccataataaggcaagaaaaataaatgaaaggcatacagattataaaggaagtagttaaaggtaatacaagagtatacctagaaaaagttactagaatcaataagcagacttatcaaggacataggctaaaagttggtataatcagtcgtattctatatactggcaatgaatatttagaaaatgaaaaaaattaaaatagcatcaaaatataaaatatgtagaataaatttaacaaaatatgtgcaagatgtgtacatgaagaactagaaaacattgccaagaaaaattaaagattaaataaattgagaaataaactttgtttgtggttggaatcctcaatgttaatatgtcagttctccccaaattgttctgcagattcagtgcagtcagtatcaagacttccagtggacatttatctagtagttgacaaactgattctaaaagttatactgaaaggtaaaagatctagaatagacaaaacaattttcaaaaaagaacaaggatggaagatttaatagtatttggtttttaagacttagtataaagttacagtaatcaagatagtgtcatcttgacctaagggtaaacatgtaggtaaatgtagcaacatagagagtccacatggtcagttgatttttgcaaaagtcccaaggtaatttaaaagaggaaagaacagtcttttcaacaaatggtactggaacaattggatatccatatgaaaaaaaaattgagattcacctgtacttcacaccttatacaaaaattaactcaaaatggaaaatggacctatatgccaaagctaaaactaaaactaggaaaaaacataggagaaatttttgtgacttgtgataacaatttctcaaggcacaaaaattccctatgaaaaacatgtataaactgacttcatcaaattgaaaaaccttgcctcaaaaaacatagttaagaaaaataggaaaacaagccacagactgagaaaatgtccacaatgtctctgataaaaggcttttttccagaatagtaaagaactgttataactcagttaagaaaaaaaaaaaaacacaaaccccaattaaaaaatggacagtgcacctggaaagcctttccaagaaggacaggcacaaataagcccagactgtgaggactacagtgaatacgtaactcttcaatgcccagacgtgaaccaacatccacaagcgtccagaccatccaggaaaacatgacttcaccaaagaaactaaataaggcactggggacaaatcctggagaatggatccagagataggtgacctttcagatagagaattaaaaatagctgttttgaggaaactcaaagaaattcatgataacacagagaaggaattcggaatactatcagataaatttaaaaaacattgaaataattaaaaagaatcaagcagaaattctagagttgaaaaatgcacttgacatactgaagagtgcatcagagtctcttagtaacagaattgataaaacagaagaattagtgagcttgaagacaggctatttgaaaatgtaaagtcagaggagacagaaaaggaatactctaaaagaatgaagaacacctataatatctaggaaatagcctcaaaagggcaaacataagaattatgtccttaaagaggaggtagagaaagagataggggtaaaaagtttattcaaagtgataataccagagaacttctcaaacctagaaaaagatatcaacattcaagtgtaagaaggttatgaagcaccaagcgtatttaacccaatgaagactaactcaaggcatttaataatcaaaccagcaaaggccataaagaaaagatcctaaaagcagcaagaaaaaagaaacaaataacctacaatggagctctgataaatttggcagaagacttttcaatagaaattttacaggccaggagagagtggcatgacatgtttaaagtgctgaaggaaaaaattttttatcctatagcagtatattcagggaaatagccttcaaacacgaaggagaaataaaaactttcccagagaaacaaaaacagatggatttcatcaacaccagacttgtcctacaagaagtgctaaatagagttcttcagtcagaaagaaaaggatgtgaatgagcaataagaaattatatgatggtacaaaactcattggtaataataagtacacagaatattgtgtatctgtgattatggtatataaattactcatatcttgagtagaaagactaaatgatgaactgataaaaaataactcttcaggatatagacactacaataaggcatgaatagaaacaaagttaaaaagcagggggacaaagttaaagtgtaaagtttttattagtcttctttttgcttctataattatgcaatcactgttgtcatcagtttaaaataaggattgtaaggtagtatttgcaagcctcatggtaacttcaaatcaaaaaacatatgatagatacacaaaaaataaaaagcaagaaattaaatcataccaccggagaaaatcagcttcactagagggaagtcaggaaggaaagaaggaagagaaggccgcaaaacaaccagaaaacaaaaaaacaaagtggcaggagtaagtccttacttatcagtaataacattgaatgtcagtggaccaaagtctctaatcaaaagacatagagtagctaaatggattaaaaaaccccgaagatccaatgatctattgcatacaagaaacacattttacctgtaaagatacacatagactgaaaataaaatggtggaaaaagatattccatcccagcggaaaccagaagagcaggagtagctatacttgtatcagtcaaaatagatttcaggacaaaaactgtaagagacaaagatagtcactatataattataaagggggctgggcctggcagctcacgcctgtaatctcagcagtttgggaggctgaggtgggtggatcacctgaggccaggagtttaagaccagcctggccaacatggcgaaatcctgtctctattaaaaatagaaaaattagctgggtgtggtggtgggcatctgtaatcccagctactcaggaggctgaggcaggagaatcacttgaacccaggaggtggaggttgcagtgagctgagatccggccactgcactccagtctgggtgaccaaaccaagactctgttttcaaaaaaaaaaaaaaaaaaaaaggaatatatatatatatatatatatatatatactatatatatatatactatatataatatatatatgtatgtatggtatgtatgtaggtatgcaaagggttctgttcagcaaggaggattaaacagctgtaaatatatattaaaaatggttggatatttgtctcaggcccaaactttttggtgaattgtaatcctcagtgctggaggtggaactgggggggagttgtttggatcatgggggcagatccccccatggctgggtgctgtttttgtgatagtgagttctcatgagattgggtggtttagaagtgtgtggcatcttcccccacagacattcttgcttggctcctgcttccaggcatgtcatgtgcctgctcccccttcactttctgcccatgcttataagcttcctgagacctctctagaagccaagcggatgccagcaccatgcttcctgtaaagcctgcagaacgatgagccaattaaaactcttttcttgataaattactcagtctcagttatttctttataacaacgcaaaaatggcctaatacgtatatgcacccaacactggaacacccagatatataaagcaaatattattagagctaaagagagagagatagacttcaatacagtaatagctggagacttcaataccccactttcagcaatggatagaccttccagacagaaaatcaacaaagaaacatcagacttaatctgcagtatagaacaaatggacctaacaggtatttatagaccatttcttccaatggctgcagaatacacatttttttctcctcagcacctggatcattctcaagaatagaccatatgtttggttgtaaaacaagtcttcaaacattcaaaaaattgaaataatatcaggtatcttctctgactacacttgaataaaactagaaatcaataacaaaaggagtctttgaaactatacaatcacatggaaagtaaacaatatgctcctgaatgaccgataggtgagtgaaaaaattaaaaagaaaattggaaaatttcttgaaacaaacgataatggaaacacaacttactggctaggagtggtggctcatgtctgtaattccagcactttaggaagctgatgtggaatgatcatttgagcccaggagtttgagaccagcctggggtctatagtaagaccttttctttgcaaacagtttaaaaattagccaggtgtggtggtgcatgcctgtagtcccaggtccttgggaggctgaggcaggaggattgcttgaacccaggaggaggaggttgtggtgagaaagattgtgccactttactgcagcctgggcaacagaaggagacgctgtctcaaaaacaaagaaaacacaacataacacaacgcgtaggatacagtaaaagcagtactaagaggaaagtttatatagctataaatgcctgcatccagaaagaaaacttcaaataaatgcactaacaatgcattttgcaagagcaaaccaaacccgaaattagtagaagaaaagaaataataataaagataagagcagaagtaaatgaaatagaaatgaagacagtataaaagatcaaagaaacaaaaagttgttttttgaaatcgtaaacaaaattgacaaacctttagccagactaagaaaaaaaaaagacctaaataaataaaatcagagatgaaaaaggagacatcacaagtggtatagatgaaattcaaaggatcattagtgggtactttgagcaactatatgccaataaattgcaaaatgtagagaaaatggatacattcttagacacatacaacctaccaagattgaaccatgatgttcaaaacctgaacagaccaataacaagtaatgaaattgaagctgtaataaaaagtcttccagtaaagaaaagtctgggacccagtggcttcactgttgaattctaccaaatatttacaatataactaataccaattgtactgaaactattccaaaaaatagaggaggagggaaaacttcaaactcattctaggaggccagtattactctgataccaaaagcagataaaggcagcaaaaaaagaaaatgacaggccattatgtctcatgcatattggtagaaaaattatcaacaaaatactagcaaactgaatttagcaattcattaaaaagatcattcatcatgactaagtggtatttatcccagggatgcaagaatggttcaacgtatgcaaatcagtcagtgtgatacatcataatggaatgaaggacaaaacttatacgataatttcaattgatgctgaaaaagcagttgataaaattcaaaatcctttcctgataaaaatgctcaaaaaattgcgtatagaaggtacgtatctcaacataataaaagtaatgtacagtgaatccatagctagtatcatactgaatgggcaaaacctgaaagccttttttctaagattgggaacacaagaaggatgccttctttcagcactgttactcaacatagtactggaggtcctagctagagcaatcagagaagtgagagaaataaagtgcacccaaattggaaacaaagaagtcaaaatatccttgtttgcagatgatataatcttatatttggaaaaacccatagactccaccaaaaaactattagaactgataaacaaatacagtaaagttgcaggatacaaaatcaacgtacaaaaatcagtagcatttctactgttgtttccagcaacaaacagtctgaaaaagagaagcaatcccatttgcagtagccacaaataaaattacatacctaggaattaaccaaagaagtaaaagatctctacaatgaaaagtataaaacactgtgaaagaaatcgaagaagacagaaaaaaatggaaagatattctatgttcgtatatcggaagaatcagtgttgttaaaatgtccatattacaaaaggcaatgcaattgctaccaaaatgccattgtcattcttcacagaaatagaaaaagccatttgaaatgttttatggaaccagaagaaactcagaataaccaatgctatcctgaggaaaaagaacaaaattggaggaatcatattacctgacttcagattatactgtagcgctatagtaaccaaacaacatggtactggcatgaaaacagacacgtagacccatggaacagaatagagacctcagaaacaaattgatacacctacagtgcattttttacaatggtgccaaaaacatccattggggtaaagacaatctcttcaataaatggtgctgggacaactggatatccgtatgcagaggaatgaaactagacctctatttctcaccgtatacaaaaatcaaatcaaaatgaattaagacttaaatttaagtgctccactgtgagactgctgcaagaaaacgttgaagaaactccccactttcatgtggacaaaaatttcttgagtaaaaccccataagcacaggcaaccaaagcaaaaatggacaaatgggatcacatcaagttaaaagctgcggctcagcaaaggatacgattaacaaagtggggagacaacccatagaatgggagaaaatatttgcacactacttgtctgacaagggattaataaccagaatatataaggagctgaaataactctatagaaaaaaatctaatctgattaaaaaatgggcaaaagatctgaatagacatttcctaaaagaagacatacaaatggcaaacaggcatatgaaaaggtgctcaacatcattgatccttggagaaatgcaaataaaaattacagtgagataccgtctcaccccagtaaaaatggcttttatccaaaagacaggcaataacaaacgctggtgaggatgtggggaaaaggaaaccgccacacactgttggtgggaatgcaaattagtacaattgctatggagaatagttcggaggttcctcaaaaaactacaaatagaactaccataatccagcagtcccactgctgcacatctacccgaagagatacatcatagagatagctgcactcccatgtttgttgctgcactgttcacaatagccaagatttggaagcagcctaagtgtctgttaatagatgaatggataaagaaaatgtggtacatattcacaatggaatactatttagccataaaacagaattagattctgtaatttgcgacaacatggatggaactggaggtcattatgttaagtgcaataagctaggcacagaaagacaaacttcacatattctcacttatttgtaggagctaaaaattaaaacaatttaactcatggagatagagagtagaaggatggttaccagagggtgcaatgagtattagagcagtggtgggggaagtggggatggttaacgggcacaaaaacatgttagaaagaatgaataagacctagtatttgaaagcacagcagggcaactatagtcaataataattaaattgtacattttaaaataactaaaagagtgtaattgtattttttgtaacaaaaaggataaatgcttgaggggatggatgccccatttaacatgatgtgatttacacattgcattcctatcaaagtattatatatcttatgtaccccataaatatatatacctatgtattcacaaaatttaaaaacaaaaaataaaaaaatttaatagataatgggcaaaacatttgaaaagacacttcacaaaagatattataaaatattttggattttgatctggagaaatggtttgaatatgtaagacttttcagtataaaaaagatgaatatatttcactatatgaatattaaaaataaaagacaccttaaagtgaagacaagttataaactttgtataaaattttatgctttcacaatgtataaaattaataaagaattgtttttaagaagtagagaacaactgattagtacaactaatatatagcaacctggcctgaaaataaaaatattttaaaaatatatgtgtatgtatatttccatatacgtgttttgtatatttgtgtgtatttatttgaaggcattggaaagataacatgactgtgaagtagtacgcggccaagatttcagaaaaaagtatacagctagaatggtgatactggtatttggttctaccttttctccaggtgtgtctttgagtttctgaggaggtggctgagagactgagagggagagtagaactgtgcagacacatgaggctgaggatgaaaatattgtttaggatctgcccagaagagcttttggttgggaccttgaaggactactccctaagaataagggtataaattataaaatgttcagtctctcttcacagggattaaagtttcacaccacatctcagtccctaactggattaaggtgatccaggattactagtgcaccaagcctaactctgcttaccagaagtgaaagtaaatcttttgagaaaggtgtcaatcacaacttcacatcaaatctgtggttatccatatacatagcctggcactcagttcaatgtaaccagtatatgaacaaacaaaacaacatgatggaagaacaagagagtcaactgacaaaggaaatggtacctggataagaaaattatctgacacagactttaatatattcaagtcataaagactaaatttaaaattttagcagaaaattgaaaattaacaaaagaacttgatgggaaatttagaattgacaaatgttaacaacaaaaattaggaatttgatggatttagatttggatagtataagaaaatagagcaaactgctaagaaaaggatggaaaatacagaaaagagcataagagaaatagatgataccttcagaaggtctgatatatgtattatgtaattgatgtcctagaaggaggaaaatggagagtcaaggacaggtaatggctgagaatttttccaatgtaacagagagatatcaaacaacacattcattaagccctgtaattagggcaggataaatgctttacactgaaaacaataccatagcacattatttgagaagtccgaaagccaaagatataatcttaaaagcagccggtgagaaaaagtttaatcactcttaagcaacagtaaacatggcagctcatttctcattggaagcagttaaaaagacagaagacagtaggatatgctgaaacagagaaactgccatcctctaggatgctctactcagaagaatagatcaaagtaaaattaacacatttcaaatggaatatataaccatctgacacgctaaaagtagtttttttcctgttgaaaagattgcgggctcaaatgctaacttgtagatgaagtattgaataaagaacacattagataattttgagtattgactgtatactacaaagcactaatagtaaagacttgtagggtggtatatatttgtatgttgtgtatgtggatatagagggagttaaaattggagtgagaaaaatgtaatttaagtgttctgaggttcttttctaggaacaagtaaatgttataatttatatttgattttggtaagtcaagtattagtaaaatatataactaacaagctaatgggggaagggatagaataaaaattcaaaatccaaaacaaggcaagaaagaagttaaagaagactattgaacaggcaggacaaatagaagataataaaattggagatttaaaccccaaaatatctgtaattatattaaaggtaaatggattaaatgcaccgattaaaagataaatattatcagattggatttaacagcaacaaaaccccacaaactgttttacaaaaactgctcctaaaatataaggatgcagaaaagatggaaagtaaaacagcacaagatgtaaactttgatgactctaacaaaaatatgtctattatcagccaaagtagattttaaggcaaaaaaaaagcattactaaaatagatatgtcataatgataaaaagtttagttctccattatgttatagcagcctttaatttgtatgtccgtaatattataacttcagaatatgtaaggcaaaagttgacaaaaccggaaggaataatagaaaaatcatatgataaataagagaacagttgtacaaaaaataaaacccagtgaagatatgggagagctgaactacttgatataataaacttgaacacctttatgttatttttttctgcttggaacactttttcatatttcagactgttttcttatttaaaacctttctttaaatagaattttcacattaaagcatccagttttttttcctttggtctggagtagaaaatctttcacacataaaacttcaccattagctaagataaattcctttttgtgtggaataacatgattgtaaatataaactgcatttcacaaataacatggatttgaaatacttctcaatgtttgagtcatttacaaactgtgtaaactgagacctggagaccatctaaatcaaaatcctgagtggaacagtattcaaggtaggctttggggacagttcccccaaatgttacactgtttcagtagtgttggtacccatctataatacaaattgttttaaaaataagttttattgtgtatatatcaggtatattacatgatgttatgggacacatatagatagtcaaaatggttactatagtgaagcaaataaacatttccatcatttcacatagttacccttttttgtgtgtttggcatataatacaaatttttcattttgtgtatgttcacatggaattattaagggagaaggaaatgtcaaggaagaagaaattgtgacttaaaattcaatttgggttctatattactgtgccatcaaaaatacttaagatgatccttttaggtgttcacaaatgtttgactggattcaatagcagtggtaattctttgaagaaatacttaattgaggccaggcacagtggctcctgcctgtaatcccagtacttcgggaagctgagacaggaggattacttgagaccaggagctcatgaccagcctgggcaacataggaagacctccgtctctacaaaaaaattaaaaaattagccaggcatggtgatacatgcttgtagtcccccagctacttgggaagcttaggcgggaggattgtttgagcccaggagtttaaggctgcattgagctgtgatcatgccactgcactccagcctgggtaacagagtgagactctcaaaagaaatacttggcgggggtggtggctctgtaatcctagcactttgggaggccgaggcgggcggatcacgaggtcaggagatcgagaccatcttggctaacatggtgaaaacctgtctctactaaaaattcagaaacaaaattagccaggtgtggtggcaggcgccggtagtcccagctatgccggaggctgaggcaggagaatggcgtgaacccgggaggcggagcttgctgggagccaagatcgtgccactgcactccatcctgggcaacagagtgagactctgtctcaaaaaaaaaaaaaaaaaaaaaaaaaaaaaatacttagtgtctactctttgctgccaagcctgtgttaggtgatagcattacagtgaggatcaaacagagataatttcttctttccagaacttacattctagtgggtgaagtgggatgtggacagaaattaaataatcccacaaataaatgtaaggttgcactatgtaagagacattggtgtatgattctatggagtggtataatggatgaattgaccttctcgaagtctaaggaaagaaggaagccattaacaagatcagaagaggtagtgtcagcatgtgcaaagactggcaggagatagactgtgtgtggaggattggaaagaaagcttatatagctgtaccacagacagctagagttggctaatgtagggtctctttgtgaagtaatgtggaatgagaaaagctggatagttaagtagaggctgtgtaatgttgatatttaggggagcatataaagaatattgggcttaatcttttagagcaataggaagtcattgaaatacattattgaggtggatgacatattcaaatttgcgttttgaaaacattgcaatatggagaagagatgtaaggccattagtggctattggttgattaaactgatcttactgcagtactctaggtaacaagtaatggtagcttgggctagagtggtggagccagagataatgggtagataccttaggtatttaggagataaatttgacagaactggatggtagatgggtattagatgtgaggtagagaagatatcaaagtagtataagctattatacaacttgctttagatttaaatgaatacatattaaaatacatgttttgaaaatgtttaaaagtgaaggagttccttgaatagatagtaaataatctatatggagaagattatgagacaaagtgattttatgaacttttaatggcagcagaaatacctatggtgttatataaagcagaatatgaaattgtttatagtatgtattcttaattagataaaatgatagtattgaagcatactaattgtcagaaatgactttttgatgtatagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccaggtatttatgattatgcgctattttagtagttcccatattgttttataatgcctattctttcctttaaaaatttaagttagtgtattctctttttgggaaaaagtatgtgttttcagttgtgatgtgataaaatgtgtaagataagtacatggataactgaaagaccagttgggatattttagtgtcaaaagagaggggtaagacaatgatttcctgaaggagatgatgacactgaagtttagctttggaaagagagttgaattttcatttgtggtcttaaaggagggaaagttggaggaatccttccaactggaagtatttaattttttttctgtatttttattgtatgtagcactttctaagttacattattatttgtacttgtgtcttctcaaccctcattaaagtataaatattttgagggtgcccttcaaaatgtccttcgtgtggaaggtacccagtgagaatttgatgaatgaacttttgactcaaaggatttgaaatggagaagatggaggtacgactagtataaatgaatcattttggtggtgaggatgaacttccttttaaacatgtataaaagctaggtagttcttcccttaggattttgaaaatgtgaaactagagcttgagggaagggtagccttgagagattgaatgtggaaagaatgaaaccaaaggagaagaaattggagctatctgtatatggtgaataggttgaggaagagaagctagtgaggaaaacataatagtaataaggtaggagattttgtaggatttaccaaggaacaaataaatttcaagacaaaatagcgtgaattttataatgagccctatgagcagttaggaatttcattagcagtgtttggcagcgtgggctacctttgaaatgattattgttaatgcttttacttgaccatcttgttttatgttttatgtttatgtttttacaatttctttgaaaataactttgagactatacatacatgttttcacataaatggtagcaagagtactttttgtaaatgaagttgggaaggttgtttacagagtggtttagaagtcagaaagtttagttgggggtcagctaggtaaacggatacttttgggtttatcatcgtttatctccttgtagaatttagcaaaatctgaatgtatgtttattatatttgtattatctccctcctttcttccgctactaaagtaagcctctgtaaatttatagggaccttctgtattttgttcaccactatatccccagtgcctaaaacagtgccaagaatatagaaaggggtcaacaaagtttacagaatgtgcagcaatagaaggattaaagtcagggaatgactgtgtgtcctgagccatcagggaagttcttataaaaatgtttgagctgagtctgaaggataaatagagaaggatactctacgcataggaaatatgtgaaaaggaatggacgtgtgacgttgtaggattggattgaggaaacaaaatttttatgtgactgaaacaagagtatatgtttaggccagttgtggtggctcatgcctgtaatgccagcactttgggaggcccaggtgggtgggtcacttgaggtcaggagttcgagacgagcctggccaagatagtgaaacctgtctttactaaaaatacaaaaattagctgggcatggtggtaggcgcctgtaatcccagttgtttgggaggctgaggcaggagaatcacttgaatctgggaggcagaggttgcagtgagccgagattgcaacactgcactccagcgtgggcaacagagcaagactcttgtctccaaaaaaaaaaacaaaaaaagaaaaaaaaaaaccgcaaagaagtatgcatgtttattgttggccagaggagtctggaaaagaaagtagaatctcccttcccagcgcagctcactaatcttttttatatttatgtccagtatataatgttgacattttaaaatttgaatgtggcaggacatgaataattactgattttggaaatggaaatttataatctttttcatatttcaacattgcctctaaaatgttcttttttttaaatcatagatatccagtcatgttaaagcgattgatacaatttaccagaccacagacttctccggaatccgtaacatcagtttcatggtgaaacgcataagagtaaggaacttaaatagttaaaaacacttaaaaagtgaaacagtccagactatgtttacacacacacacaaaagcttgcttttaattttatctttatgaattaagtagtttagtttaattgtatctgttgatgcagttttttactcctggcatttacacacccacacacacacagatacttgggtttatgatttaagaattaaatgtataaggtcttaatccagtctacagtagaggtaaagtgtgtattcagtctgtctgattaacatattattaagaaagctctgacccttcaataactatggctatagtgcttgacttttccccaattatccctcagtttcctaaaatttgctttgtgcagtgtttttcactgtatgttccatttggtgttccaggggagaaaaaggataaatacagtgtttaaataaaattggaagttggaaaaacccttagtactataatcttcttgaaaattcacaactcacagtaacatatatcaagttttgagaagtctttcaggaaagaaacccatatttttctaaatttttgaccatgaaactttttttttagaaaaaatatattaacatcaacagattccaaaatactttaggcattttgagaaaagctgatccggagccatagggtcacgtagtatgagttctaatgttataaattacaggtaaataaataaatattaaattactgacaaatttaggctattttttcaaaagatttctgaatattctaaatatatatgtatagcttttaaagaaacagtatttatatgctaaataaacaaccgaacttaaaaaaaaatcatcctttcacaaaagtatttgccacagggttccttaatatttatgctttcctatttttcttcaaatgtggttggataaaatgtctatactagagaagtttagtatatacattcagccacatagctgtaggtagtccttaaatttagaagcagtgtgattaaatcttaaattggattttcttaaggtgaaatatgatttattgatttacagtataagaattgttcataattaattgctttcatgtattctgtgaacaatataaatccttaaatgagcaagtaacagtgataagaggtataagtgttgctgtttagtaggcagagcaataaaatgcaagtaatgaaaagtagagagcacctgaacacattttagtgacgcacctttgaggaaaatgatatgtattatgaagaaatgcatgtatataagtaaatgatgtggtagttggttgtttttagaccttacctcttattaaaactttagtaaagttttatctgttgaagattgttcataacctattaatttaaaatttctgtcagctatattaataatccatttaaatataggtaattaaaatttaaatgcaatttgttttttttttttgagaaggagtctcactctgtcgcccaggctggagttcagtggcgcaatctcggctcactgcagcctctgccttccagtttcaagcgattctcccacctcagcctcccgagtagctgggattacaggcgtccactgtcatgcccggctaatttttgtatttttgtagatacagggtttcaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgttttagtgttaaatggccgtaactgattgtttttcgttaattgttaatagataaaccagatgttctgaaatctgttcttaagcagttgccctcaatggtgtttttgcctccctgcttctgagcctcttggttttactggagagtacaggtcataaagagacctgtagctcttgttgtatcaaccattatgtcatcctcttactgccaacattttcaaacagactgaggtttgcctttcggtaaaaacatttactttcatattgtaattccttggcttacctggggaaagccaaatcgttctaggacttcagaggagacacacaggtctctgaaaggatgcaggggctaataaataaaagcttttgtttaatagaagtctggtattagaacagattattcagattctgaaggaggaacctgtggtaggagtatagtagctaagtatcaaaagaaacattctggaagaactcagcttcaaagagtaaaagaagtgagtttaaattagcaaaattcttgcccacattcaggaaaaaaaaataaatttgcagttagtttggcttggctcatgtgactctctaggcaaggaaaaccaggaaaatgatttgtctgctgaactgacagtcttgggtttgatacctattttatattctagtaattagttaaaatacagggttttatatccttgtaagtgtcaccatatgtaggagattaggactaaaggagacttgttcagagaattaaatttgaaaaactatacttcctttactaaaggttttgaaagcaaaacttgttttttcttcccaagtgttcagtgttcaggaatctggtgaatacttgctcagaaatttaacatcttcaattttaatttccctacctagcctttcttttttatttgttgttattgttttgccttctgtgatcagctcagggatgtgggcagtgggaacaaccttagaagccttaattcaggcctgatttccatgggagcatattgtccaggtgtacgcagaagaaggtgagcagacattcacactaaagctctgctaacattaattacttactaaattattgttttggattttagatcaatacaactgctgatgagaaggaccctacaaatcctttccgtttcccaaatattggtgtggagaagtttctggaattgaattctgagcagaatcatgatgactactgtttggcctatgtcttcacagaccgagattttgatgatggcgtacttggtctggcttgggttggagcaccttcaggtagtttatcatattaaatatgtcttaacttactacttgaaacaaaggggagttttcagagaatgttgaattttcaaagtataggagaaagtgatgcctgtataatatcctaatttatgctacttgagttaggcaagactcataagcataatgtaaaagccacaatagatgaaggagctttttattttgaaacgcatacagggaaatatcctgattcctgacatttgaatggaccaaatgaaataaataattttatgagaaaaagtggtaattctgaaacccaaagggaaatttaatttttccacaaaagttaataaatgttatatatttattaacttttttcccctccaaaatagggtacttagaatcaaaagaggaaaactgtgtcttgctctctcttctgtagtgagataaagaggagagaaatcctcatcaagagtggcaggtaaaaggaaaagaaagcctgcctttattattttatttctagcctttattttaataaaagggaagcactgcatgaaagagatgtaggcaggaagcccctggtacccacaactccattgacatcatcacctgggttcatactctgccgagtctctgccttagccatgaaagctattgtcattgataatgttgggatgggacaatacccttcccattacagtgggggtggagtgttgtggaggagctgtgatttactgtataagttcagttgcctagtttagaaatccaaatttattaattgaaagatgagtggaaaggaccccaggctctttgaatataaattgtgccaagtagagtttaatcaatagtatattatcttctgagctatatacaacagattctccttctgatacttcatttctatgtttttttttttaaaaaaaacttctgctttatccagagtaagagaagcttttgtattcctattcttattagtttattctttgatttgttttgtatattttaagatcttaagtagtgctgtattttcctttgtatttctttctccttttttaaaagtcagtatcttaagtcaatacttttacaatttccatagcttcttttgtttttcttctatgttttaaaatgtactcaatttcatgatgtcattttaaagtataagtttatgtcatgggctgcatattaatagtgcagtacttttggatatttgtcttttatgataatctgtacttttttgttacttggattagtcagcagattgtacagctcactctttcctatgatttttcatgttcgaaactttcatactctgaaacctctttgccccttcaatggttggatgattttatcacaaagtctgtgatttcttctccctattcattagtaagtactactaaaaactcagggtctcatatgattttatttgtatattatccattaatacagtagctgtgaagtctcaaacaagtggttctccaagtgtgatccatggactagcaccatcagcatcacctaggaacttgttagaaatataagttcataggcactaccccggtctcttgaatcagaaactatagatgtggagcccaacagtcttagtttgaacaagttctcaaagtgattctgatgcacagtgaagtttgagaagcaccacattaatatttttgtctctaaagcttgctcacaaaatgcctcctgggtaagtgagtatgtgatcttaaactaaaaactttctgccattttgcattttcagttacagactattgtacttaaggatgtaatgattctgtaggaatttggtaaaattcttcctaaatcttcagatattctcatgtctttagattcagctactcattttgttgtaaaaagtaagctttattttttagagcagttttagatttacaaaaaattgaacagattaggtattctcaaatctccttcctccctcccctgacagttttgaggagtactgatgaggtatattttagaatgctcccctatttggaatctgtctgatgttttccttatgattaaactgtagttatgggtttttgggacactcagtgtttatgtctcattgtttgtgatatttggatcaccatttgtgatgctgctcattttcctgaggtggggagagttctggattgaaaatggtggggcatgttacttgtattttctttttttttttttttttttttgagacagagtgttgctctgtcacccaggctggagtgcagtggcgcgatctccgctcactgcaacctccacctcccgggttcacgccattctcctgcctcagcctcccgagtagctgggtctacaggcgcccgccaccatgcgtggctaattttttatatttttagtggagatggggtttcaccgtgttagccaggatggtctcaatctcctgacctcgtgatccgcccgcctctattttcattattagggtcttcttaaaggtgaaacaagatacttcctgtgtacttcatgagcaaaaatatggtgattggcaaccagaatagaaaacgaagactcccgttgtcaactttgtatccccattttccccccctctgctttttttccttttatattattatctctctttctttcagacattagatgtccgcttccattactctatgttaaacccccaacttcagctcttggaagccatcttctaagagctgctggggaggggctaggcaggcacagaagaatagaggccatagtgggaaagaaaagggatctttgttcctttggtccaactttttcgagtgtaggttacctgccttgaaataacactgccagcttcttcacttgtctttgcacttactactagctgaactgagtttcatatttgacatttttttttttaaaacaaggaatgttatatatttattcttgattatttcaatacccttatgaggtgtaggtattattgtctcccttctacagatgaggaaacttgtgttcagaaactttgtgaccaacctaataccacacagctagaggtggaacaggatctggaatctggaccttttgactccagattcagttcatttggtaattatattactaggtattttatatatatataaatacaatctacacacacacacacagtaacatcttagccttttctttgatgtttcaaataagaagctgaaatgttttctgcttcttagtagaggttatacattggtggaatctgttttcttctttcttgagagagaagagttataaaatcatactaagctataatattttgatataattttgggtaattgtcatggcataatgggaagagcaatggactgagagctgggagacaggattcttgtgtgttttctgtctgtaaattcaggaaaatcattttgcttctggctgttttttcattgtagttctgtctttgcccttcttttgagtcttcatgtttctacctataggtcttatcagttaactgaatgaacatagtctcagttcggcttggtcgttgaatgaggctggctttggaattcatctctacagttagtcctgaaaccttcagtactcctctatttgtgaagaacatcttttgaggcatttcatttggtagaaatagtctcttctgttttctttagattagatgttttagtttgatattacatattaaaatttgagagcgtacagaacttaacacagggttctcgggataacccacagcttattgaattcttaacccatagtttaaaagtataacttcaaatgctgggaaaattacatcattgaaatattgcaataggacacttgctattggcatttaatgcttgtctggatcccttggatatttaacatctttgatccctacccattgcatgtgagtagtgctctccagacttgaaagccaaatgcctgtgctctcacatttcctggtatcacttgtgggagtattactatggtctggtccagaattattgcttacattaatattgtatgatcagcatgctactattaatttttggcctcctcacatcaaaactgtatttatggaatatgtcaaggtatcatattactcttgtatttttttctaagacttttttttggggggtggggtggagtgggtctgttttgaagtttaggacagatactctaactttagctctcaaactatcctgtagatagaaaattgtcattatacttctttgttgcttattgaatccttcatcaataattacttttgacccgaattgaaaacgtttcacccttctcattgttattcacaacttatgtatttgtcagtgataaatatatgtatagtaaaatcttaaatttaaaatatatagcaattgagtttgagttaatggtttagctgtgggtatatatgatacctcattactgagttttctggcatatcaaaactagttgcagtatttaaaaaaattaaaccataactttcagagttacaaatagtattttatttcttcctgtataatcaagttactccaacatatgctattagcctgcaacaaatattaaacttcctttttttttttttttgaaacgaagtctcgctctgttgctcaggctggagtgcagtggcatgatctctgctcatggcaacccccgcctcctgggttcaaatgattcccctgcctcagcctcctgagtagctgggattacatgcatgcaccacctcgcctggctaatttttgtaattttagtaaagatgaggtttcaacatgttggttatgctggtctccaactcctgatctcaggtgatccgcctgccgccgccacccaaagtgttgggattacagacgtgagccactgcgcccggccattttaaactttcatataagcgataatcataaagaccaaaagcagttgtttaagaagttaggcaatatataaattactatatttcagaatagtatattctaatttatgtatactcttctcttaaattagccagaccctaaaagtgcagaaaaatgtatattatcagagatttaaaaatatgcctatttactttttttttttttaactgataaagatttgaagtgtggagtcttctatgcttaattcaagtttgacagtactgcattggaccaatttgcacatgacaaatcttcactaaggcaggatattaatttactatttgtttaaaactatgctgtgtgtacaataattattatatacagaatacttatttatatattttctggtttccagaaataatgatgtgcttctcaggactgagctccaaaagtagaactagcttgaagaaaatatattaaattctcacaaattatttggtattttctctctactcagttgtcagtgtagaaaaggtattaaattttgaatatcataaaagttctcaaccccttgctgggttaaatttgcatgtgactccagctatttgtccggcctatagtctcaggtcactcattttaatgtgcatatacatcacctgaggtgggcagagttctggattgaaaatggtggggcatgttatttgtattttctttctttctttttttttttttttttttttttgagacagagtcttgctctgtcacccaggctggagtgcagtggcatgatctctgctcactgcaagctccacttcctgggttcacgccattctcctgcctcagcctcccgagtagctggggctacaggcacctgccaccatgccctgctaattttttgtatttttagcagagatggggtttcaccgagatgttctcaatctcctgaccttgtgtttctttgaaacacatttttcttttcagctttctgaattttaacagtaattcaaatttgtattttgttgccatatatttattatatttaatgggagcaaggcaacagtcgtagtataatgctgttcttgcagacctattttgaattgccttctgttacatgctttattagggattctaaatactagacttgtttttgaagtggggagaatgggaaggggaggagaagcaatattagactttttttaaatggtttagtaactttgttgtaacttgtctatagaaagctaattagagcagttatcgtaatacgcttatccatttgattgtatttcttttaaaaatcaaatagggaaaactttaagtataaatataaactaaataacttctcactgaaaatcttataataaagttaattaaaagaaaatatgatcttaccagtgtaatgtctatataaaggcatgaattgaccagatggtttctgattttcctattattatttttctgatttctcttaattgattttagctgtgaaagcactgtcatttgctgttaaattctaaagtccctgttaatgaatagatgaagtacaaaatgataaaaatatttaagtggaaatatggtttttcttttaaaatttgatagtgtcctaaagacatactggaacaatcataattcagtttttaatttttttttgaagatttcaaacctgcggaaaggttgcaagaatagtatggtgaaattcttcttcttttttttttttttagacagagtgtcactgtgtcgcccaggctggagtgcagtggcacaatctcaactcattgcaacttccacctcctgggttcaggcaattctcctgcccgagtagctgggattacaggtgtgcaccaccacacccagctaatttttgtatttttagtagagatggggtttcaccatgttggccaggctggtctcaaactcctgacctcaagtgatctgcctgcctcggcctcccaaagtgctgggattacaggcgtgagccactgcgctcagcagtggtgaattcttgatggattaatcaattattaaccttttgtcgcatttgctttctatctctcccttccttcccacccatcttctctttttccttctttcctctaccccctctttttttttttttttaaccttcttgacatgattattttctatttttacaaatacattgtatgtcatatctcaggacagggaatcatgtgctcatgtgcctcactgcttcttgtagaagtgactttctcagaatcttcttgaggatattttgttcaactttcatttaacttaaatcataagatttctttttaaaagatgaaaggatgtacactttgacttagtgtaaatactgatatattcaaattgaaaggaaatgtaaatatttgttttcctaaattaatgggaataacatttgggggacattttgattgtgaagaacattttgtaaaggctgtgtactcagtcctgggagtttctttctgaatgtcattaaaacttttatatgaagtgacttcttagtcttggaccaaagaaacttttgcatatgtgatacgtttgagtaccagttctattttagattaaaatataaaatgttttcatttaatatagcatgtattacctttttgggggtaaggggaaacagatactaatttagccatttttttgttctggattaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccagtaagtattgtctaattattagcttaaaaaatacttattagtctaatttttatgttgagtgatttatttaaaattcaccgtgaaaacaaatgtacttacgagtgtttagtttttatgtcagagcacagtaatgtatttgaccatactgaaagggaggaagatagaatgtttgtggttaaagtaagaaaagtaagcataacagtgctagaattctgtgaaggcaagggatttcatctggcttattcagacaaaatatctatatctcctggccctagaacaatgcctagtacataatgtactcaaatatcttttgaatgagaatcattattcattgtttaaaagtacattttgaatgttcagcaaattgtgagaaattctttttttgttttgtttctgttaaagcatttttagggaatgagattgatattttaaaatcttttctctactgtggaatgagattgataatttaaagtattttctctaccgtggaatgagattgatattttaaaatcttttattaggaaaaaattctaacatacacaaaagtagaacaaatagtgcaacaaagcgttatacgcccatgattcagaacagggatcagcaaacattttctgtaaagggcctactagtaaacattttaggcttcaggggcagtgtttggtttctgttgtacagtctttgttgcttttacaatttgttaaatatggaaaagccattcttagttaagccatataaaaacaggctgctggctactttgtcaacccctaattcagagccaataattgtgaagattttgacatatcttctatctgtatttctttttctttgctaaggtatttaaaggaactctatctatccttacgtatttcagtacacattcctgaaaaaatagacattttctaatacaactacaatgtggttattacacctaacaaaattaacagcgatctttgatattatctaatatccagtccattatattgatcttttaagtgaccttaaagatcagtacaacacagaaatatgaaatactgaatgatactctgtctttgtgattttggtagagcttattaaagataacattttgaaaatgtacacttgaaaactgtatgtaaattcattttactttcaccttatcacttgcaaaagtgcaaatttttatgattttaaaaataagttgtctacttgtagcttaaaatccccaaatgcacttctctaatttttcccatgtttgtaaaataggtgccatctcactaagttgcaagtctttcttcttctacatcccaatcagaaattgatagattattattaatgttcttggataaggtatttaaaatgtgcttaatctctgtaactcttgactgcttttgtgatcttctcttaaaagagtacttggaattttagagatgagcagagaattattgttcatagttgatttgcattttcaagagcagataagtgtcctctcttctccccaagtcatcttggttccaggccttaccaggggaattttagtactcctccagctacttgtctggcctttagtcccaggtcactcatttttatgtgcatatacatcacctgagaatcttaaaacacagattcttttttagtaggtctttgatggggcctgagtttctgtatttctaacatactcccacataatgctgctgctgctgctgctggtgctcatctgtgaaccacactgcagtagggaatctagaccattctcttttcacttcttgtgtaatctctttcctacctagctgccagtgagatgtttttattcaattaatgttatattattgtttaatggagaaattggttcacactctttgcctaccacgctcaatcgtaccccattcttttgcacatgttgttaattctgccatctgtatccgtagtagatggttgtcttcatctgttttgtgttgttataagggaatatctgagggtgggtaatttataaagaaaagaggtttatttggctcatgattctgtaggctgtacaaaaagcatggtgctggcatctactcagcttctggtaagggcctcaggctgcttccacttatgatggagggcaacaggtgctggcatgtgcagagatcacatggtgggagtggaggtggtgggagcgtggggtcaaggagagaggagagtactaggctcttaacagccagctcttgcaggaactaagagagtgagaatgcactcacccacccacctccaacccttcaggaagagcattaatctattgatgagggatctgcccccatgacccagacctctcttgttaggcccactaacaactttgggatcaaatttggggggacagacatccaaattatacaatgcttaataaatatttgttgagtaatttaatagtaagatcagccagaatcataaacacctgaacctgtctcccttaacatctttatctgaaatctctttctctcttatacgtttgtagtaatgtcaatgttactttttctgagtggttcacattatttcttaaatgtatttatcctatctgaaatatttattgtgcacctattataaactgctttataaactttgttgtaggaagttgtaatcataaatgagacaaagttcctgtctctcagggtgaaaattctaatatgtacctactctcaccagattcaccttcatgtaaatacagttctaataatgccacttctgcttactaactcacttctactactttctaatattgctgatacaatttccttatcttaatgtttggggtgtttgataatttggggtttaagtatatttctagtgttatctctcctcatctgtcaaattaattcacagacctttaaaactttcctccgctaggaagtcagttccttcccatgtctgcctgttgaaatcttgatccgtgttgttatatgatgtaaatgaatatggcccttaataaaaattaagaaaatatgaccatcatagttttatttataataccaaaaagttttaagcagcgtagatggccctacagtatgaaaataccacggaatgctctgcagtcatttaaataccaagttttgcagtgctcattttatactgttaagctgaaagaaaggtgtgtataactgtacacatggagggtagctgtggtgactcacacctgtaatcccagcactttgggaggccgaggtgggcagattgcttgagcccaggagttcgagaccagcctgggcaacatggcgaaaccccgtctctaccaaaaatacacacaaaaacaattagctgggtgtgctggactgcacctgtagtcccagctactcgagaagctaaggtcggggaggatgacttgagtccaaggttgcagtgagccaggatcacgccactacactccagcctgggggacagagtgagactctgtctcaaaaaaaaaagttataactgtacacatggtatagtccaaattttaaattaaaatgtgatacagctagatataagtcagataggaaatagatcaaaattttaatagttatagtgcatggtagattatgattgaatttttatttatgcatttttgttttcttaattttctttcttatagttagacaaatttttctgttttcttgtcacaaagattatagtttcttagtgaaacgcttctcttgatttgaactctgaatacttgtgcgagtccagtcaagatggcctttatgttctgttttgtgttttgcttattcatgtgcttgttttattcgttatctgaggatggcaaatagctggcatgcttgcttacaacctgtttccccttctattcctgttaatggtgatctattgtaatatctcctggcctagtaaaataataattgactagcaatatctgtaatggatttatgcagcagcaagtcagactaagcagttatgtcaagatttgctatcatttaaaaatagaaggtaagtgccttgaaggctagggataatacttttctcatctttatatttttatattttagtgcctccttttatagcactggacattcattaatatttactgaattgaaaagtggcaagatattctgtgatgacatcaagagttatacagaattgggatttttttctttcctttctaaaactctaatgctgagaataattctagtgctacacctttttcagaaactgagttgaattttataggttgaaaacataaagcaagataatattggtgaatagtatagagttgctaaatgctgcatctagattcagaagaaaggcaagaggtatcaggaagaataaaggtgatagtagaggacacattttttaatttaacagttgcctcagaagagggaatagaaaatgaaagtaacttagttgggctctaggaaaaaacagaacgtccttgggcagtctttttctttcttgagagtggggttgttgggtatttaaaacaagattttaattaaatagcacaattactctagtgtccagtgttttttgccccttctgatgtgttctgaattgtttgaggggcattgtgagggttgttttagtgcatatccccaggatggtaggggctgctgggatctggtagtagtgttctgttgcttggtctcataagcattactttgagaaaattcagggagctatgctgtatgtatctgactcttcaataaaatttatcaaaaccgaacaccacttatgtgcatttatatgttacgtgtacacagaactctgtttatttggcaaagcagtattttggttttatctctaggcttttaccatttttcatttaaaaatatatcattgtgtttctgttcctagtcagcatttttacttacctttcctatatattggctattaagttagctgtcttagattcctgttctgtgtgtatttagccccatgtcagtctcttgattcttttgtctttccccacctctgtcttctctgaactattcataacatgtaatttaacatatgtgttagagactatttagtagttttaaagtagtttattttactgttactagttttaaaagtatgtgagcttatttttgatagacttttatgacagtctgtcctcaattctagtccctgcttacaaagctataaattgttatggctagacctccactgattttccttcttttctaagacagtgacccctaaaagagcaaattcttttcctactcaaggtgtaaaacaattgtaagatcctttttaaaggagagtccacaagcttccattgttttcctgatgagaacattacgtttaatcagttgacctgaaaaccttattttacttcctgtttatgtaactttatattctttttgacagcatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttggtatgtatattttcctaacgttttgttatgaacattttcaaacattcagacaacttgaaagaattctatagtgattactgacatacccaccacctgcattttactattgctaacactttgctgtattccctttatctcgttatttcttaatcttgccatctctcaattcatgttttattgcaatttaaagtaagttgcagccatcagtatacttcacacctaaacattttagtctgcaaatcattaactagagttcaatattgtttatagttctttttctgttttctgcataagtgaaatgcacaaattttaagtgcatcatttgatgagttttgacagatgcatttacctttgtaaactacctatcaagatacaggacatttctgtcaccccggaactttcttttatcacccttcccaatcaggctctgtcccaacacaccctcagaggcaaccactatctgatttatttcactctacattggctttgtcttcatataagtgaaagtatacagtttatacccttctgtggaaggctgtttaactcagtatacagctttgagattcatctttagtattatactcctttttattgctgagtactattacgttgtatgaatatgtcctagtttgtacatctactctcctatcatgaataccttggatttgggctaatgtgaataaagttactatgaaattatttcttattttagtaaaatatatatagcataaagtgtgccattttaaactgattttaaatgtacagttctgtgacattaattataggtacaatgttgaatgtgaatgtaatcaattacattcactcttcatttgcaaactttttcatcatcccaatggaaattctataaccattaagcagtaatgctctgtcttcccctcagcccctggtaacctctaatccactttctgtctttatgaattggcctattctgggtatctcatgtaagtggggacatacaatatttgttctttcgtgcctggcttatttcacttagcataatattttcaaggtttatctgtgttgtagcatgtatcagagttccattccttttcacggctgaataatactccattgtatgtatagaccagattttgttcttccagtcatctgttatgtctttcttgcggcattgaacatactctaaatatttactttgtattagggtttttttgtgtgtgtgtgtccttgtcctatttcacaagaccataggtttctttaggggaaacactgaggcctattcatctttgtacattaagagcactgaaagaggggttaaacatgtgacagcaaaggagaaagaattcaggaagatttccagataagcatgggattttgtttttaattgaaattttattgagataattaatagattcacatacagttcataagaagtaatagattccctgtacccttcactcagttccctccgatggtaatgccttgcaagactgtagtacaatatcatgaccaggatgttgatattgagaaaatccatagatactattccaatttccctagtttttttttttgttctcatttctctttgtatgtatttagctctatacaattttattacatgcgtagatttatgtatccaccatcacaatcaagaatcagaacagttctgtcattacaaggatccctcattgttttataaccatgcttacctcccttctgttgtcccttcctcccccctgctaccctgttttccatatgtaaaattttgtcacttctaaaaaagttatataaataaaatcagacagcatacaaccttttggaattgccttttctcactcaacataattccctggggattcatctaaattattgcctttatcaatagttcgttcttttttatttctgagtagtattccatggtatgtatgtactgcaatttgtttaaccatccatttgaaagacatctgggctgtttccagtgtttggctattatgaataaagcagctgtaaacattcatgtacaggttttttgtataaacatataagtttttactttgagataaatgctcccaaatcgaattgatggaccatatagcaattgcttgttttgctttgtacaaaactgccaaactcttttccagggtggccatactattttatgttctcaccagcactgcacaaatgatccagtttctctgcatgttcacaaccatttggagttttcacagttttttattttagctgttctgatgggcgtgctgtgatatctcatggttttaatttgcatttctctggtggctaatgatgctgaacatcttttcatgtacttattggccatttataaatcatctttgatgaaatgtctgtccatgttttttggtcattttagtgatcattagtgggacttttttcttttctttggagtattgagaattctttatatagtctagatactagtcctagatactggtttgcaaatattttctcccagtctgtagcttgtcttttcgcccttttcacagttctttcgtggagcaaaagtttcacattttgatgaggtccagttaatcagttttttattgtattgattggcattatctttttcttttaaaagggcagattgaaattacatcttcaatcttcaaaaactgatgttatcatttttgttattgttattgtcagtggttgtttttctaatgcttcttaatgtacaggtacattaagattcttcatttgtaaactgggttttcacagtaaaccttctgaaataagttgacttttaaaaatgtacatattgctttgtaggtattaacaggaaagaaaattttttcttaaattataacaaaatgtgtacctattataatttttgcatttaaacagtatttttaggccagacagggtggctcatgcctgtaatcgcagcactttgggaggccaagacagggagattgcttgaggccaggagttcgaaaccagcctggccaatgtagcgaaaccctgtctctacaaaaaattaaaaaatcagtgaggcatggtggcgtgcgcctgtagtcccagctacttgggaggctgaggcacaagaaattgcttgaacccaggagttggaggttgcagtgagccaagatcgtgccactgcactttaacctgggcaacagagcgagactctgtctcagacaaacaaacaaacagtacctcattgttgtttaaactgttagcaaataactaacttgaagtactaattttatatgaaataaaaattaatatgtagtaaataatgtatgtaacattttctgacttcgttatttgttttcttataaattacgtgtcatgtgaattataaaattattactagacttgtaaaaatcattattcacctagtatatatgtgcagatgcatgtttctagttttttttgtttttgtttttgctttttttttgagacagagtctcgctctgtcaccaggctggagtgcagtggcacgatctcggctcactgcaacctctccctcccaggttcaagcgattctcctgcctcagcctcccaagtagctggggctgcaggagtgcgccaccacgcctagctggtttttttgtatttttaggagagacggggttttaccatgttggccaggatggtctcgatctcttgaccttgttatccacctgcctcggcctcccaaagtgctggcatttacaggcgtgagccacctcgcctggcccccccttttttttttttttttaaatttcactttaagttccgggatacaagtgcagaatgtgtaggttcattacataggtgtacgtgtgccatggtggtttactgcacctatcaacccatcatctaggttttaagccccacatgcattagctgtttgtcctaatgcgctccctcccctcaccttctacccctggactggccctggtgtgtgttgttcccctccctgtgtgcatgtgctctcattgttcaactcccacttatgagtgagaacatgtggtgtttggttttctgttcctgtgttagttttctgggtatgatggcttctagcttcatccatgtccctgcaaaggacgtgatctcattcctttttatggctgtgtagtattccatggtgtatatgtatcacattttatttatccagtctatcattgatgggcacttgggttgattccatgtgtttgctattataaatagtgcatgcttctggtttttgagaacgaaagagatggtttaaagtgaaacagggatgaagcttcgatgacctccaagattttaaaaaatagtcgatgtggttaagaatgaactttctgctttcatctaggccagtctggctctggagagcaggtgcctccacagcaacatccctgggggccctgaaatcagggttcagctaggctcctatgtgccctgagggtctgggttcccagtcctgttgccaagtggctttgtcccagatcctttcttctgggctgatgtgagtgcatatgtttgtgccaagcttctgttttatattgcacatataaataaaggaagataatttaccataaagaaataattatctgaatataaagccagtctttctagaacatttttgatttagataggcctcatgtgggtttcctgtgttgagatgtatgggttcctgtgttgagatgtatgtgttcccttctacttattcaattcgcaacttaaagcctgtacaatgactgttttccatgtcgatttggtgtaggagaaagaaaagagcaccagatcgtagacctagaaaaccctagatatagtctgtgttttgcctatactgggatatatggtccctagcaagttacagactccttggaagttagttttatttcctagaacatttaaggcatttgatttttatcattctctgcagttgctaaagctctttgattttatgatcttacaaagaggagcatttctattccaattttaaattccattgacaaaaatcaaagaactttagaagactgctgaagaaattttctaaaattattcactatgcttagatgagactgtctaatcttaatcaaccaagatctggctcaataccattaaggtctgtgagaatacagaagatataaataatacatgtttgttcccttaaggagcttggtttagttcagcagcaaaactaatgtacataaaaaaaattacctactgattgtattacaatcagctaaatagaatgtgggacatttcatagacaaaatcacccaacttctttaacagatcaatggtgtaaaaataaataaaaatggagaaatctattatacgttaaaagaacataagagacctgtcaaaaagcaaccatgaggggaggagttggggttaggggaaccttgggtttgaaacttgattcacagcaacaaattgtaaagagacatttgaggaaaattgaacatggcttggctgttagatgttattaagcatgctattaattttgttagatatgatcatggttattatggttaggtttaaataagaaaaaaactttatgtcatagtgatacattctgaagtatttacagggacaataatatgttaggtggggttgttttaaaatactccagaaaaaaattgtgggagtaagtgagacaagaacagcatattgttgttgatagttgttaaagatgagtgattggtacatgggaattcattgtacatattcttttattacttttaggtgtgtttgaaattttctgttgcaaaaaaaggcttagtttttttttttcctggttagtgaagcactaacttggtttgtatttgtgtgatatgaatagaacagtcaataaagctcaatgtagcatggcctaagttgcaagttacagcttctagaagggaccctctgtcaaatcctctcactgtacagattgagaaactgaagaccccaagattgcattgctagttagtagcagaccccctgttagaattaggtctcgtaatttccagattcctagtttgttctacttattcatcaaagttttcctttatccctttgttatgatgatctaaagaatttgtgaattttaaataaaattaatgtgtgcacacaatgcttactttgtcttgtttattttcctcagaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcaggtaccttgctaatttcagtgatgttaacattcttgtaaagttacctcaatgcagttatgacaaatttaaaactgagattaagagatgcatatggttttgaaactttgcttttatctgttgtttgttttctttttctgaagtagtgttggttactgctctgttattggcagattgaactacctttttttttttttttttttttttttttgagacagggtctcgctctgttgcccaggctggagtgcagtggcatgatctcggctcactgcaacttccacctcccgggctcaattgatcctcccacctcagccccctgagtagctgggactataggcatgtgctaccacacccagctaatttttgtatttttttttagagacagagttacgccatttgcccaggcttgtttggactacttttaatagtaatttgtgtggtgaatgttaacaaaaggacatactcaaaggacatactaaaaagaatcctaaaaaatacatattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtggctttgatttgtgtttcccctgatgattagtgatattgaacattttttcatgtacttgttagcaatttatatgtcttcttttgaaaaatgtttatttaggtcatttgtctactttttaatgagattatttagttttttgctgttgagttgagttccttgtacattctatcagtccctagtcagatgaataatttgaaaatgttttctcccattcagcagatcgtctcttcactctgttgattgtttccttttctgtgcagaagctttttagtgtgtgtaaccctatttgcctatttttgcttttgttgtctgcagtattgaggtcttactcaaaaatcttggctcagatcaatgtcctgatatcttttcccaatgttttcttttagtagtttcatcgtttcaggtcttaaatttccatcacattttgatttggtttatgtatgtggtgagacataggggtctagtttcatttttctgcatataggtatccagttttcccatcaccacttattgaagagactgtcctttccccactgaatgttcaaaaatcacctttgtcgaaaatcaattggctgtaaatatatagatttatttctgaattctctattctgtttcattggttaatgtgtctgtttttatgtcagtatcatgctgttttagttgctatagctttgtagtatattttgaaattaggtggtgtgatgcctccagctttattcttttggctattggcttctgtggtttcatatgacttataggattgttttctctttatctgtgaagaatgtcattggtatttggataggcattacattgaatctgtagattgcttttggtagtatggccgttttcacagtattaattcttccagtccatgaacatgaaatgtgtttttttttttttttgacttgttcagtttctttcatcagtgtttcatagttttccttctagaaatttaataaactcacctccttgcgtttattaaacttactcttttttttgcagctattataaatgagattgattttctgctattttcttgtatatagaaacacaactggttttttaatgttaattttgtatcctgcaactattctgaattcatttatcaattctaagagttttcagtggagctttaagggttgtctatatatataagattatgctgtctacaaacaggaacagtttggcttcctcctttccaatttggatgtcctttattttcttctcttgcctaattgctctggctcagacttccattactatattgataacagtggtgagagtggacattcttgtcttgttctagttctttttttcttacttattttacctggtgatcaggaagtattgttgggaaacttttttttaattactgattcaatcttgttacttgtgattgatctgtccaggttttctattcttatttcaatcttggtaagttgtatgtgtccagggatttattaattatcattcggttttcccatttattggcatatagtttattgtaatggtttctaatgattctttgtatttttgtggtatcagttataacgtctccttttttgtttctgattttatttggatattttttccttgtctagttaatggattgatgattttatctttccaagaaaccaactgttcattttgttgatatatttttattttatttttttatttttttattttttgagacggagtctcacttttttccccaggctggagtgcagtggtgcaatctcggctcactgcaagctccgtctcctggattcacgccattctcctgcctcagcctccggaatagctgggactacaggtacctgccaccacgcctggctaatttttttgtgtttttagtagagacggggtttcaccgtgttagccaggatggtctcaatctcttgaccttgtgatctgtccgcctcggcctcccaaagtgctgggattatagacataagccaccgtgcctggcctgattctttgtatttttttagtctcaattttgtttatttctgctctgatcttcattatttcttttcttctactaatttggggtttggttcgttcttgctttttcctgattcgttgaggtgcattgttaggttgtttatctttctactttttctatgtagacatttattgctataaacttccgtcttaatattgctttagctgtatcccatagtatttggtatgttgtgtttttctattttcagttgtttcagagagcttttaaacttcatttttaatttcttcattgactcattggttgttcagaagcaagttgtttaatttttatgtgtttgtacagtttctaaagttccccttgtgattgatctctagtttcattctgttgtgttcagaagagatacttgatatgatctctgtttttgaacatctgttgataattgttttatagcctaatatgtggtctatcctggagaatgtttcatgtgctaatgaaaagaatgtgtattctgccacagctgttggatgaaatgttctgtaaatgtctgttagatctatttggtctaaagtatagttctaatccagtgtttcttgattttctgtctagattatctgtccagtgctgagaatgggctgttgaagtctccaaccgttactttattggagttgatctctctctttagatctaatagtatttgctttatgtatctgggtgctctggtgttcggtgcatatagatttagaattgttatatccctttgctgaatggaacattttatcactatatagtgatcttttttgtctcttttcacagtttttttttggagacagggtcttgctctgtcacccaggcttgagtgcagtggcatgatctcggctcactgcaacctgcgcctcccgggttcaagcgattctcctgcctcagcctccctagtagctgggactacaggcatgtaccaccatgcccaactaatttttgtatttttaatagagacggggttttgccatgttggtcaggctggtcttgaactcctgacctcaggtgatctgcccgcctcggcctcccaaagtgctggcattacaaaatgagccactgtgcctggccctcttttcacagtttttgacttaaaatctgttttatctgatacaggtatagctagtcttgcttactttgtttctggttgagtgaaatatcttcttctgttcctttacttttagtctatatatgtctttagaggtaaaatgattttcttgtaagcagcatataggtggatgtgtcatgtgttttgggaggccgagccgggagttttgcttgagcaggagtgcaagaccaacctaggcaacatagtgagatcccatttctacaaataaatgaatacataagtaatttaaaagctacagagggagaagagattaaaataggcccattcagccaggttgtgtctttttaagtagggggatttcattggtgtatattcatgattgatatcagtaggtgaggacttcctcttatcattttgataattattttctggttttttttttttttttttttcttcagacggactcttgctctgtagcccaggctcgagtgcagtggtgcaatcttggctcaccacaagctccgcctcctgggttcacgccattctcctgcctcaggctccctagtagctgggactacaggcgcctgccaccacgcccggctaattttttgtgtttttagtagagatggggtttcactgtgttagccaggatggtttcgatctcctgacctcgtgatctgcctgcctcggcctcccaaagtgctgggattacaggcgtgagccactgcacccggctgtttttgttttgttttgttttgtttttgcatattcttcttactttttttctctcatttagcattgtggtttggtagttttctgtagtggtaacatttgactcttctttttctcatttgtatatcacagtggcctgtattgtacagctttgtggtaatggcggtgttggtgtacgtaggttgttagcattataattctgtgtgttttcacaatggtgattattggttttttttgcttccaggtgcaggaatcccttgagtatttcttgtagggtcagtctagtggtgatgaatttcctatttttgcttgtgtgggaaagactttatttgtccctcatttctgaaggttagttttgctgggtatagactcttggctgctaatttgtaaactatccttcagaaatgagggacaaataaagtcttatagattcttggctgccaatttgttttttctttcagtactttgaacatattatcccattctctccatgcctgtgaaatttctgctgagaaatctgctgctagtctaatagatgctcccttatatgtgacttgatactttcctcttgctgttttttttagaattctctatgtccttgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttgagctcactgcaacctctgccttccaagttcaagtgattcttgtgcctcaacctcctgagtagctggtattacagggtgcgtgccaccatgcccagctagtttttttcgtatttttagtagagacgggggtttcaagctcctgacaagtgatccacctgctttggcctcccaaagtgttgggattacaggtgtgagccagtgcaccccagccaaaacaaaggttttctgtgcctttttaaatctcttctccttctgtagcttttaagtgattgattgattggttgcagagatgggctttcactacattgcctaggttgatcttgaactcctgggctcaagtgatcctcccacctcagcctcccaaagttctggcattacaggcatgagttactgcacccaaccttctgcagctcttataatatgaaaatttattcacttggtggtgtcccataagtcttatagactttcttcctttttttttccttcccctaaatgagtaatttcaaacattctatcttgaagttcagagattttcttttgcttgatcaagtctgctgttgaagctgtctattatatatttttattttattcactgaattcttaagccacaggatttttgtttctctttaatgatatttattacttttttgaatttctcattcatatgaattgttttcctagtttcattgaattttttatctatattttcttgtgtcttttccctcaaatcattattttgaattcctttttaggcaatttattgatttccttttctttgggacctgttgctagagagttaattatgttcctttggtggtgtcatatatatttgttttttcatgtttcatgagtccctgtgttcatgtctgtgtgcctgtctggtggaacagtcgtctcatctaaattttctagagtgactttcatggagatatactctcacctgtagctaggtcttagtgtgctggtcgggaagggtgtggtgcttctttttccaggtaggtgcagtggtatagtctccatgcagcttcttcagctgtattcaacatcatcaataactgtaggcacctcagtggtctgtgctgtagaagtttgtggtaatggatgctggtggtgtaggttgttaatgtcctcagtggcaacgccttttggggccctcctattctcatttttcccataatggtgagacttagccaaggggatccctcttggtgtcaggtctgacatggcctacgagcacctgctgcggtgctggcttccagttgcggatgcgtagagtaactgtggggctggagttctaggctcaggatctcacaaacctattatggtacttgtgtcttgcagtgcatgtttactgtctggcaagattgaatgtaggttgcctatagcaccaggatctgtgactctgggttactccctagcaccttgggcccagcgggccagtctgtagctgggattatacactttgtgggcagggtatagcccgggcttgggtccagggaagaggtgctctggagatttgagcccagagcacagtgcatggcagtaatttcggagcctgagccaataggactcagtgacgagttgggtcaccggggatggaggtggtggtgagtctagaccctgggatggtggggcttggtggtatcccaaagtctgtgagaccaggtgcagcaacagcaagtacctcagaatgttcaagcacagctgtcatttgggccctagggggcagggaacagcacagtgatgactactgtggggagaagggtgtctcagcagctcagactctagggggctagtctagctccagggaagcagggtgctagagttgtttggcctgtaggcatagtatcccagttcagccactgatatttccctgggatgtgagttactgtgttggcttagccctggaatgcacagctcctcaacttggccaaggcattattacctgaaggagcaatgtgctgctttatctcataccctgcagggtgtgacttttctgtgtaggcccaggcactgtttctttgggacacacggctccaccagtgcactgtttactcaggagggcggtgtgcggtttcagttttttgaagttgtataccagtaacatacttatcatttaagtgatgagacttaggatttaaaaattggtactatgtctaataatgtggatctaatctaatatctaatagtatatagggaataactagtgatttactttgtttaatcacttaatgtttcctctagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatggggtaagcatttaactatatgttttaaaatttaattttagaaaacttgtttttcagaagaattattgatgcttaaagctacatagttaaagtaattaatcttggtctctgtttaagtaatattccctcacaaaaccatgaatatattatgtggcattcaattagctactaatttgtctttcatctttccatgtacatgtggttgatattctctagagaaacatagttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataaaaaataggtttgactgtatagggattaaacaatttgtcttttatttttcttctagcaatgtgcaggttctatctgtgagaaatatggcttagaggagtgtacgtgtgccagttctgatggcaaagatgataaagaattatgccatgtatgctgtatgaagaaaagtaaggcttttaaaaacacaagagtataaaatttgcctcaaactattattttctcctaaattttaagtgtaaaactttgacctacagtttggccagataatttccagctaaatctgtcctcttgaggagattataaatgtaacgtagcattgtgtctctattattatggtctctacaatgttttaaaaatgataaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatcttcaacttatatttgaatctgaccttcagcttatatttggcatttcttttccagtggacccatcaacttgtgccagtacagggtctgtgcagtggagtaggcacttcagtggtcgaaccatcaccctgcaacctggatccccttgcaacgattttagaggttactgtgatgttttcatgcggtgcagattagtagatgctgatggtcctctagctaggcttaaaaaagcaatttttagtccagagctctatgaaaacattgctgaatggattgtggtaagtatgttttttatttacaaagaaaacttaaagtggtttgatcttaattttacttggccagaagtcatcaaagttacgagaaaacaacttaactatttatattagaattactttatatgaagatttttaaagttctaatatttctggttattatttccttctgaagtgatcagaatcatgtgtatcattcatagattgcttagtaggtgatgggagtcattctgttttaccgtgctccttagttcatctcctggatgggttacttcttttggtgcatattattagggcattttcatgggacttaaaaaacatttttttttgttgtttttcaagacaacttatttgcccaaatcgtggactaattggtgatttttcctgatctttcagtataatctctgggtctttatcttgtttgtaataggaaatgttgaacagaataagatcagatacacagccttttgtagatctactaatgattatggatgttcatccagcagtaatccactgaacgcttatttttaagcccacatatctccaagttgtacaaacacagaattacctgatgttttcttaaaagattgtcaagattgactatctcaacttaagtgttcatgctttaaaagtgataacattaaaatatctataggaagcttgcaaatgatatatttgagaatgtgctataattgaactgaatgtagtttgctttggaaattgacttataactcacattcccctttctcaaattagtgtgtatgtgtgtgtgtgtgtatgtatgtatgtgtgtgttcagaactatggatgccttaaagcacaaaagatgttgtttgtgtgggatgtcagccttttttgtactcttctaataacattctagagtaaaaattttatagttaaccccagcatttaaaatgatgtttaccgttcctaggacacattaggatatgtggtttttagatatgtaatgatcatggagtagaaggattgttgaaattggatttaggagatctacctaggtttcaaaccaaatacttgagcagttgacttaacttaggtttccttaaaacatgttactctttttttaaattcctgtgcttgttgcgtggtaagttctagtaaatacctgtcaaactgaagttgtcttctggtaccatggtgcagtggaaagagcacatgtttgagaatcacgtaaggattcaaataatctttctggtgtttatcaattctgtgacttcaagcagcttacctttcttggcccttctttattttcaactcagctatttttttttctgattgtctctaataagaaaagttgaaatttggtatacttgtctgctgtagaagacagtgtatacagaaaacgaaaggagatctcagaattacattctactgagtatatattgtgctagatattttagatttttggggtactaagtcatatctaaacatagcatttttttacttttctctgttatctctaattttcactcattacattatttagaatttcaaaagcccatttattttcactttaaaaatatttaatagacatgatcttttaagtatttttaagaccttttctccccatattttagatgtgaggattaatgaaatgtttcacaatgaattggcaacatgaagtcctttcttgtgctctggaactaattaatcagacactttcaagttcatagacgttgactttaagtgtgtgtgggatagaacatgcctttattttatatcattgttgacaggcatatgccagtctttcgaatagcatgctcataatgtgtgaagagtaccgctaggctgttggtgcatttgtgggcattaaccacatcaagcagtaagataataaacatctggtctttacaagttacttgtctcatttgcttatgtgcatagtttacttgcataccgggatttatcatgttagggaagtgcccttccagttagtaatacagattatcaggatgctcttgtgtaagaagctgtgaaagaagtgaggggttagtttcactactttcctttccagtggtgcctggtggcgttttgtcttctttctgtgttacactatggcagcttttctcctcatgcagggtagagtaggaagaaccttaacaatttagaacttcagggcatgggttattgactgctgctactggtaccacggaagtgatactttcttttctgtgttgacaactatgttttgatttttccaaatacatttactgtatttgctgagtgcctactgtgtgtttggacaggataaaatgataaacatcctttggatttatcaaagagtcatctagttcttgaaacatttaagagcattcatcagtaaatctgttgagaccttatttcagcatctccttttctttaattagggattgagggcattggtaattcatttccagtttcttctatagttgatgtgttctgattttctgtatctttcatgttaggtttgacattgtagaaaactacctcttaccttgacttttattgttcaaatgtattgttgtgtttcccctccttttaaaaatcattgcctgatgattttgtggcttttttctttttaacttgttcagatttatcaggagtttgtatttttgtattgctaatttatcaagagtcaaacacattctcattttaaaattagtttctgctgtcatattttgctataattttatgcatctaagtagtaagtatctggtattctttatgaatgaaagatttagagcactgtttcccaaatgcttaacagaacactagttccattagatgttctgggccttcaatggtcaaatgaatctggaaaactactccatactatagacctttcttggagatttgtgagaagacctgcaataaataaatcgtttaaacttcattttccaaacttacctaaccctagaaacttttatgatgaaaagactaagtcctaaatatccttagatgtcatttggaaaaatattgattaatagcagtagttctcaatcctgattgtataccagaatcaccctagggtttggactaattaaatcagaatctcttgggtttaagtatctgggtcttttaaaactctccagttaattctgatgaggagccagggttaagaaccactcatctagaacaggggttggcaaactatggcccatgggccaaatccagcccgtgcctatttctgtatggctcagaagctaagaacggtttttacatttttaaatgattgaaaaaaatttaaaaattatcaaaacattcttttaaaaatcatatgaaattcaaatttcagtattgataaataacattttataggaacatggccacacccatttgtttacacattgtctttggctgcttttgcactttgagtagctgcaacagtgactgtatggccccacaaaacctcaaatgtttatctgggcttttatgggaaatatttgccaactcctgatcgagagcggtgatctcaaagtgtaggcctgagaagcagcatcagcatcacctgggaacttcatagaaatgcaaattcttacgttccattccagacccactgagtcagtaggtgatggtgcgtgctaatagtttgtctgccatttttttcagtctctgtgatatgtgactcctttttaaaaagacttgtaacagaaattttccattttatcatcttgatatgttgaaaatagaaggtggtttcattgctttgtggaacagaccacatagcatagcacttaatgaaactttaacaacaaagatataatgatattgtaaggttttcagcatatagtgaggacacagtatacatttgctagatgaatgaagcagatttctcaaatgtaataatttatatggaaaagagtaaaacttgtgcatattaactttgaaactggaatgttttcaggttcctgttagtggtattttatcttacttgcccaggttgagcttaaagtaaccaaaagtttagtagcaagttgctttctgcttggcagatcgctgttgctgctgctgctagtggtggtgggagtttgaaggataggaggagtatatattcaaagcccagactatagtattatgtcttctgaaaaattgaaaggaaactttctgcccctatagggatgacataatcagtatcatggcaaggagctctgggccccacatggtcttgtgacccatgggaagtccagaatgcatttgctgagagtgagcgttgttgaacactgcagtattcattgaaaggatcatatggttgactttctggaggtctttaagaacagtagattatcttatgtctgaagagacttgagtgcatgtcttccctgtcctcgctcatgcacttttttttagatgatacttgctttgtcattttgttaccatataggttctttttgtttatatttagattatcaaattaaatactattgtaattaatacataataaattagactatttaattttgactttttactttattattggctatgtttaagtgcctgtattgaacatcatctctctttttcttatgtagaattattttctgagttgagaaacttcttgagtttttgaaaaatggttggatgtcttctctttgtccctaaagttttgcttaacacccttgtctctggggtataagaccctggcactcagtttacgctcagtaaatgttcattgaatgaatgacagctcccctttctttcagactaacaggtgggcaatttgtgatcttttcttttgagagaaatgcatattttacatttactaccctagttagtattcctttccctgattttatagtatatttaaaggggatagcatgtaatttagcatttaactcattctttttttaaaaaggaaaactataaaggtggccgtacttactaatattttcagatgcactatttattttgtttagtttttcttactgtcttttgtctattgccatgttccatttccccacacgctaaattcacaaaagctactatcattggcactaaaacatctcaagcattgggcttgtgagatacatagttacctgaaaaaatttagaagaaagccaggaacactgtgctagaaggaactggaagttctgaagggcttgagtgccatattttattatacatctgttgatctaaactgcgactaggttctttttacctttgttttctacagttttaaccactactaaatctgggctttctgtctccaatctgcctctcttactgccatagcgtgtactcgtatggctctttatttaaatctataggccaggtacggtagcttatacctttaatcttagcactttgggaggttgaggagggaaaattgctggagactagcagttgaagaccaacctggacaatctagcaagacctgtgtgtgcaaataaataaataaatgaattcgcagggtgtggcggcatgtaccttgtagtcccagctactcaggaggatcaccacagcccaggagggcaaggctgcagtgagccgtgattgcaccactgcattccagcttgggcaacagagcaagatcctgtctcttaaaagagaaaaaaaagagtgtgtaggtactaaaaagactatcattaaatatatccaaaccagttttactgtcctatctctgttgtaacggccttgtcacattatttgtatgtgttaggcaatctggaagtaataaatgagctgttagttatgtttcaaggtcaatatttaaataatgacttacttgtaataactagttcaacaggtattttgtttgttgggtaggtactgaggtaataggatataagtccagggagctcacaggtcagtttgggatagagaagacaggccagagaaacatatcttcagtctgtgtgctgttttcacagaactgggagaacctattaggaaaagcctttaaggagataacgccagagctaagttctttgtttatttttatttttgaaatggagtctcactcagccacctaggctggagtgcagtggcgtaatctcggctcactgcaaccaccgtctcccaggttcaagcggttctcctgtctcagcctcctgagtagctgggattacaggcacctgccatcatgcttggccaatttttgtattttagcacagatggggtttcaccatgttggccaggctggtcttgaacacctgacctcaggtgatccacccgccccggcttcccacagtgctaggattacagacatgagccaccgtgcccggccaagctaagttcttaagaattagtagaagtagagagtacagaaatattttatggggacagagcatgtgaaaaagtcacagaagtatgaattttgcaaaacatttttttctactttttttcttttgaaaagtttgattattctttttttagttgacaaagtaatacattctaaagtaggccttttttttttttttttttttttttaaccctggacccccaatctttctaggatggatttcttgtgtattcttcgaaactgtctataccactgtaaggatatttactttttaaaaaggtggaatcatatacactttgctgtactttatcgtgtgctcaagtttttgcttttgctttttttcctctctcctacatagtggtctatcttggaaatctttggtgggaagcattcgaagaagggtttgacatgaaggagtaacatggtcagttccatattttaggtagccataacactgatggccatattttcataaaaatgaaagtaaagatgaaggaaggaaatatattgaagatgataatgactttaggaagagaagtgtgtctcctgtacccaacttgcccatcatcgtgagaaagctagtaggaaaactcttaagcctttgtactcatggattggctcacattagaggtgttaccacttccccagcaggtgtttggaaatgtacggttgttgtcagagtaactgaaggggctctactggcatttgatggttgggggccagggatgctaaactttctgcattactcaaaatggtcgtgtactgctttgacagactgagggtggccttctaccctgtcttgcgataagtagcaggtctgttatttgaggatgaataaaaacaaaaaacaataggagtctatggaatacctatataataaaggaatgggaacatcatcctaaagactaacaaggagagcagagctctgaacacaatttttatagaaaacaaaataaaacttaaaaaaaaatctggcagtctcaagaagtggcttttagaaagtagattgtaaagttttaaattccaagccagattcagccctgtcagcatgttttgtgtattctacacattgttttaagaaatttctcacaagtttgccagcatttaaaaatagattttaaataaaaattcggatatattgcttctcttgaaaaatcagatctttaagcagtaaggttgaattgcattccaccttaccttccatgtaagcttttgagtttgccgtccctgcaataacaagcaatgtgagggacaaccatgatacagtttttacagattgaacaataaacatgaaaataaagagaagaaaggtgtctgtgggactcttctgtatagagatctaatctgagaattaaataagactgagaaatgacactcaagtgtaaatcattctaagtttgattttaaaattgaatatatatatgaatatgtgtgtgtgtgcatatatatgtacgtatgtatatatctctttcccttttttattccctctccttttttgaagcagttaattcctaaagccattaggtgagcccaagcaaggtaggcatccacgccaaagttggggagctatagtggcacagagcagagtgttggaagctgaccaggttcagaaggtgtgggatggggaacactaccagtatggggtttcagagcccaagcagggtgagaattgcacccctgtggaggagtgactggcatgggatgtcaagagtgcaagtaggatgaggaaggtgtctacataggaagggtaggactaaaagaaaccagggctctttggcaggttccaaggctggggtagggaaagaacaggataaatctggaacttcttgttgggccagaaagtaagaaagtgctcaaagaatgatgaggacatgtccaaaaaacacaataatgtcagtaattgattatatatttataaaaaataggaaaccatgagggaataaataaatgaatacattgaaagtttgatgaagaacaggatatttacatacttccaaattaggtccctacaaaattttcattgtctacaaaagagaaacaagaatcatggtaaaatttggcagataacaccttaatccagtgatcaagttaacatcagcagtaatgaaataaaaatcacgtgttacttgataggatgcagcgagaacacagcatctgtgatattcttaccaaagatgtgtgacctgaatttgatcacaaagaaacaccagaggaacccaaattgaaggacattcccatgcaaaataactgccctgtaatcttcaaaagtatcaaggtcataaaagccaaggaaacactggaatttttccaaatcaaaggagagaaaagaaacatggtggctaaatatagcacacgattctgaactggatagtattgggacaaatggcaaaacctgaatggggtctgaggattaaatgttagtaatgtatcagccctgatttcctgattttgatgattgtcttgttatctaggaaaccacccttatattgtagaaattatatgctaaaatgttcaagagtaacagcatggtgctagcaacttactctgaggtgcttccagatttttaaaagtttttcttttttgtttttgtttgtttgtttatttgaggtggagtctcactctgttgcccaggctggagtgcagtggcacaatctcggctcactgtaacctctgcctcccgggttcaagcgattctcccccctcagcctccttaatagtggaattacaggcacccaccatcatgcctggctaatttttgtatttttagtagagacggggtttcaccatgtgggcctggctagtctcgaactcctgacctcaggtgatccacccgccccggcctcccaaagtgctgggagccacctgggagccaccgtgcccggcctcaggtttttaaaaggtacttggaacttttgaattgtacttgcaacttttctttaagtttgagactctttcaaaataaaacaaatgtttagaaagtaggaaaggctttgtgtacacaaagaaaaagtggcttgggatattttgctacaacatgccttttaattttagcattactctcattaatgctaaaattagcattagtattactttaattatataaacactgctggaaaaactaaacagtgtagaagtagtacccagtttgttgtaagtccctaagtcatagacagtcttcttaaatgggagttttgctggaaactattagtagtaattatatatgttacagtaacctgtgttaaataaatgtaaaggttcagttttgaagctgtaaatattttgtatgatgtttattagtacatgtggtcttaaaacaaagtttgaatatttggaattgcaaaatataatttaagactagacacagtaattttcctataaatttatcaataatttttgaaggtttttctgtttggctaattgatttgtttaatataggtcaggttaaaatagaagttttggtttcttctaagacgggatgaactttgcctgctgctaaaatatgtatcttcttccacttttcatatttaaaaagatagcctataaactaatgaatacaataaagatattatatataatgtaatgaaaactgatgtatataaaaagtaatttcataactagtccgagtctcaaattccaaatgaaataaaagaggaaaagggtgtctcaaagagatagaatttcagtcttaactttgataattagaaagcaatgtaggttaaagagtaatttttaaatgtattcactagtagaatttaaagcaagttacatgctttctaagccatggaaagtataaacgcaatcaaaacatagtctataagagtaagaggagatccttttgtagttcataagtgtgatgattgggtttgcacactcatatgtgagatgtgccttcctcaaaccttgttagggcattggcacattatccatttgagggagaaaaaagagtaaggggaaaaaacaaaggcaatatttaaaccagaaaatatttaataacatgggaaaatgcaatataactatatgcaagatgaccccagttttgtatttgtgttcatgtgtatgacaaatgttgttatatgtaaagagactaaaaaaaatcagattgagcggtttcctctatgagatgaaattatgggtgatttccattttctcctttaaacttttttttatatttaaataatatatatgtgcaaatatctaacatatgtatacaactcctaaacaaatgttctttaaaaattacaatatactgtgttctattctatgttttatatactgtaaaagatactctaaaatattttgtagtttttttttttcagtggaaaaatctgtttatttctaggctcattggtgggcagtattacttatgggaattgctctgatcatgctaatggctggatttattaagatatgcagtgttcatactccaagtagtaatccaaagttgcctcctcctaaaccacttccaggtaagaatatttgagcaagatacatatttatgtaactcagaattgtttagcaggtagaattgaattataaatgagtctgtagtaactaatgttacagtactttctccgtaagaatgggattattggatgaatgatttagttgatatttgtgtgctttttgtcaatccaatctggccagtgactgctaagttaatgctaatttatctgagtgtctgaaaatatttagaactagaaattttaaattttgcttggtatttgttttcttgtttttttttttttaaatatattctaacatattcccttgccatgattatggtgaactactttaaaattgttgatctttctattctaatagttgtgcttctcatattgttgtccttcattcctccttccttcccttccatcttccctccctcccgccctcccttccttctttttcttttttctttctctcactgtgttgcccaggctggacttactcctgagctcaagcaatcctccccactttagcctcctaagtagctgggactataggcgcgtgcactgcacccagctctcttatcgtttttagtgtttgtgctcttgaaatattttctggcacataagcttattttcccccagggtgatgcttgtggggacatacagatcccagtctgtgggaaagtcttagagtagaggattcattcatcaaataagcacagtcaagtattctccattcctgaaaacaactctttagttctggtctccaccttttacctctcagggagacatagcatgaggaagaaccctctttagatgagctgtgggcattggaaggagaaaaggacaggaaataaacccttcgtattgtttagttccctctgtttatccctccccttctccaaggtattcgtagctattctctacaggtgtgaggacagacattgtctcagggcagcagcaggggagagccagaactaaatgacagcagttccctctcctgccgctctcagacttctcataagatgtcttgcctcaggcaaatccactaccttatacaaagtagttcaaaactaggtttcttacactttttctctgttttccctcagttgttcacctgcatttacctgtctggggcaagatggcccagtagtcatgctaggacagtatcttagtgagagttagaggaaatttgatttttatatcattgcttttcttaagttcacaatgttagttagcactctggaacttatgttagtatttaaggaagttctaagggccacatgacactttttagatgctgttaccaattgtggtcttattcagtgaaacattttatgtgtatgttggtttcattttaagtgaatagcacctttaaaaacttagaaaactagctgtcatttattgaaccctcacaaaaagtgttaaacatttttatatgaattatataatctttacaacaggctatatacgttaattatcatccttgttttacagtgtaggcatctgagtctcaggttaaggcatttgctcaaagacacttagtaattccctcatatggattctgtccagaatctgtgatattaatctggattaatctaatacttgtggctgctgagcactgaattgttgctagtttccattgaaatgtgctgttttaattaacatacataccagactttgaagatttagtataaaaaaagaaatattttgttagtaatttttgtattgattatatattgaaatgataacactttggctatattaatttaaataaaataaaaaatattattaaaattatttcaccttttaaaccttttttattgtggctatcagaagattttaaattacattgatggcccatattattggacagcactgaactaaaacctttcttattgaaacagcagctttgcttttaaagattaaaaagctcatgataaataaatctgctttgcttttatttgtggctcacaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtgggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatac

SEQ ID NO: 16503 - DNA, 51621 bp, Human
  misc_feature (1)...(51621): n = A,T,C or G
gaccattccaagccccctccaatcccctctccacctcacagctcggaggatcttttcaaaactctaatctgatcatgtcgtatttctgcttaaaccaccttaatgacttacacttttagccctaactaccacttacaaggcctagtaaggtctgacccttgcccacacctcagggctcattttgcatgctgtactccttcactctctctggggccaaccacagtaaatttctctcattctttgagaggcatcatgctgtcccctaccccttacccccaaagccaccaaggactttgtacatgcactttcttccccacttcatgtagttaatcccatgcttctttctgatctcagtccacacatgacttccttggagaagccatcagagatctctccaacaaagtcaaatccttttgctatatttgcttatggaaatatggcccccatctttgcagcatacatctcagttgtgattttgtatttatgtgtgtgggattatttcacttacatctgtctgcttcactagactctaggctctgtgaaggacaagaaccctatgtgctcttgttaagtgcagtgcttggcacataatgagtgtgcagtaaatagttgttagatgagtgaatgggaagaccagagaacgctcttgcatgttattagctgtagtcacagtaagaaagtcctgtttctctggtccatccactgggacttggtaatggtgtggtcataggtaactcttctagacaatggtatttatgataacttcatcaggaattaaagccaaagtgctgaggttttgtcctggttctgcagtagtgtggcctcaggcaggttataactttttaaagtctaaattctaaatgtcacctacagatgagaagtctccttctgcctttggcctctcaccagctgctttctccatgtcctctcctccctccctttttgcaaagctaggggagggcctgatgcagagctggcttccctgtgggaggactggaaggaaccacacagcatggatactaattccatgagtccacattggtaatcagaaactaggcctgccttgctatttagaaactaatgctatattctatttcttcagataagccagttttgaaaaacaaggcttgaatatttggcaggacaaggagctactcccaaacacagtttcttgccagcaaggatgtcaatttatcaaattgaaagggtataacctaggagcctcggttaggtgtactggctccctttctcgtttgattagaatgacatacacgctaattgatctctttccggctcagtcatctccatgcagtaaagaatttcaagctgctattgtttatttcctatgtattatgtctaaatatttcatggtgaatgaagaagagtgactattttcaaactggaatgcttcttcagaagaaacccaaactggaatgtttcttcagaagaaacttcagaagtcaccaaaaaggtgactcctccatctttctgattcttggatcctaaagtatcttcagcaagtgaagcccagtttcataaccgaagaggtgactccatctgtcctacagacttgcagtgtgaagcttgcaatggtttctctgtatgttaatttctccatctctaggatggcctatgtggttcttactaacctcagagtggtatcatgaagccactgaaatgataccagaagaaaacaagagtgattaatcttctaggatgataaatctatattttcttcaaattcttcattttgcataaaaacctttttcagaaaagaatgttaacattggatatatctacacctgatttgacagttccaaactacaccccaaccacccacttctgaatgagaagaaaaaaaaatcagaagcctgcaattgtgtaacatgaaaatcttttctggaccagggcccgtcactgtgatttggcaacacaactggcacatctcttttctcatctcttgaaaaaaaccaacagagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtaagtatttcctgatttcctacattcagacccaataatgcctccctagctgccaggctggtagtggagagttttgtttggtttgttttatttaagttaattgggatcagattcatcttttccaggaagaaacaagttactagaggctgtttgactatttaggggttgtgatattaagttttcaattacctattgcatttacccacaaaagttgatgggaatggaagagaaggagtgagtgaagtgccttctttatttcaggtatttacttatactctaaaatggctttgtgatttaaaagtcagtcgttagtgttttcattgatcaattgatttgtaccctgcttgcttcctccaagcattggggtgactcagccacctggaataagcatcaatagtcaataaatatagttggcaaaaatatacatatggatggcaagaaacatctcagtatgacaagtacttgacaagtattgtgctgtcagatcacttgatttttaagaaattaaaaattgcactaggtagaaatagtgtaccaggcaatagtccagctttagttttgtgtcatttttggtctctatttaaagcaaagtaatctctaaatatctttggagatttacaagacaattacaagaaccttctagatataaacgagggacgacttctaagaacctcttgaggattgcccagagatttactcagctattaacaagagactggaaagtttacttaagtggtctgggctttcattttgctgcacgttctagcattctctgtatcctgaagttttacctggaaccaggccatttgtgaatagaaatgtattatcatgtggcaactattgatttcaactggttttttttatcctgcttaaggatttcctactccaggtataaataatttcattttccttaaagttatagagaatagcccataaactctgtgcattaaaagttctttgcttggggcaaatacataataatttagaagaataagcttggaatgcatcagctaagccaagaatgagaaacaaatgtgaactcaaaaaattgaactagtggaatgtgaagagagagtcataagttttctggtctctgagaaacacattagaccagattcgttacagtattttcagggagttacggacaatttcttgcactcctcatcttcccttggcattcattcctggctgctctgaccacactcactgtcataatgtagcaagacattatgtagtaagacattatgtaagtagttatttctaactaaaataaaagaaataaaagagagaagatgaaagtcagtgattcttatgattcccggtcactgcttactggaaaatctttcttagtgagactgagacccctctgtcatgttacttgacaatctggccccaaagaagcagttgtcaatacagagtgattacagcctcacagtgacgagtgagtcagaaaagtgaagcaaattcagttacaattcttagtgctctgcagaaaacagaggaggaaatgaactacacatctttttttttttttttttgcaaccaaaaagtttaaaaccctctgtatttcttaagaagaacctgtttcataatcccgtgctttctgtgttgaaagtgaaatttgctttcagcagttcactgttcaactggccttgtgtcttccccactatgcaaggtaggggctaaataaagaacatcttgatattgtctgttgaaaaattaaaacttgtatgttctggataaagccagtcatttcctgaaatatttaatttccatttatactatacatttattttctaaagtgaaccctaataaaatctgcaaccttgattatcatcttcagttttgttggagcttgtggggatgtataaacaaaaagttcctgcacaaacacaatttttttaaaccaagaaatctacatggttttgctgaaagtttatccaaagtaattttctgctttattagagaatgtgcattttgccttgtattttctagtaaaaagctttgtacattgataaggcaaagggaaggggaacatcgaaaagatggcagaggatataaaggactcagtctttcaaatatgtgagattgttttttttccgccaaccttgggagtctggttctattttttttccctcctttcaaaaactgctcttatggggagcatctcaaactaatctaacaccatggtataaattacgggtccccaacacatgggccacggactggtacaggtggtccctggtgctaaaaggttgggaacagttggtataaaggactgataaggcctactggtagcattaagagaaaagaaggtccatgaaaaattctttataaactacaactaaaaccaacaacaattaagtcataagccaaaaagctagctctaatttggccttttagtcattgggatacgtaggcctttcacctttactagtgtggggggaaagtttgcaatgcaaaaggctgatctcttccttgggctgaacttcagagaatctctagtcatgtctagtcatttctcacagggactatgctcactcctactactctatatattctcctctctcttcaaacttttcaggattctttgatacagagctcatcttattgaagatgctgaagtgaacaacccagcaagcagctgtatttcctcctgaggtggaaggacagctttccagggctggacttttgagtagataacatactgtgtagtcggacagatgctgaattcttttctcaccctgtcaagcttccgcattagaggtctaacttttggcatctcttagaatggaaaaaaatgcaagtacttctgctaaaagtagtacccttgatctttaccttcagtgccctgaaggaaatagaaagaaactatcctggaacacagactatggaggaaataggggagtgggcagtacaggaaggaggaaggaaggacagggatggttgattgtatgtgagaaatttcagacactgcagtgttcccttcttcctgctcctaccttccaccaggactgggtgagaaatcatccctccttgctggggtcacagagtttgtctctccattttgagaggattctcaatcagacatgctggttatagacactctagggctttaaaattattattacaaagtttgttcagatcttgaagtaggtctattctatcttagggagcttttgagacaaaagaatctatggtcaggatttagagtgaaatcagaaagtttataagccaaattaaaggaaacgtccactttgcagggcagaatccaggacaattttggtctagtacattatttggaatgcccaggtactggcaggagagctctgagataagggtgggcagatatcactggccctttttattggtggagaagctgagctcaggctgatgtaatcatgcatcccgggaatcagcccagagcccagttgccctgccctgggcacacactcgcccttggacttccactgtgctcttcccttgagcagcacagagtgttcgcttgtccaaattctcgttcctgtttgaatgtttcctgaagagagagaaaggagagcgatcaactgcattttgccagatggagagacaagtgtaacacaattaagagacttatcagcccttgaatgaaagagctgggcttggtatcttgactccagtcattccctaataccatcatttgatgagaattaactcctttcatgtgaaagcccaagcgaacttgacaaagtttacagtttaaaatacattagcagtgtcaaaagatgattttacagaacagacgtgatcgtggtggggatattttacaggagatctgctagcagagtcttgggatctcttcaccacctacaaacacattcaaacctcaggtaacaccagggttctgaggtggctcagtgatgtcttcagctctgataaacacattgaccaagcattgcactgtgtttttcctctagtatttctgttttctagcttttcctcaagaccactcttttggttcagagcaaaggacctataggaaagtgggcctcaagagaccccataacttctctgtcttgctttctggctcaacagccacctattctttctctgtttcctccatgcttggttcttctagcttgctattttacaaaaccatccatctctccaagtctagggtgcccaggactgagggtcacatggagctagagctgtcagttggccaacagatgctagatcagaagcccctactgtcagcagtgccctggattctgcctgtgggtggtttgtctgtccaagtcgtgcaccatcctcaggccctcgctcagaaactttggaataagatggtctctgttgcctgactcttgcatcattcaattgagagaacagacacccacagtcttgcagcattttatcaaaagctctttccaccacagcagaacatcagaggatgtctaccgtcagttttacctgcctcttgttattatgatttatgttcaatgctcagtccttcaaggattggtacttctgtacttgggagttctgtccctttaagaacgtctgaggttctaaatctgaacatgcagaagtgctaaacactggggattctccttagatccttgccttgaagcaagagtttaaagactcgaggctgtcttctgtcaaatatgatgacgaggacaagagagggcaaaggaggttaacactaagcatactctataccccagacactttgatccttaaactaaatctaaactaaatctaatgaggtaaagatactgctctcattttatagatgaggaaattaggacttagtatgtttaagtcacttgaccacaagcaagtgtgtggtggagctgagattagaatcaaatctctccagtttctcttaaccacgctacagttaacattctaatatatgcttttgaagttttactacagttgcctataagaatatatattatagttttatatgtttaaaaatttacatatatagcttcatagcttatacatcttctccaatttgagactttttcccagagacactttctgaaatttattaatttgggaacatgtatgactggtttatgtacccatcgccctctcactattgattacaatcaccaagactgctacattgaacatcttggtacatgtctccttgtacacatgttcacgagtttctctggagtatatacctagaagaggacctggtggtcctagggtatgtgcatcctcaactttatgtgtattataaaattgctctccaaagtgatttcaaagttgtacttccagtagcgacatgagttcccatttatcacatactcaaccatccttgatatcatccaacttttatattttgctaatttgagagagagaaaaatggaatttcactagtaattgtactcaattccagtgcagtgattatcttttcatgtatttactaaacgtttaggtgcctcttttgtaaattgcctgattacagcctctgcacctttctctttgggatactttactttttcttaattgttataggatatttatatttattttaaatccatacattaaggtattttgtgttttcttattgaggtttaatattttgcttttcatatttgtgtctttaaataattagaatttatttggtgtatgatgtgggattggggtctattatctatgtctgcaaggatagacaattgtcccaaggccagttttgactgtctatcttttctccactgattgtgatgacattcctatcatacacctgttcacacgcatatgtggttctatgcctagactattcagtgccattgatctgtttgtccaaacttgcactacctcatataccattttttttgttgttgagaacattgtttgttgttgttgttgtctttctacttttattaccaaggttatattagactcatgaaatgaatcaaaattttccctttttttctattttctggagcactttgtaaaatgggagttatgtatttcttgaagattactcagcatgtgcacgaaaaaagagagggatggacagatgacaagaaaaatttctttaaaagttacaggtctggccaggcgcggtggctcatgcctgtaatcccagcactttgggaggccgaggtgggcggatcaagaggtcaggagttccagaccagcctggtcaatatggtgaaaccccatctttactaaaaatacaaaaattagctgggcatgatggcatgcacctgtagtcccagctactcaggaggctgaggcaggagaatcgcttcaacccggaaggtggaggttgcagtgagctgagattgcgccactgcactctggcctgggcgatgaagtgagactccatctcaaaaaaaaaaaaaaaaaaaagataaaagaaaaaaactctactatacctgaggtgacatcctcttttcaatttttaaaaagaagtttgttttccatttcagtaatttctgctttgatcttccttatgtcctcctattgagttgatcagctttctttattcttgccttttctcctctgtgtgccctttctattaacgtatttacccttaggctgggcacaatggctgatgcctgtaatccctgcactttgggaggccgaggcaggtggatcacctaaggtcaggagttcaagaccagcctggccaacatggtgaaacctggtctctactaaaaacacaaaaattagccaggcatggtggtgtgcacctgtaatcccagctactcaggaggctgaggcaggagaattgcttgaacctgggaggcggagattgtgccaaagcactccagcctgggcaacaaaatgagactttgtgtccaaaaaaaaaaaaaaattacccatatatatatatattttttaacttaaagtaaatcaatttttcttctgaacaacacaaaaactttaaaaaattctaactccaatcaaccactctatcttacatgtcattgttgtctaatatttaaatttttccctcattattattgttgttactggtgttttaaaataaatatttttgtttgcttatttaaaaatgcattcctatcatttactggtttatttgctaatcattactgcatacacccactactttctcttgggttctgtctccttattcttgcagttcttcctttagaaaatttttcaggaagggtgtgtgacagatgaactttctcagtctttgtctgaatgtgtctatttcatgctcaaggttgaatgataaattagctgatacattttaggttgataattatttttgcttggcatttttcaggtgtctctgtcatttttccaatgcctctgttattgctgttcacaagtctctgggtctcatttttgtccttaataatctgaatttatctggtaactaataagagtttcactttgtttttttattttgaaatttcactattatgtgcctagaggtgaatttatttctagttcttaactcatttttcatcttcaatttaaagggttataatatttaccaattctggaaaattttcctctttattaccttgcctttcccccagtctgttttctccttttagaactcctactatattggtatgcatgttgactctgtcatttttttatgcctcaaccatttttttcatatttcttctcttattctcttaatccatgctgaattttgtatagttgctgtttgaaatctatctttcagttcaccaattccctatttggttctatctaatcttctgtttaacacgttcattgagtctttagtttcactatcttttcatttctatatgttttatttggttctttttttcttttagtttcttttcttgtgtgcttatttctttcatttccttaactcaccaaagcctaatatatttataatattttaaacctgttctgtcgtctcgagttgcgggggagtgaatcattctgcctattttatctactgactcttattcataaaggatcttttcctttagtgttttatacatctgtattataaattcttcagggagatttatttttccctgtgggaattccacgtggcctaaggtgtggatttgttcttccagagcaggtttgcatttgcttctgctgggttccccaggtataccgccagccagaaatgattgctgtggagtggcaaactgaaaagagaagcctgggggatgcaggtgcctgttgaagagcactctcccaaaagaacggcactctgtgacctttctcccaactgtgaccgtaaatgactaagagacctcgtgcttcctacaaatgaggccagctcttttgacatccttagactttgagtcactagcagctgagggagaattttcctacagacttccccctatcagcaatgaacgtggaggaccaggctcacctgggaaatcttacagtttcaaggcgcttgggagaaaagtccgttctggatcactgatctaagggctgcagactcctggagccaaacttgattctgccaaacaggattctgcttctgattgtgaattttaattttacccagaaaactcactgttttcattgactttcaaaggggaagtattttttttttctactttccagaagtgggtttcgtcagtttttctttagtgacgaatcccattgcaacatgttctcattacttgacgagaaaggaaaacatactaatgagagcagaagttggcccttatttactcatcagccctgtgaaagtgacctaacaacccacagatggttcaaatggctgaagcagttcaaccgtgaagaaattaggtgcccattatacctccagcaggcatctaatttcatgtctggggcaggattgctgagttcactgaaacttctaagcaaagcaagtgatttaagagaaactatgccagcaaagtgtgccggccctgccccttgcccttttctccatctcagtagcttggctggtcatgctaagatgtgagcctagaacagtcagtcaagaccataaacgacttgaaggcttagtccctctcagcgcacatgccttagagtctttctggaaattcaagctttcttatgagagtacctcccgaaaaccctatgcttctatcaacaggtgattggttaaaaaaatgggggtgcatctatgcaagactcctatttacccattaaatagaaggtttacatgctaatacaaaaatactctaagctattcaagtagaaaaagcaggcagaaatggtatgtgttaaataccctcacctgtataaacacatgcacacacacacacacacatatacatgcacacacacagaggcacatgcacactttttgacaacataccaggaagtattgatattagttacctgtggagaataatatttaaaatctggggttggaaggaaacacatttcttatattttatagtatacccttttgaaatttaaaaacttgtacatattcatatgtattttcttcacccccttcctccccatgagagagctcacccagtagagtatgtcttttcaaagcatttttgtagggagttgctcaaaatctgttctgaaaaacactagttccaaaagatgcaaacaagaattaagtgaaaaaaatacatgtggtccttcccaaatatgtttgggaaacactgggttaaaccaaaataagcagttttctcaactgcaggaattatcagagcctttaatgttctctgtaaatctctaagaggggaacagaatgtaaagctgtcttcagctctacttaaccacaaaccccttttttgaggagcatctaatggaactaatgatctgtgaaacatactttgagatttgcagaccctggaaacacatcagtcctcagaactcctccatatgcagagatctcccaggttgagagtgacaagaggcggccttggcactgttgggccctgtgggtagagggagaactgtcctcagcaacccccactcacacacagcccactcagagtcacagttatcctgatgcaaacacaacttaattaataaatgcttcattcatttcttattctggtccttgggatggtgatcaagttcccatccaggtcagcatttgggatgagttgagggatgtgaatgcctggtgaggtcagaaaaggagagcattgttcttttcagcccagtagagatagtggagttcaatcacctctcctttctgagctctgagttggttcttggtgcttttttctacttggagagcactgaggctggccatgttcccattcacctggctctcaaattgcagattcctctctttttatgagcctgccctaatatcgcctcttttcaagtacagctggttcttgggtgattgacctcttcctgatattctgtcaggctgcatgccaccacatattttatttttagccagaagatccaggtttcagtcttggttctttgtgactgtttttgttatgactgagaaagttttattttgcaattggaaaactaactgacaggaaagctgtgcataaatctgtactctgtgctaataaaggaaacaggctgacccacagaggcagcagcagttgtcacaggaggaacactgggatgggaatgaaagaatctggctccagattcagaaactgtcacctattagcaatataggtcttgtatcaagtcactcagactttcagtttttaactggggatgaagtattgggaggactcacagaagtaaagtgcgtgagagtgcctcaccatggcgcaaatgccatgtgaatgtttcctccttcacctattgctggtcaaaatcatgtgcagtcaaaccttggccccagcacgtaccacttatgggaatgtgagagcaattcttttaacttctctaagctttggtttcctagtttgtaaaatggagacagaaagagagccttagtcataggtcattgtgaggactgatgggctaatgcatggaaagtgctcaactcacaaaatttactcaatatagattagttgttattggtattattgttatcttcatatgttcaaaaggctatagtcacataagctgaataggagggaataaacaggtggagtaggatggatgggggacttctctaacacacacctatagcacaggctggagggccaaggtttgcagagagtgctgtgctgacagattgccatggattctccttcctctccagttacaaacttataggagcagggaagcctctggtaagccctaaatgactcccttctcaagaatggggattgtgttttttggaaacactatggccaccaccttagacaaagttttgcctataggcagtccttcctttgatggtagccacagatgctttctccaggagctaggactgcatcccagcccaggtgtgttatcaccatggtatctgcaaggccaggaaatcactggcaccaaaagcttaatggtttcctcttcccagaccttaagacaggagtcaacagctccaaaggtaagtgagaccgaacaggcaacacatatgagtgatgtgggcatggtggggttgcagggaaatggatagcgtatgccctgtctcagaggggcatttgccattcagacccactccactgtggccttaccccattcttgcatcaggagtttcaattacttgagctcaccacagcctgatggaaggtagtcgccatcgcaattaccttaggcatatacttcaccctcctacaagtttcagaatattccaaggccccttttactatctctgatggaatttatggctcaacattctttatagccacaggctttcatggacttcacatcattattcggtcaacatttctcactatctgcctcctctgccaactaaaatttcactttacatctaaccaccactttggctttgaagccgctgcctgatattgacacttcatagatatagtaagactattcttatatgtctctatctactgatgaggatcctactcttttagtataagcaataccattgacttccaatcaataagctttgataatatttgaaaaagagtaattagctttacactagccctagtgaccgacaccttactagcaattacattttgactcccataacttaatatttatatagaaaaatccagcccttatgaatgcggatttgactcattaacctctggccaccttcctttctctagaaaattcttcctagtggtcaccacatttctcctgttcaacttagaaattgctctactactgcccctgccatgagcccttcaaacaaacaacctgacactaataatcagcacagcccttatactaattatcattttaatcctaggcttgacttatgaatgaacccaaaaaggattagactgaattgaattggtagatagtttaagttaaaataaatgatttcgactcattagattatgatagactatatttaccaaatgccctttatttatatcaatattatattaacatacaccatagcattgctgggaatattagtctatcaatcccacttaacatcatccctattatgcctagaaggtatagtattatcaatactcattataattattcttataactttaaatatacatttcactctagcatccctaatcccattagcctcctattatttgtggcctgcgaagccacagtatgccttgccttactagtttcaatctccaacacatacagcctagattatgtacaaaatctaaatttacttcaatgctaaaagttattattccaacaattatactgttaccaccaacatgactctgtaataactccataatctgaattaacataactatccacaacctattcatcagcctcattactatatcttacccaattaaatgataattcatctaacttctcactaactttctcctctgacccactaacatcaccccttctaatcttaacaacctattacctcttgtaattctagcaagccaacatcacctttccaatgagtcacccccacagaaaaaactctgtaatagttctcttcccctacttatcacacttacccatactcaaaataccttgggttcactaaacataataataataataatatttaccacccaagaactattaacttcctgatctaataatcttatatgactagcatgtattatgactctcatagcaaaaatacctctatatggacttcacctatgactccccaaagcccacgtggaagcccctattgctggctcaatagtacttgcagaggtactcctaaagctaggtggctatggtattatacggcttacccttaccctcaaccccctaacagaatatatagcctaccccttcctcatatccttatgggaaatagttatgacaagctctatttgtctatgacaaacggacttaaaatcactattgcatattcctccataagccatatagcacttgttattatggctattctcatttgaaccccttgaagctttacaggtgcagtcacccttataattgcccatggagtcacttcatctttactattctgcatagcaaattcaaactacgagcgagtccatagccgaattatattacttatctgaggccttcaaacactgcttccactaatagcctcttgatgacttttagcaagtcttactaaccttgcctttccccctactattaatttaatagaactcttcatcactatggctttattctcttgatcaaacatcaccattatgcttataagacttaatatactaattacagatctttactccctacatatactaatcacaacacaatgagggacacttgtgtattacattaacagtattaaatgctcatttacacaagaaaatacattaatacttatataccttgcacctatctttctattatccttaaaccctaagattattatggggtttgcatactgtaaatatagtataaccaaaacattagattgtggatctaataacagaagtctgaaacttcttatctactgagaaagtatgcaagaactgctaactcatgctcttattataccactattataaaaacactagttcccttaatcttaccaattattactaccttagccaacccctgcaaaaaagattgatacccatactacgtaaaaatatctattgcatgtgtctttattactagcctcatccctgtaacaatatacatattcatagatcaagaaataattatctcaaactgacagtaacaattcaaactcttcaactcccactaagcttcaaactagactacttttccacaatatttatcccagtggcactatttgttacctgatctattgtagagttctcaatatgatatataaactcagaccctaatactaatcaatttttcaaatatttactcattttcctcacgataatattaattctagttaccaccaataatctcttccaactttttattggatgagaaggtgtgggaattgtgtcttttttactaattggctgatgatatggccgagcagatgctaatacagcagccctccaaatggtcctgtataaacgattggcgatattggctttattttagctatagcatgattcctcttattttccaacacatgagagcgtcaacaaatatttattctaaatcttacccccaattcctttccactaattactgttctcctggcagcagcaggaaagtcagctcaatttggccttcatccctgacttccttccactgtagaaggcccaaccccagtttcagccctactccactctagcactatagttgtacagtttttctacttatctgcttctaccctttaatagaaaataatctatgaatccaaacctttacattatgtgtaggggcatcaccacattattaacagcaatttgtgctctaacacaaaatgacatcaaaaaaaaaatcgtagcattctccacctcaagccaactaggccttataatagtcacaattggtattaatcacacctagcatttctttatatctgcacccatgcctttttaaaagctatatatgttcaggatccatcatccataatctcagtgatgaacaagacatctgaaaaataggaggactattcaagactctactcctcacttcctcctcccttatcattggcagcctcacacttacaggtatgcctttcctcacaggcttttattctaaagacctcattattgaaactgcaaacacatcatacaccaacgcctgagccctttctattactcttatcgcaacctccctaacagctgtctatagtacccaaattattttcttcgctctgataggacaacctcgcttcacaactgattattattaacagaaataaccctttcctaattaacccaattaagcacctaataatcggcagtatcttcgctggattcctcattaccaataatattgttcccacttcatccccctaaacaactatgccacttcgcctaaaactcacagccctaggtgtgaccaccttaggcctcttactagcaatagaactaaattttataactaataaccttaagctaaagtatcaattacagacttttaaattctccaatatactaggtttttactcagccaccatccactgtacagctcccccaactcaagtctatttacaagccaaaatctggcctcacttctactagacataatttgattaggaaagtccataccaaaaaccatttcacaaactcatataatcagcctccattaccatacctgccccaaaaggcctaatgaaactctatttcctctccttttttattttacctcttctaactctaatcttaattacctaatcatcaccctgagtaacttcaagtgcaacataaatactgacaaataacgttcaaccagcaactgccaccaatacccgtaactgtataaagaagctgcaccgacagaatcctcacgcaaccacctcgccccctcaccctcaaatattatgcaactccatatgctattaaaattaattataatgaccatcccatcatactcattcaccaaattaacaccaactctgttaataatcctaataataaagcccctcaaatgtcaatacttgaccctcatgtttcaggatactcctcaaacaaccattataccacccaaataaattaaagactattaaccccacgaaagtcccaccaaaattcaacagaataccacaacccacagcaccactaataattaaccctatcccctccccataaataggagacagtttcgaagaaaaacctgcaaaccctataactaaaagaatacttaataataaatcataagccattattcctacatggactataaccatgactaatggtatgaaaaaccatcattgtatttcaactataagaacactaatgaccaaaatatgcacaacgcacctgctaataaaaattattagtcattcattcattgatcttcccacaccatccaacatttctacatgatgaaactttggctcacttatttgtgcctgcttaattctccaaatcactaccagattatttctggccatacactacacatcagatcccttaactgccttctcttcaatcaccaatatcagccgagatgtaaactacggctgaataattcgttatcttcgtgctaacggcgcttcagtatttttcacctgcctcttcctacacattggccaaagcttatactatggttcatttatatttctagaaacctgaaatattggtattatcctgctactcacgaccatagcaatagcatttataggttacgtactcccatgaggccaaatcttctgagtttttacacacctattctacaaacctgctatcagccattccgtatattggaactgaccttgtgcaatgaatctgaggtggattttcagtagacaaagccacccttacacgattttttgccttccattttatcttacctttcatcattgcagctttagagacttttcaccttttgttcttacatgaaacaggatctaataacccttcagggatctcatcagaccctgacaaaatcactttccacgcttactacacaatcaaagatattctaggcctaattctcctcctcctcttcctaataattctagtactattttcacctgatctcctgagctacccagataattacactttagccaaccccctcaatacctcgccccacattaaaccagagtaatactttttatttgcatatgcaatcttatgatccatccctaataaactaggaggtgtactggcccttatatcttccattcttattctagcagttatttctatacctcacatgtctaaacagcaaagcatagtattccgtccactagtctcacactcatatgaatcggagggcagccaatcagctacccttttattatcatcagacaaacagcatccattatgcacttctcaactatcttcaccttacaccaattaccgccctaattgaaaacaaattactcaaatgaaactgcccttgtagtataactcaatgctccggtcttgtaaaccagaaatggggaattccctctccaggacaactcagggaaaaagcacttctgcttcactgtcaacacccaagctgaaattctaattaaactactccttgtacgtttttcagcacacactttaactgctatgtcagtattaacgaactaatactaatacattagtgcttttatatacttcatgcattactgttaatcccatgaataatatattgcactataattgtttaatcatatatagtacattaatacattaaagtacatcaagaatataatctgcatacatataaccacgtattaacaatcccccaatcaactataacacattcaccgtatcaactgtacaactcaaactaagccaacacgaatatcaacccatactaaaaatccttaacattacatagtacattaaatcattcatcgaacatagcgcatttcagtcaagaaactccttgtcaacatggacataacctcgcagcccagtaaccacagactgggcaggaaaactgcaatcccctgtaaatagcatgcagtttatatagcattttcacttaacaccctcctcttaatgactttcacctggcaaccttcatttaactcaaaactcagggcctcattcccctgtacagcccatgttgcatggaactggccagggttcatatgtttatcatagacagggaacaaatctctaggttggccacttccagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcctcctaaggggattaaatgagtaatatacatatcacatatatacgtgtgtacaaacacacatatatatgtgcatatatacacacaaatctgttgatttaaaatgtgttgccacagatgctcttttaatgcttacttctgtttttataaatatttgcatcatttaatgacaaaatatctacttgaggatatttttgattaataatttaaatgtgttcctttcctatatccaagaagacctgcagcagggtacaaggtaaagcagtcacacagaactcatgttcttgggtcatgttgctgctgtccacatagtacggagcaaatgtgctctgaactggcaccactggatttgcttcccaggaaaagtctttgaaagaacaataatgaatacataccatctgggtgagacttggaggtattggggcattttagaatgtccacctggcttacttttttgactttagctaaataaaatgtaataaagggggcaggtgggagttgggggaactgttcaactccctggttagtgcccccaaatgctgaccagtgccacagaaacccatgtggctgttgggtgtggctcatccgtgtggaaaaggccccttctaggcccatactcacttccagtgttaggcatgtttaatcagcgttagcggggagtgtgcattgataaccacaaaattggaagacactatgaggagaggagtgtgtgagagagaacaagagaggaaagggtttaactctacctttcactctagttttctaccggtgggtgcttgatcatctaacggaagttgtctgtgcaaggggagctagaaatcaagtgagcagaaaatcgattttgcataaattgaaaaagctggagataatcaccaaaatatctcagtcatctctgagaaaggaagggaaattggagctgaaaaggattttcatttctaggtccctgagaagctttgatgacaaggcacaagtgttgtatattttctgaactagggtgaccatacttattgttaccagaaaagcacttgtcctggtaaagaccaggaactataaggagacaaatagcttcatcctcagccctttctctttggactgacacatctggtttacaaatgaggccatttatactggatagattgggaacagatggctgctacctggggtcttcaagtcctcaccttcccagacagccctttgcttttcaacatgcagatagaaaaaccgatgcccctattccacatcctatggaaaacctagtatcctccctgaagatttccatggattcttgggggcattggttgcatctgatgacctcttgttccatccagtgtgtgacggctaaaagttcgggcctctgactaaaacagacctgtgatcaaatcctggttctctctccttacagtgatgtaaaattaggcaatttgctttgatctttctcagcctcaatttgctcatccatgagatggagataatactacttacctcccagaatgttataactgttaagttaataatgggatagtgataagggaatacaagtaaagcacttagcatgcaacctggcacaaagaatgaactaaatagagggtagctggtattcctttattcacactaccctaaacagatgagtcaagatggtaaattttttgtacagtatttattccaaagcgcatgacaatctttcccaaggagatccttttaactttaaaaattttcaagaactctatacactacaacattcttttagtattcattaattctgaaaatacaagatcacaaaaggtagatagaagacatgttattttttccatttttggacaatgtttgatgcacacaaggaatcacagacctcttgcggtaattctaaggttccctggtggtccctggccccaggttgcctgcattcacaaacacttcactacggaattcctaaacttcattaactactgcttttctgaaagggctcagttcttacatactcaccgaacaaatatttattgagtgtctgttatgcaccacatattctgctaggactatcttgttttacactttaaaggacataataaatataaaagagatttgagcagggttacgtgcaataaaacctgtgggctgattattccctctctccgttcccggcatttcagcttgtgataatcacttcaccatgtcgggttttacattgtgtccaataaacagcttgtcacaggggtcatggctcagttgagaactgcccagcagtcccacttggtatttcttagaaattatacctcccacttttcacatttcatatcctacccccaaattaagttgggttttttttttagtaagattcccgtctatttatcatttccacattgtttaaaggaggattattcagggtagttttgcttcctgcgcttctttttttattcatacataacagatgtacatattttgggggtacatgggacattttaacacattcatataatgtataaaaatcaaatcagtgtgattgggtgatccattgccttaaatatttgtcttttcattctgctaggaatattcaaattattttcttctggtgactttgaaatatacaatacattattgttaactatagtcatgttactgatctttcaagcactaggtcttatttcttctatcaaactgtatatttttacctattaatcaacctttcttctttcctccgccctttcttgacctctagtaactacccatctactctctgccttcatgagatccacttttttagctctcacataaaagtgagaacatttgatgtctgtctttctatgcctggcttatttcacttaacataatgacctccagttccattcacattgctacaaatgacaggatttcattcttctttatggttgaataatgtttcattgcgtatatatgccacattttctttatccattaatctggtttgtgggcatttaggttgattccatattttggctattgtgaatagtgctgcagtaaacatgagagtgcagacagctcttcaacatattgattttatttcttttggatacatgcccagtattgaaactgctgaatcgtatggcagtcctgtttttagttttcttaggaacctccacactattttccatagtggctatattagtttacattcctaacaacagcgtataaatgttcctctttctccacatccattattccctttttgataaaagctgttttaactggggtgagacgctatctcattgtggttttgattcgcatttctctgatagttaatgatgcttgagcatttttttttttcatatgcctgttggccactttctgtcttctgagaaatgactactcagatcttttgcccgctttaaaatcagattatttggattttgtttgtttgtttgctattgagttgtttgagctccttatatattatggttatcaatcccttatcagatggataggccaaactaaattttttatcttttcctgctttttcttgaaggcagagaaatggggtttcttttgtgcccttgcttaagtttagatattttaatatctttcatcaaatattattatttaagcatggaatataaagaattagggtaatcactctgtggttctccccatgtatacatgttaaataaatttgtatggttttcctccaattaacctgaaaaaaaaaaagtacttccctggtggacattatagtttttgggggtggggggtcggtgccacaagacaaggtggcaggtatataataaaatggcaatgtgcagacgtgatagagtaggcacagaaagccaatgagggcttttgttgtcagagaaagtcctatagagaaagcaggatttcagctcatcattaagaatagattgggtttagttggggaaggtgcaaggaaagggtgtttcttctgaaaggtgcagcatagcagatgtgcagggatgaaaataagtgtcatcagctcaaagggctccaagtgactaggatgtcagcatggctgatgcagaagatctgtgctaaagaatactggaaaggaaggtggctgggaatcatgaggtaaggcaatggagagccctgaggaccagcttgaggactctgggctgacatttcctgagcaatggggaggtggtgtgtggtgcttcatctggcatggtctctggatggggagagactggaggtggggacactgattggaggctgcagatgaaggctctgcaagatatgggaatgacagactatgggtggccaagggagagaaggggaaggaataacaggtattaataattccagaatgtttgctctgggtaatcgggaatgactggaggagttcccaccaattaaagttttgtaggaattctgcctttcaaatgtctttcttccttttccaatgaaagtcttttccttcttccatgtatggaacctgatagtaaaaaaagcatttatctttctattttctagcattgctttcctacaaaaagcactaaaatcctgccaattatgaaatggcccatcttcagagagtaatcataaatagtcaaaacaacttgaagatcttatcagcttcccgctttccctctctcaccaaaattaaaccccatgactagcaatgaaacagcaagtatttcaactagatgtatttgttatagatgtcttttctcctctgtttttattgccaggcagcaagttagcagttaagtccatgggtctgttttcttaacctattcaccctgaactggaatttttgagtttatactaaaaacaataatatcctacccttattatttctctttgttgtttaaatattgccttcattaatgttatctcatttgattctttatcaaaaagccatatgattcaaatctggcacatatcattattcccctttaatatatgagcaagctgagaatgagaaataatatgttcatttacattgccaacaagtgtcatccctggaaataatgtctaggatctgttattcaattacacccaatatactagaagctgttacagagaaaaaaaaagttcaacatattatcttgaaaatcttcttataaaattgagaaaatcaggcataaatatgtaaacagttaaataacattccatggctaagtgtcccaccagatggcaatagaagccatgagtcagaaggtacagggttaattaccgtgtcataatgtgatacacaaatatgggaagactgtgttcatttctgggctctgtgttttaagagggacactgacaacgtagagcttacccaggtgagactcactgggagtccgaggagacgcagagatcaaagatgaagggacaagtgtccaaacgaagagagaaccccgggagggcattatgcccctccacttattgcaatgcctggtatgtgaaaggcttattctccttggtcccaacagtatgcctgtggctaatgaacagaaattacaggaaggaagcctccaacttcatgtaaggaaggatgctccaaccacaggaacaatgaaaagtatacagaacaagctgcctaatgtggtaatgagctccctatccttaaaggtgatccattatgggttaggtgaacacctatttaggatgttgtagggagaatgcctgtatcacatgccttctgcgtgctgtcaagttcagaaccagcaaaatggtataactgagagatggcatggtgcagggtttaagagcacagtctctagatcctatatgatgctcagtcttggaactcagcaaccatattgtaaagaagccaggccccacggagaagccatttgtaagccccagctaaggtatcagaggacagtcaacatcaaccgtgagatgcatgaatatgcaagctttcagataattccagtgttccacttttcgagccactccatttgataccaagtagagcagggatgacgtgccaccccaaaccctgcccaaattgctgattcataatcaaaataaatgctatcatttaaagccactaagtttgggggtggtgaattcttcagtgctggataactgaaatacaaagtttgtgtgatattcagagttaccattggtcttcacatccattaataggtggtgctgagtcaactagaaggtggtgttatgtgcagaaaggcagttgggtgggttgtgccgatgagagaagagaaggcttggtgaagctattgagagaacatgaataaaagattaatgaggaactttgaagacacagtgaaggacacagtgaaggctagatcttcattgtgtccatggttttgtcattccctccatctcctatatggttttgtgacttttctaattcttcttgaggaggcagctagattgagcaagtgctaggtcctgtcaagaaggtagaagaaatcttaaaagtctgtaggcctgcagaggaggagtgcgtggtggacttcagaagcagaacacccaaggggacagaataaaatcaaagagactcacatattacagaccatgatacattagaacatccacaatgttaatatggaaaggaacccaagagattgttttctagataatgaaatcaagattatgcacttggaaggtaaataagtacttattgtagagtacaaacgctacaattgaacttcaggggagaaatattaggtttgttgagaagaatctgaatggacgacagacctaaaaatgctttctagatagggagaccaggaaaatcaagatagggtggatatgataacgggctgtttttgagtctaagaagggaaaggtacggcagttcttgaaggtgagatcagggaatcacgatggaactttgtatcatcaataccataaaaaacagttctctcatttttggaggaaaaaaaatacactgaacacacagaaggagagaaccagagtgggtggccagatctccagcaagcagcccatgatatattagaatgccaatggtctgctgtcccggtgctctgaatacaggcaagaggaggcaggcaagggaacaaaccaggaggcagttacctggcttcctcgttgcttttcaggctacaataaaacatttctaaattaagatgtaatgctggaaatctgggctccaatcttctgagtggcgattctgatgagggtaactgaagtccccacattgctcatcactcctcctatttcctgcagcacacagcattgattatcctcctaagaaaagccatttcagcatctagagtggaagaggggagtattaatcatagtgaaatttgacaaggcagaagcctccacggacccacttgagccatttaaagcttttatgtgccctctagactggaacaagtgcatgtacatcaggaccataaaagaggggagacgcttatttagaaagcattaatagctcaggactggcctctctcttttgcgtctcttcttagccctggttgtctaagtcaagtcatttcagctgtcagtattgttttattcctcattttaggagatactactaaaatgtcagttcacctggaagttgtgcccagagcatttaattggatttacattaaaatgaaagaaatatgccaatgtggttttaattccaacagttattataatagataaggattctagaaaaaataatgtcaagtctaggtgaaattgttaggctataaaatggactcaggggatttttttgaaaagagaaaggggacatgttcctgctgtaactgtatttaacattcagcgtagggtacaaagctctccaccttttctctgcttgctaagacaagtggatgtatcttagaactggggactagaagggacatgaaagcatcatctacgtaatttctctgctgtcagagaaatcattctatgtgtattaaatatctcttgtttgtaacttattctcctctaaaggacctcacaaatgagccctgagggagctgtttagaattaattcatcacaataaaaaaattgtctttgtgcaacctttcatattttagttttagactcttccattttcagctctatatgaaaagactcaatagtaggttattatcttcctgataaaaagccttcacattgttaatctctttttccaaaaatatatttgtttctgaaatatttcctcatatgctctcttttcctgcccctaaatagtatgtattgctcaatgccaagccctccctcaagttaattgctcttttttagttataaaaccccaactggagtccatctaatcatctaataattcctatacttatgcctccagggccacactagctttttaaactacagcatggtgaaagctggtggtcatttgctgtctcattttcctaccaaacttgtatgaaattgttctgtctttcccaagaaccgtccttcaccaagtatttcttcaatggactgtgattaaatggttttaactgattattcaatgaatatgtggggcccatttttttaaaaaaattagaaaacagatgggttttaaaaaagagaggatatactatgaaaagttctcttccaatctctgtcccagtcatgtgctcccccaacccattagggtctaaccccatttctgctgcttgtgtattcatggagagagatcatgtacataaaaagaaatgcatgtaatgtatttaatacaattggcagcacgttttagcactgctctgcatcttcttttattttaataatataccttgggggtctttccactttggtatacatggatctcctttattctatttttttgtttgtttgtttctatttttttcagtagactagcagtctactgactggatgtaccatcatatatttattgcaaacctttctcaatatggatttcattctccaaaatatcctctaccagctgaagattgtggaagactcactatcatacttcactgtgcaactgtttgcagaatgcttactatcagcacagcactgggcttggtgccagagggaatacaagaagcagtgagtttggcagcctctgctccctaggaaactacagccccatcagggagaaaatacatgagaataagggggtcctgattgccaaatctatccccctaaggttttcctttgttttcttgtacatcagacattttttctaatgcatggtacaaatggcctttcccctttattggatgtgtgtatggtggtttgtgtgcctggtcctgcttttatactgggagccacaagaacagaactgtcaaactcaaatacctacagaggccaggagggtgacctaaatgagtgaagggtagagaagtgagccagttgggaaggcataagctctgtttaaagggatccccaactgctactgtgctcgattatttccctgtgaacaaccagatcttttggttgattaaaaggaaccagtgggtaacaggtacatgggacttttctgtattatttcttacaatacatgtgggtctataattatctcaaaataaaaaatttaattttaaagaaaatcagatacctagatcattgtgtgaaatgtcctgatttataaatgtaggcaaaatctgagcattgtgcaggtgcagcaaaactcatctatctgtaagccaaatgcagccttgggtccaccattttgctatctgtgtatagctgaatcattataatttgatttgtataaaacccaaggcaacccaatccatgactttgctttaaaaatacttgctactgtgagtttccattacttttgacagtagccatccccacttacctgttgagttttcctctcattccaggtccttggatgtggctgtgttgcccaagctattctcagtcgaggacgttttggaggggtcatcactatcaatgttggattttcaatggcagttgcaatggccatttatgtggctggcggtgtctctggtaagcagtagaaataatgaatgctgctcttaattcagccactccaatgtgcccgcacagtgctggctgcttcacataccttaatttacttatatctcaaaaatcctgcaagagtgtgtattggatcccatttttatagataaaattaaaatcaccaaccaatggtaagtaacttattatgcaaaggcaacatttaacaagagacagaaatgggggttagagctcataaattattcattcctaagtctggccgctgcatcttattctccaccagtcaacgggattttttacttgctctagtccacatttggaatccaactcccagataccctgtaaatagcccagtgaaggtcactccaacagaggcaagtcctggacctttatctatagcaaacaggaagagtctgggtctcttgcaaaatggatggtgctttcatggacgtgcagatctgatctacaaggtcttagtctaatcctgctctgaaaagtaaactgattagaagccattcacatggttctcaaaagcaaaatgaaatgataatttaatgcagtctgggcacttaggaagcgactgtggaaatgatctggttaccaaagacactcagaatctttcagcagcctggtgtgggtcctcagagcattgagtcaagacttggtgagaagagaagaaagggaactgagaaaccatgcatgctgagcactgtgctaaatgccagactgcctttatctccctctcctttacaacagcactctgaggcgggtattactgtctccattctacaaagaaatccctcctgagagggagtcagtaaataagtggaagccctgcagctggtaaagaagaagagctgagatttgatccaggctcacatgatctgcatgacagtgaagctcacatcctcattttttgtttgtttgttttttgtttggttttgtttttttttaggagtcttgcttttctccctcaggctggagcacaatggcacgatcttggctcactgcaacctacacctcctgggttcaagcgattctcccgcctcagcctcctgagtagctgggattacaggcacacactgccacacctggctaattattttgtatttttagtagagacggggtttcaccatgttggccaggctggtctcgagctcctgacttcaggtgatccacctgccttggcctcccaaagtgctgggattacaagtgtaagccaccgcaccctgcctgttttttgttttttaagacagagtctcactctgttgcccaggctggagtgtcgtggcaggatcacagctcactgcagccttgacttcccaggctcaaacaattctaccttctgccacctcagccttccaagtagctaggactacaggtacgagccaccacacccagctaatttttgtattttttttgtagagacagggtcttgccatgttgcccaggctggtcttgaactcctggactcaagtgatccacttgcctcagcctcccaaagtgctaggattacaggcatgagccaccacacccagccaacacatccccattcttacacagcatttacaatgctctattatgagaagggcattacaagcaggttagttgggcagaggatcctgcagttaagctggctggcctcctagcaaacactgcctttgtagcactgaagaacgattgcttagactccttgggagctccttgggctgtgcatccggaatggccattgaccagctggcaccctttccatattacagccagactcagatccaagggtcgtccaggttaagacagagtcccactctgttgcccaggctggactgtgatggtgggatcacagaactttgcaaccttgacctcccagattcctatatatgtgatttgttagcatgcacagtgtctccattcaaacttttgtccagcttttgctgtgatcccagcactctactgcttaactcaaggcaaactccaagaagggcacaagaaaaaccaggggactgccctaaatatcccgaggcttaactgctccccctataagctcccactgagttcaccaggtaatgtaggtgtagccatattttcagcctttttttaggtagagacatggttttggagtattttgcctgcataacaccctgaactgaacatcatccaatagttacttagaattaattggccccagaccctaccactgctgttaacacccttcaccactgcaatccatatctgtttctgtccattgatatacctggggatttctgcagtcactgtaggaggaaaaaagggaaagaaccagcaggaagaagaaggagtgaagaaaaggtgtgaagtcttctgtggcctctaaactggggttgaatccctatagttacaagagtaagggccaaaactgatgggacttctttcagtagaagctgtttctgggtgagagtcaggacctgaccaaaatgtttacaagcaactatgagaccctaaaatacaaacagagtggtgtctgagactggctggaaaatagtagcactggcttggaaaggcagtccttatctttctatctctatttggaatctagcacagttcaggctccctaaggactggtggctttgggaacattttgggaacatgcagcacaacacactggcccatcatgacatctgtgtggacaacagcatcagtatcagctttggcaggtgcaggaataggggaagattgtgtgtgggaggtgactttctcatcgtggctgcagctaacatactggtttgtgggcacatactggcttgtaaggtctgcttgaagattccaaaagtaaccaatttatactgagcataaatgtgaatgggatcctattttgtggtcaccgactagtgaggtcagcagatatttgtcttttaaatataaaacatcaccttattgtaaagaagttacagcatcctgctcccctgggaatgttccagtcaaatccagtcagtcagaggtcataataccctaattatgtagcatcctgcacaaagcatttaggctgtctaatggcaattgctattgatgtagtattttatgactaaaataaacttattgaaaaagcaaatagacttgctttcattacaaaatatagggttatcttgatcacaggattgtgtatgggtggcgaggaggagaggatttgcatagaacagaacactgaaggggttccctctgctcacctaagactttcatcttgtgccctgtgggatccagctgtgcccgcgggccctttatgtgaataatctgattgtcccagcaacctcggcaaagccaagagttgagtgcaggactctctgactctagttctcatgttctttccaatacactgctctgccttgtccttgtgataagccagggtgaccactcatctctgcggggagaaatttctagcagccacttggcctctaaccagaggcatcagggtgccacttgtccacctctctttctgaacctttctgcctcctctccagcccttttcctcattgctttgcaaagcacccttccagacataccctctctaacccccaaacaactatttttctctgtagatcactgtagtctgagctatctaaataaggcctcagattatttcttcaactttcttttttttttttaatggagtcttgctctgtcaccaggctggagtgcagtggcataatctcagatcattgcaacctccgcctcccaggttcaagcgattctcctgcctcagcctcccaagtagctgggactacaggcgtatgccactatgcccagcaaatttttgtatttttagtagagacagggtttcaccatgttggccaggattatcttgatttcttgacctcatgatccactcgccttggcctcccaaagtgctgagattacaagcgtgagccaccatgccctgcctatttcttcagcttttatattgaatacctactaagtgccttgcatcatgtgagacccaaggtaaataatagttccagcctcaggatgcttaggaggagccaacaaacagaaacctacttatgggaaattttattttggaagacgaaattgttaaacaaagaaatctcccattggtagactaaactcaagggagttggactggaggtgatcacttacggcccccttggttttttgttgttgttgttgttgtttgtttttgtcgcccaggctggagtgcagtggcgcaatctctgctcactgcaacttctgcctcctgggttcaagcaattctcctgcctcagtctcctgagtagccaggatcacaggtgcgagccaccacgcccaactaatttttttttttttttgagacggagtttcgctcattgcccaggctggagtacagtggcaccatctcggctcactgcaacctccgcctcctgggttcaagcaattagcctgcctcagcctcccgagtagctgggaatgcaggtgcctgccaccacgcccagctaattttttctatttttagtagagacggcgtttcaccatgttgggcaggctggtctcaaactcctgaccttgtgatccacccaactcagcctcccaaagtgctgggattacaggcatgagccactgcacctggccccgcaccccttttcctttcacaatggctacctccaggcagctggaggcagctactctgcagcaagcctctgggagaagagaaacttcccactgccctgtgtgccccctcctccctcctaacccctgtttctagccttccctggtaaggtgtactgctagtctccagaactgtggctttcctggatttgaaaggaaaacacaacagttgaagtgtttataaggctttaggaaatcatctgtgcttcaatacactggcattttcttgctcattgtagccactgagtggcaggggcaggtgaagaaaggactcttgtggcttagccagcagccagaatcccccacccactgcaagtccattttgccctggagacttggaaaaagcatagctttctccacagggagtggtagaggcttctggaaacaagtgcacctattggttctgtgcaggatcatcatcatcatcatcatcatcatcatcatcaccaccatcatccctcctttgtttacgactaaggccacagcctgaaagtccacatctcaatgtggtgtctctgattccccctccacaaaaaatgtcatctgtattcctcaaatgaacatctgttttcactaggaagtgagcctatatgctcagacaatttttttaaattctttatttatttttctgcccacaaaagcagagaagcctttataaacacggtgaagatgggctggaagtggtatagcagaaaacataggctctagaattcagataaacctgaatctgaatcctggttcttccatttactgaccatgtagccttaagaaacttactttccgtccatgcctcagttttctcatccgttaactggagtagtactcatctcattgggttcttaagaggatcaaatccacctactaaccctacaatggtgtctggtaagtatttgataaatgctgctgttgttgttactagcaaagccagctggggatgttagagaccaaccacagagccaactctctatttgattttatggctggatgcaagtcaaggaagccgatttctctagctggagcttgggctgggctcaggaaagggttgctacatttctgtataggagagaaatgcattgtttatgcagaggaactgagaacaagccactcacactgtgaccacctcaaaatcaactatgcccccaccctcagcaacccacagtcattttcctttaaagatacatctcttttgagctagtttttatatcctctgggcatggccggaggaactgctagatatagatttaaatcttatacatatattggataagcatattgacttttaaaagatatcgaagttaatagctacatcagtctgtttggggtgattgctttatagatagagggattcaagcctattaaaaaaacagccacttgagcacatcaagtttctttttatacctgactctcttttcatcaagataaacattctaaactgttatccaaggatgccatgaaaatgatcattcctccttctctccctgctcagatacacactctctctttcacgtgcatacacacccctctttctcctcataggcagtagttctctacctagaagactgaattccacctgaggtctctagatggttttctgtatattcttcttcctaacctgccctctcacttctccaatcttcccttgcaggtggtcacatcaacccagctgtgtctttagcaatgtgtctctttggacggatgaaatggttcaaattgccattttatgtgggagcccagttcttgggagcctttgtgggggctgcaaccgtctttggcatttactatggtgagtaaagtccctgagtcctaaggttaggaagagctgggcataatttgaaagtcagaattacttggtaggcacaggtgagaaaaagcaaggacgggaagcattctacaagtgacagcaagttctaaatttgagaaaatgaggccatattaccattccagcaaattcgtgaatcctgttaatgaaaatggtcatatcttaaatggggagcagaacttaaaggaagcctgtctttgtgccaagccagcactgcaacatacacatccatacaacaagcagtaggccagtggcttccccactgctgtctctgatttggctgggaaaagaggtgttttctggtgacaaaggtgtgaccagtaagtattgagagaaggactctgggaagatgtctttgaaggaagagacacagcagagatgtgggctgggtgggagcctcattgcccttctatcaaacagccagggcttccactctgcaacagtccttgggaaaaacacagtattggtcatagaagaccagactttagctctagctgttcagtaaatacctgtgcaacttaaataagtcatctgatctgactagcctcagtttcctcctctggaaaatgagggaattgaatcagatgactctcgaggcctttcaaactaaaacaccttggtgttcccatgaaatcaactgttaaagcagctccttccttctaacccaaggtaagccttaatacattatgacttacccaaactgaagaccttaggaagtagaatttatgaaccaggccttatagaaatgggtcatggagggctgggtgtgtggtggctcatgcctgtaatcccaacactttgggaggcataagtgggaggatcgtttgagcccagtagttcaagaccagcctgggcaacatagggatacctcgtctcttcagaaaaaaaaattaaaaataagccaggtgtggtaactcacatctgtagtcccagctactcaggaggctgataagaggattgcttcagcccagatcaaggctgcagtgagccaggatcatgccattgcactccagcctgggcagcagagcaagaccctgtctccaaagaagaaaaaaaagaaaaaaaaaaaggaaaagaaataggttatggaaagggacttttccccatagagtgtctctctgagaattagagtctaaaagggctaaaatggaattcaagaacacacaggaaattcagagcccgctgctgtggcaagaatggcctggggtcagtgctagctgtggcagtggctgcaatacccctggctctaagggcatcttcagtatactgcaacaccctcaaattctggagtggtattaggggttactgagagccctctgggaattataaattattcctagagcaagaccaagccccactttggcttacagttgacctcgaaaactccaagaattcccccaaaagagaactcattcccaggaccctatcgaagaataatttgtccaagtttgcagtgggccattcagagaggccaaaggccttcttcctttgaccctccatcctgggattcacctgggcatctctaaaactatcattcctcggaagtagagagagacaaatgacatggctatgccaagctcaatctgagtgactggttgtttagcacaaggcttggcacaggcctccttcaactcttcccagggaacactaatgtgccagagctttctctttcatagatggacttatgtcctttgctggtggaaaactgctgatcgtgggagaaaatgcaacagcacacatttttgcaacatacccagctccgtatctatctctggcgaacgcatttgcagatcaagtaagtgtagattcaacaaagacttaactttggtgaaaagatatgctctcataaggggaatgcattggagaattagagaccaatcagaaaggagagattatatttccaaaggcagaggttgctgggcataacccaagctttcttgataatcgttttacctttacaaggagctgataccaccagaaaagttttctccttcctctttaatacgtacacttgtttaacattagttgagatccagaaaagagtgaatgactaaacatttcaatccctgtagacacaaatggagttcacttcactattgactcttttgaacaagtggtctaagtgtggaggccacaagagaagatatttctatttcaaatcaaagactgtgaagggtggtagttgagcctaggggatcatcaatcctctctgtctcaccatgtgcataggtttatttatttaaactctcaaggtggctagaagtatctctgcttattgacctttaaacaagcttctagcacccaagcatactgtggtgtaaccaatagcacacctatttggtcagcttatggcaggactaacattgtcaactcaaaagactcttcttcccttactgtgtcccaagaaggctgctggttatcttggtcagggcagtggaaggaaggctatatttttcagtatctctaagttcttcctctatgatcaggacttatacagcagatcagaatgggcatgtgtatcaaatggatcttccagttcatcagctatgcccacctccattcaatgtatggatgaaaaactatgccctcatgtcctcagcttttttactttccactttcatcaataaatcaaacaggcaacaagtgttcattaaaaactcactatgtgcttggccctttgtctggagcttgaaagactgacgagtaaatgtgagttgtaaagatccaagatgcagagtctgaatgcttgaattaaaatagctgttctgcctccaacttcctgcgtggcttcagcaaagtactgaactttttgggtcgcaagttattcacttgtaaaatggggataatatgagccttcatgaagttacttatgaggataaaaagaataatatgagaaaaacgcattgtaagcagtatctgcccagaaattttgaatctagttgaagagcattgaacaaggaaacaatgcaaaataagatataattagacagagctgggcacggtggttcacatcttactccctgcattttgggaggccaaggtggacaggtcacttgagcccaggagttcactaccagcctgggcaacatggcaaaaccctgcctctaccaaaaatacaaaaattagccatgcttggtggtgcttgcatgtagtcccagcaacttgggaggctgaggtgggaggatagcttgcacccaggagttggaggctgcagtgagctatgattacaccaccacacctcagcctgggcaaaaaagaagaaaattagataggaaactggagtatagcgaccatattataatagaaatttgaagcagagagcatagaagagcgaggacaattttggttattttggtgtttttctctaagctttttttttttttttttaagactgagcctgttgccccaggctggagtgcagtgacgtgatctcagctcactgcaacctccacctcccaggttcaagcaattctcctgcctcagcctttggagtagctaggattcccagtgtgagccaccactcctggctaatttttgtatttttagtacagacggggtttcaccatgttggccagactggtctcgaactcctgacctcataatccgcctgcctaagcctcccaaagctgtatcttgatcaatgctgacctgcataccatatcctgagcttccttcattgtgtccttgtctcagagtgagttggcaatttctctaaggtctgtggtttctaagcccattattgtgtatatagtcaagtagaaaaagtgaatattagaaaaccctgaggctgtaaccgtcagcaaaccctgaatgctgtccgtattcttaggctttggagagagttccaaaaattgccaattatcagtcagtcaacacccaacagagctcttggccatcatgaccatattttggggtcaccttatttcaagattactaaattgtttagctgtaaatactcttcaagcatattccttggtttagttaataatcaatcatttattcacccaataactatttactgggcacctacttagccaagtacagctctatactcttccttcttcaaggagttcagagtctgaggctcaatctaacaagtaagtagatactcttttgcagagtgacaaggacactgatagaagtaaagtcagaatgtcatggaagcccagaggagggagcttttactctgcaagagagagttggagaaggcattccagagaagagtgctcttgggggaacatgtgtcttttaatattaattaaaaattattttaacattattattttggaaagcagatgaaatgataatgaacttaaactttaaaatcagttgcctggttcccatcctgattcttctgcttacaagtttgacattggacaagtgtcttaaccttgttttactcgagttttcttatctataaactgagaataatagcaggatttacctcacagcattactgtgaagatttaatgagataaagcatatgaagtacctggcacataataaatgttcaataaataatagctatcatttaactgttaaagtaaaacagtagtttggaaaactaataacatagaaaccagctataattggccaattcaaatacctattatcatttttgtttattgtcttaaaatttttcttttacgtatgtttttaagtagagtcaaccctacatatccatgaattctgcatccatggattcaaccaaccatggatcaaaaatatttttaaattgcatttgtattggacacgtacagacttttttcttgtcattattccctaaacaataccgtattcacattatatcagatattataataatctagagatgatttaaagtatacaggaggatgtgcataggttatatacaaataaaacacaattttatattggggacttgaacatccatggatttttggtacttgcaggaagtcctggaaccaatcccccacagacaccaagggacagctgtataaaacacaaaacaaaacacaaacacaaacaaaaaaatacaaatttttttcacttaatgttataagtatttttaaatattactacatagcttttatgtttatagtttttaatggctatacagtagactaaaaaaagagtaaaagcttccagtttttcagtactataaattttgctaaagtggacattttaaaatgatttttccacgttttagattatttccattgtgtaattctcaaacatccagcagcatcaaattgtataaataaatttatgtttttgaatgcatattgctaaattattgctgaatttccttttaaaagcatagtacttgtttagatctattagaaaagcctgaaataacgggtatctttttcctaacatttgatattgtttggatttattttattactaatgagtttttaccactgctttcctaattctgttttccttttttgaattttctgttcacttcctttgcacactcatctattgatatctcacattgcttttctcaccaatttgaacaagcctttcattcatttttccagcctgcagcttgccgttctacttagctgagtagtagcttagcaggatagtgtggtattaagataacagtctctggagccaaactctctggatccaaacctgactgccacctactaagtgggcagggtaaccaatctgtaaatgagaattatattggcttctcctctagaattgctgtagaaagaagagagactggcacaattattcacccagtacatgccagttattactaggcatattgtaatataagtaaaatagtaatattgtaatattgtaaaatagtaagaagggatgattttgagacatgcaggtgagcagaatgcaggctaaagccctggctcaacttctccctctccaggtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcaggtaagtaacagtggtggggaagagagagacagagtcatgctgcgcctcaccagtggggcggggctttgacatggagatccagggaagttcagatgacagcgccaacgttaactgcacactctggtcataagcatgagacatttcactggtattttgtggtatgatgtgtgtgtgtgtgtgtgtgtgtgtgtgtgtgaaagagagagagagacagagaaagagaggcggctctaggtaaattcaatagagataaaactgtcccacataataataatccctcaattgctatatgattttatgtgaacattttagctgtataacttgtctgcagattcattgtgtgacaaagttgggctacaatttgcatcctatgatgccactacagggctcttcctcgtgaaccacgcaacctatgctgcacttattccacagatatttgttgggcattatctgtgctttagtcactgtgctaagcaaggaaatttcaaatcagcaaaagcactcaccttgagcgatataataagtgctctggcaacccctaaaagtgctgcaggaacacagataacgtgtgagtaactgccagggaagcagggaaagacatgactgcaaatgtgagagctgacttggttctggagatatgagtaagaacttccggacaggacagatgtaagattgagcctctgccccagaaatggcaagactccacactttctacttcagaatgtgctgaggaaatacgccaactgttggtacctatcttctaggacaaaatttgccccttcactacttcctggtttccctgcatgcagtcacagaggcgcatcctcatccacccatggcaacttcctatggggaaggagctcactttggttcatcaggaaacagggctctaccatggagaaaagtaggaaaaacatgtgtgagcaaattctactttaatgtttcctgtgagaacaaaggacgtgagtgttcccaaatgatgacctagacatagagtcatcagggtttggcctgcatttcaccagggtgaaaaataagttaaaataactggtaccattgagatcaccaccacagatagcactcagagcatctagagtgtaagtgccatgagtaccttgacagccttttcccctggtatatccacagtgcctagaacagggtgtagctcatagaaaggctcaataaaaaggtattgaataaaagaatgaatgaattctatgtgacggacacttcctaggagttgaaggatgcaaagcaactcagtcaacattccctgtcctcaagaaattgacaatccaataaatttcctagaacagcagttctcaaccagaggtgggcaactgttccccagggcatttttggttgtcacggctggacctgagggaaggggctgctactggcatctaatgggtagacgccaggaatgctgttaagcatcctacaatgcacacggcacacctcccacaacaaagaattattcagtccaaaatgttaataggtttgtggttgagaaattctctcctagaatgatcacaactagaacacgaaaatgtccgcaactaggatggatctcttgtatctttccaatggagcatcaaaaacatatgtcctaaggatctccttattcccagagcccagaattcgcccatgagtttcccttaattccaccatccagagtctcagtcttggagaccaagctcttcttccaccccctttgagacctccttggtgattcattcaaaagtcaaagagacatggtggttccaaaacagatggagatcttgcccaatgtccctttgctctgttaagtatatgttaggagaactcatgtgaaggaaaatgttggaatcacctaatgtcccatgtccttagctagcatcaggatcttttcccttccatggagtcatttattcattcatgcagctacttgatatcttactcaaggctctccactaaagatgataagacctagtttctgtccttcactgttgtgtttatattctacttaagaggttattccagaagctcttacacaaggtggaagcagtcaagtgccattaaagagatttgactaattaactccaggagtttagaggtctacagctccaaatttaagaattatgggagtggaagtgggaacatttatagtatttggatatgcttaaacaagcaacagaggggttatctcaggcagagagaaccgttattcaaagacacaatgttaaaatcacaagtgatctagtctagctggaagggtgcagaaagaaagttggaaagggccgttgtcagatcatagaggacctggactcccagaatgagaattttggcttttcttctgctccctgttttgtaggttatagggagtagcaaagtatttggggcagaagtttggcaggtttagaatgtcaatttagcaaaattaatctggcatcatcctataagactgattgaaaaaggagagagtggggaagtagaaacccattaggaaagagcagggttggctggtaatcctcaaccaaaaatttctccccaaaacctttgagggacaacaggcttccaaagtgttcttagagtgtctcatttcctcagagttctatattcaagggaaatccctcagtagatatcctagcttggacctacacctaaggtcttagaaaaaaaacaaggctaccttgttcccaggtccccatgtactcctgaacggcaagcagtggaatgatggcaggtacagcgagatgccagagggtttgatgagggcaagagtcaacagaccctggccaaagactcttggtttttcctttaaatgttaagatgtttcccatcaaatttctctccacttattcacattgttaatgacttaatcagtgaaagctctcaggagtattattaaatttttcaaatagttggcccaaagtattgaatccctaaagatggtcctttagacagttaacatacacatgttcctggcatctcccgaatcatagtgtgcaaatgatcactatttgtgtgcatataggactaggctaggcaggtaaccacatctgagcgcctccatttgtgacttgtgaacctgatacaacatgtccaatctgataaaagaaaaagcatccagccagtgaagaggacatgtaccctggctgatatcttggaccttcatctgctaaatgacaggaagaaatttgccataaaaggaaatgatggacccaacaggtagcttatactcccttcatgttttgacctctagagaagacttcaagtctttacagccaaacgggagaggcagccaccctccatgtgcctcccctagaaaaatccatctggatttggggcctggggaagggcactgtgagggcggccgagtacagcatcctcgctgccgtgtggtaagagtgacatctggtggctgccatgctcaggctcagtgctcttccatcaaccctgcaagggcaatggaggacttcggagaccacttaggtgccccaggtggaagggaccatgcagatgaaggaaatggagctcacgatggggaatgggggtttgatttgctcaaagaccttctagataatcttgagattagacttagtctcctggattctaggacagggttcttgtgtcctgcttatttcctttatcgttcttttctaatcaaagtttgagatatacaaaaggccacatggaacatatgtgtagttattcagcataatgatgaaaagaaaagctatgggtccttctagaatccaactagaacactgaaattcttacatgcctctgggtactcctcttgtctcccatcccctctgcatttatcctgaagttttgtgtttaccattcccccgctttttaaaaatacttttatcttaaatgtatatatccttaaacaatatactgtataatttgtttgctttcctgatcctttctaagaaattatttacatggattttctctctccaaagaagatggtgacaactcacaaagatacctgcttttccccagaactatagctttgctgtaatgtactaacattgaggatttctggaagagagagagccatggcatgacagccttatcagagggtagcctcaagctaagatcttaaaaaataagtactgatttaaattatatttagaaggcaattcacacatccaccttagattttttaaaaattcattcattcattgaaaaacatttcctgattgattagtttgattgtcctcatacactaatgatgcccaggaatctctccacattctgcttgtaatccacaggaatcattatttcaggatgagggaaaggcaattctgaataattgacctgaactttcttaggggccctcaatcttaacgatgggctcaggcactatattttataaaaagaaaataaataagacataatatctcacaaatattagtaggacaattaaatagatcatctgaaatcaggtgtagtggaaagtcaaggatggcagttgccatgctgcactgagccccccttatacttagctcttgctgagttaagagggaaccatgagtgtgagaaagactaacaagtgagtgaaaaaactagacagtaataccaggaggaaggccaagaaatgtatcactaatttcttgtttgatttcagagctggaaacaacttctggtggattcctgtagtgggccctttggttggtgctgtcattggaggcctcatctatgttcttgtcattgaaatccaccatccagagcctgactcagtctttaagacagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccacccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgttggttgcttggttggtttttataagtattaagattactaagtacgtctagttcagaggttgtctattgtgtctacaaatttgaatttcctgggggaacttttgaaaaaatactggtgcccagttggtcctttgtaaacatctcaggtgattctaaaatgcagcaagggttgagaacattgacttgggtaaatcacacgggtctaaagtttctttgaccatgtccagtagtggccaggtaattcctagcaggattccagagtcttgggatcctcatggattagagcaatggttttcctccctccctacttctaaagggaacatgtggcaatatttggagacttttatggttatcacaactgggaaggggatgctaatggcctctagtggctagaggccagggatgctgccaaatatcctacaatgcaaaggcaaccctcccaacaggtaattatttggcccaaaatgtcaataatgctgaggttcggagatcttggtgtcgaggaaaggtagggaggggagtaagagaagacactgaaatcctgcaccttgattcaagttcagtcaggagcaaaggtgccagacaaaccaggaacaaaccctgggggtggactataattcttaaagcaagaggcaattcaaaatttgagttttgaggatgaactgtggaatctatgatctacacaggtgctcattaaacacaatttgatgattgatgactaggatttataaacaggaaatgtaccattatggaaatcaaccccaggaagaattttttcaatggaaaaaagtgcttttgttccaggtgctcacactcaaattctctccccacccctacccccatttacaaataagtggatttacctttgtggagttattttccaagagaatgtttatatggttgaattatctgtatccgaagtcaactagatagagccaacttatccattttttaaatagttgctttaagagttagaattgtaacattcctccttccctccccctcatgaatcgaaaaacttgatagaagcatttatcttaatgccaaaaatataatttctctgattctttaaccagttgagatctcagagcatgtcaaaggttgcagggcttttctaaccagtaacaaccagtcaatattcagctgttaaacaggatactccacataaaaatgtcatacgtaaaatgttatccttaggatataaattattatttcctttaaattgcttacacacacacaaacacacacacacacacgtcttactgtaaggtatattgatgttcaataatatcgtcatgggaaaaaaatacatcttccagttagagagaatggtttataagttttatttagccacagaacctgtcgttcaaataaaaccttatatgacacccacaagtgaaccagaattgctataaataaaaaaagggagggggatcaggagcttcattctgcttgtgatatcatcttaaaaacacacccccaatgcagcccctaaggggtctctgaagagaaattgtgtgtgtgtgtgtgtgtgtgtgtgtgtgtgtgtgtgtgtgtcagggctgggggtggggtttcagaacacagtgtcacagtttgaaaatcattgataaagacttgggataagttgttggtgcacacttttatgaaagtttcaaggatataacctacaaaagaccatattaacttaatctcaggtcttttccaaagactttttaataaatgaattagacagggtgaacagaattactcaatccagcaaacatcacccacaaagagatgtggtacatcagtcctcaaactgggaatttaagttctctgtgacaacatgtttactaatcacagcccatacacagaagcaatggtactcctggtcacacttactgtgttgactgtctaagtctgtataaaaataaatagatagatgatagacagacagataggtaagcaaccaaccatgctccaatctctttcttattgctggaaatggagtagctcttatt

SEQ ID NO: 16504 - DNA, 40435 bp, Human
  misc_feature (1)...(40435): n = A,T,C or G
gctgggattacaggcgtgagccactgcgccaggcctaactccatgtagtattaacttttcttctcttctgattcttgtaccaactgcatcttttcttttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatctgcatacaaaaatggaaagcaaagccatcacttagtacaatgtccttttaaaagatgttatgtcactactttgcactggagtgaacaatatttttataatatgttactaattaaaacaagaatataaatacataaggagtacaggaagtgaattagggaagggtataagacaaaactaaaaccttttctattacagaatgttctcaatggttttaaatgcatactttttctttttttttttttttttgagacggagtctcgctctgtcgcccaggctggagtgcaatggcgcaatctcggctcactgcaagctccgcctcctcggttaacgccattctcctacctcagcctcccgagaagctgggactacaggcgcgtgtcaccacacccggctaattttttgtattttttgtagagacggggtttcaccgtgttagccaggatggtctcgatcctctgacctcctgatccgcccgtcttggcctcccaaagtactgggaatacaggcgtgagccaccgcgcccgggctggttttacttttaacaagaggagtgggccgcacgcggtggctcacgcctgtaatcccaacactttgggagcccgaggccggcagatcacgaagtcaggagatcgagaccatcctggctaacacggtgaaaccccgtctctactaaaaatccaaaaaattagcagggcgtcgtggcacgcgcctgtagtctcagctacttaggaggctgagggcaggagaatcgcttgaacccgaaaggtggaggttgcaatgagccgagatggcgccactgcactccagcctgggcgaccgagcgagactctgtttcaaaaaaaaaaaaaaaaaaaaaaaaaaaaaaaaagggaaaaggtagcctcatgttcatgtccagaggaatagtcnnnnnnnnnnnnnnnnnnnncgcttcgtgtgagaccccaggttgactctagaggataccccctccgaggcgggcggatcacgaggtcaggagttccagaccagccaggccaatatggtgaaaccccgtctctacaaaaaaacacaaaaattggccaggcgtggtggcgcgcctgtagtcccagctacttgggagctgaggcaggaaaatcactggaacccgggaggcagaagttgcagtgagcccagattgcgccactgcactccagcctggactacaagagcgaaactccgtctcaaaaaaaaaaacaaaaacaaaaacaaaaaaaaaacctaacaacagcaacaacaacaaaaaaaataggaaccattcggcctgtttccacatctgtacaacaagctaaatcatccctaccctgcctacctcgttgaacaggcattttttgtgagagcaacgaacctgaaatgttaacaccaacactgacgtctacaattaccgttaccgtttttaataaccactcaggcacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcgggggtgagtgaggggacactgtctggagagctcctacccccatctaaaaggaaccccctccatttcattaccagccagttgcccgttgagctctgtgttgccagatcttgagttttgaaatgctgggaaatgctggaaacacagattttaatataaattctgatttttaaatgttggcaactaaattcaattttttaaaaaatactctgtatttggccgacaggctgtccatttgtggtcaagagcaggactttggagacatcacacagacccgggtttgaatcctgataagtaatttacaactttatttggacaaggcagtttaatttctgggcctcaatttgctcgtctgtaaaatggggctaataatacctatcccataatattgtttggaggattaagtgagatgcatgtgaagaaattaacacagtgcctggcatatataatagtaatcatcaatatatatgtacagaggaccattttatattgcacatatacaaagggctgcttcccaaattagtaatttgttagctggtttctttcattagatacacacatagtatgacctaattaattagcctaaggccttagttaacccactcttttttttttgtatttattttaatattatctttacacaataagttgcaagaaaagttggttaaactaaaagagtggcagtcacccagtgatgacgctgtggtgcttgtataaccaaccaagttggctttaagaatggtgtggagggaccagaggtcactactgtgccttacaaggagccaaccagagcagcagattttaagttttgcaagtggaactgcctgacttttgtgccactattacctgttttgttctgtttttcagatcttcttggagaaaatatttatctgctcttgtttaccatagctttacgaatattaaactgctttttagtgcagacaagttttgttccagatgaatactggcagtctcttgaagtttcacatcacatggttttcaaatatcctttgtggtttcttttccagactatgagtgtgtattcatcttggaaattgtgctcagtttcttttagagtagtcccccttgctccctcgtcttcagtagatagtttccaaaatccctagtggatgcttgaaactgtagacagtaccaaactctatatatattgtttttatatatgtaaaaaatacacacacgcttatgataaagtttatacaaattaggtacagtaagagattaacagtattaaaatataacaagtataacacaatactataataaaagttatgtgaacttttatgtggtctctctcaaaatatcttcatattttcagacagtggttgactctgggcaactgaaacatggaaagagaaaccacagataaggggggactactatacatattttcagttttccgtattttccccaaataattttaactcatcaaagtataccattattttatacaaatatttctcctgtatctttcttttatgttaatatacttgacacagccgttagcatacattcccacagtacttagcacttggaggatacagagaaagtaaaaaacacattactgccttgaagaagttaagagtttagttggccaattgaatttttaatgcaaatatccagtataaaatgctgttttaagactgccacaaaataaaatattgttttataaatggaaatgaaaatagattttgccaggtgaagtggtgtgcacctgtagaggcaggaccacttgagcccaagtttgagaccagcctgggcaagagagtgagaccccatcttaaaaaaaaaaaaaacacggaaataggtttcaatattattggacatttactccttaatgttactaattatggttatttgacttgggaatggacagagagactgaggagttacacttatcccttaatctttgcaagcatttacaagattcttcatcttttagggaaagatagtgttcagttgctggtaagtttaaataaaagtaactaaatgatattggggccatggaatttgtttttaaaaggctactgttgctgaagtccagccatatctgggaagcccatgatactacagacatactgtgatgtgtaactctttagtttgtgctgaaatacaagactgagcatgaaaatatcctgctatgaggaatcctgttatgatgtgcagattttcaaaatgactatattatgtattatttggacattagaagtatacttctttcttttttttttttttttttttttttgagatacagtctcgctgtgatgcccaggctggagtgcaatggcgtgattttggctcactgcaacctctcccacccaggttcaagtgattctcctgcctcagcctcccgagcagctgggattacaggtgcctgctaccacacccggtttatttatttatttatttatttatttatttatttatttatttattgagatggagtctcgctctgttgcccaagctggagtgcagtggcacgatgtcagctcactgcaacctccaccttccgggttcacactattctcctgcctcagcctcctgagtagctnnnnnnnnnnnnnnnnnnnnaccgcgtctctactaaaaatacaaaattagccgggtgtggtcgcgcatgcctgtaatctcagcactttctggaggctgaggtaggagaatcacttgaacccaggaggtggaggttgcggtgagccgagatcacgccattgcattctagcctgggcaacaaaagcgaaactccttcccccatcccccgcaaaaaaagtatcacttgagagcaccgttgtattttgtgttttttaccttgtaagaagaccgtgtgatatgattttatgaagtctgtatacatctaaacccactgaggatttagtgttgaaattaaaactttaaaatttttaatttgacaaacatttaatgatctgcataatcatcgtcctatatagtaattaggcatcaacagtaagtaggattgtaattcctaggctattaattgctggggtcagttgccaggagatagtacaagggcaggactaatggtgtaaaagtttctctagcctcactcccatgatcttttaagctgtcatcagatgagactcagagtttgtgctccccccgatttctgtcagtgggggttaatggctcagcattccaaaggcagtccaaatcctgacgtgttttgtgtagcttagaaagacacaggttctagggtatttgttttaaggtggggttgtactctccccattgcaatatttgcttccgttattgagaaattagggttaaaccagtgaaaccgatgcttcaaatgggaagatgatggggaaggagaattcagagcagtagcagagtttcttccattaacaacaggcagaatttaggagccgcaacctggcttttcttctcttacagttatctactagtttatagattatgcaaggtatccataaagtctggaatcacaagaaaatatacataatctcatcaatgacagtttatatcccaggaagtaggtcagattacaaatgaagaggtcttcaagatagaaaaatttcctgctcctccaagacctatccactgccctccatctgtagctgacccaccaggtcattttgtgatgtgaaggaagcctcccctgacctgctccaacccctctaaaaggaactcattgtcgtatctagaacttgaccctgtagagattcattaggatatgatcagtcattcatactctcatattgattattttaagcaaattatatacataattttgaagctagaagaggttggagaagtgaagtaaatagaccaaggtcacaacgtgttaaaagcagaactagagctaaatcccaggtctatttactcacagcctagtgctcttcccagatggctcctctacaaactgcataaggcttatgcacagctaggcatggtggctcacagttgtaatctcagcactttgggaggctgaggtgggaggattgcttgaggccaggagtttgagaacagcctgggcaacatagcaaaactctgtttctacaaaaaatttttaaaaaggatagatggcttagagctgcactgtccaccatggtagccactagctacatgtagctgttgaagacttcaaatgtggctagtccaatttgagaagtgctgaaaatgtaaaatacatactgaatgtcaaaggcctagtacaaaaaaagaataaaaatatttttataatttttattgattaaatgttcaaatgatgatgccttagatatattgggttagacaagatgaaattaattttacctgttttggatttgggggtcatctctgttgttactttttaatttgccagctatagaatttaaaattccacatgtggctcatgttatatgtcttttggcctgtgatggcatggaacatgtaaaaagaaagaggaagaggaggggaaacctgaatggggaaccacagtaaggtttgttgggttttgtttcttttgaaatggaatctcactctgtcgcccaggctggagtgcagtggcaccatcttggctggctgtaactgccgcctcccgggttcaagtgattctcctgcctcagcctcccgagtagctgggattacaggtgtctgccaccacacctggctaatttttgtatttttagtagagacggggtttcaccgtggccaggctggactcaaatgatctgcctgcctctacctcccaaagtgttgagattacaggggtgagccaccaagcttgccaacagtagggtctttgaatagtcagaagacaacaaaagggtatttggctcctgtagcttaggggaggagtcaggagtgtaaagaacagaagtatggaatgaggagctaccaacataggcctagtgctcaagttacgcctggcatgttcttctctttacctcactccactgctttattttactctttagcaggtccttactgtaacatggaaaattatggcatcaaaaatctggagaaactgctaatgactgggagttcagaactccgcttattgttatgcgaaagtctactttgttttaaattcaagatttctacttaaccacccttgaaaaacttctctttattcggggtaaatgtctctagctcttaacctcataatcatagatagtatcctctagacactttgtaatttattaatatccgtcttaaaatgtggatctccaaactgacacaataatgaaggcagagtaactagttcagaatatggtgggtccattaacttacatttctcagagcacaggaattcttttagctttttaatagctacctcacactgttggctcatattaagtttgtagccaaattgacttttcatatgaactgctttcagggggcctgggaagtaaggatgaagcttatagctccctatgcagagtaaacagaaggtatgtacatgagtgccttttcctgtattttacagggcacagtttatgtgaaattaagtactgggtacctttaactttccaattttagcatttatttacacattgtggacaaaaagaaaataaagtgctaaaagccactgacaactaaaagtaaagcagctcctataatgtggacttaatgaagtttgcttcaacaaaaatatgaattaacagccggcgcggtggatcacgcctgtaatcccagcactttgggagggtgaggggggtggatcacctgaggtcaggagttcgagactagctggccaacatggtgaaaccccatctctactaaaaatagaaaaattatacaggcatggtggcgggcacctgtaatcccagctacttgggaggctaaggcaggagaatcgcttgaacttgggaggtggaggttgccatgagccaagatcgcaccactgcactccagcctggatgacagagtgagactctgtctcacacacacacacacaaaataaaaaaataaataaactcacgtataaatttttagaaacacatcttttaaacaaaccaagattaaattgtgctctaccagcagttgttattttgttagtgttaactatgacacctttttttttaactctgagagatgctagtgcatagcattagcatttctaactataatttagttgtaatacatttagtctttatttcagttttacacttaaatttactctttaatgtcatctgaataccatgttcctataattgcagaatatttgtgcttttttaaaaagtaatttgttagccaggtgcggtggctcatgcctgtaatcctagcactttgggaggctgaggcgggcagatcacaaggtcacgagatcaagaccatcctggctaaaatggtgaaacctcgtctctactaaaaatacaaaaaattagccaggcgtggtggcatgcatctgtagtcccagctactcacaaggctgaggcaggagaatcgcttgaacctgggaggcagaggtggcggtgagccaagatcacacagctgcactccagcttgggcgacagagcaagactccatctcgctgggcacggttgctcactcctgtaatcctagcacgttgggaggccgaggcaggcggattgcctgagttcaggagttcgagaccagcctgggcaacatggtgaaaccccatctctactaaaatacaaaaaattagctgggcgtggcggcgtgcacctgtagtcccagctactcaggaggctgaggcaggagaattgctggaatctgggaggtggagcttgcagtgagccgtgatcgtgccactgcactccaccctgggcaacagagcgagactctgtctccaaaaaaaaaaagactccgtctcaaaaaaaaaaaaagtatttcttattatcttattttatatcttattatcttatacataatattatcttattatctatattgcaggatagagaagcagcataacttagtaattaaagtcaggcagacctgggtttataatgccggctttcatacttactagctgtgcagccttggaaaattagttaacctctctgtgcctcagtttcctcatctataaaacagttcttgactcagaagattgttaggactgaatgagttgatacatataaaatagcatgatacatagtacacagtgctgcaaatatttgaatttttaaaaacctgttgttgctaatgaatataaatatacttttaaaatagaaacttggccgagcacggtggcttacacctgtaatcccagcactttgggaggccgaggcgggtggatcacgaggtcaggagatcgagaccatgctggctaacattgtgaaaccccgtctctactaaaaatacaaaaaaattagccgggcgtgggaggctgaggcaggagaatggcgtgaacccgggaggcggagcttgcagtgagccgcggttgcgccactggactccagcctgggcgacagagcgatacgtctcataaaaataaataaataaaacagaaacttaacacaattaaatgactggctattaatatttacattaaaattagggccaggcacagtggctcacgcttgtaatcccaacactttgggaggccaaggtggaagtatcatttgaggcaagattagctgagtgtggcagtgcatgtctgaagtcctagctactcagtagactgaggcaggaaaattgcttcactcctggattcaaggctgcagcctgggtaacagagtgagaccctgtcaatcaatcaatataataaaaaataatttaaaaatatatttataatatatgtgtgtgtatatatgtcatatatatgcacacatacagagaatgagactggtaaatatcatatttatatataaatatatatatttatatttataatatattttatatataacatatgtgtatatatgtcatatatacacacacatacagagaatgagactggtaaaacttaaaactacattgattattttaatgagaatataatttttgtagaaaaggggatgtagggatgtagttttgtggaagaatagaaaaatatattgcctatttttgtactaagaatggcttcccatagatagttggatcagcttgttgacttttatcataattcagtttgaaccaacagatatttttaacatcctgttcttctttttaactgatgaagatttggattcctagacttgcccaagcacttctgtctgctgtagcagatgtgagactttactcattaatgaagcaactagaaaatcaggaagtggcaagatgggtggtaagtcctaaatactttagaagctgtatgccagttatttcgttcctatgggtataaagcacatggaaacattgattcccaaaacaattttagaagataattcatacaactttatagaggtacttccataaataagaacagtaatatgcaagtggcacctgccatatctttccttcggattaagccctgcacagtgtaagccactgatgccctcaaaccctatgagagtctaaaccctgggagacaacctttggaagccccttcactcctcaaaactgtccttgcctctctttccatagaattgagtagggatcgttctaaattaccagctacctcacaaagcatcttagctatttacaacccttgttctgttcctctagccagcctctatctgaggtgcagcccgagaaatctttttgcactgaaactctcacttctgaatgggatgttggaagtattaggttggtgcaaaagtaattgtcgtttgtgccacaacaatattaggttggtgcaattactggactcatgtaaggaagaaagtatagtatgcaagactatcttttgtcgtttgacttatttcaaggtgggaagatagattcctgacatctcccactccaatcttgaatggatttttcccatttaaacaataccctgatgagggattggattctgtagtactgtcgttaattcacttggctctttgtaaagttaataagcttatatgagcctgtttgaaagtcttaactaccttttttatattgtttctattggaaaatacattctaaattccaagtaaccaatttagcaacatatttctgaaatataatttattaataaattagaaagggaacatttctgcaggtattctattcctttgcattaaaaagaaagattggtttagcaactaagtccttgctaattgattcagcaatatggttagcctcattattttgtgcttatactttatgtacattgcagaaggctcaacataaaatggtaggcaaaagtcatgatggctttgaagtccttcctccaaagatacagcactagggccgggcatggtggctcacccctataatcccagcactttgggaggctgaggtgggcggatcacaaggtccggagttcgagaccagcctggccaacacggtgaaaccctgtctctactaaaaatacaaaaattatccaggcgtggtggcagacacctgtaatcccagctactcgggaggctaaggcaggagaattgcttgaacccaggaggcagagattgtgccactgcactctaacctgggtgacagagcaagagcaagactccttctcgaagaaaaaaaaaggatacagcactaggttcttctagtttagggaaaacctttactttcatgaaaattgggaacattttttaaaggctatatttggtgagatgggaagctagtgccacatgcttaacaattgcctcaactaacaagtttcttttaacacatttgttttgtagacttaatggtgctctgtgtgcatgttcttccaaaaactgattcattaatttagtcaatctccaaattaaaatttaataatgtctcctgacttttttttcctctttcctcttttgtcttaatttttcatcagcgttccaaaacagggagacattccaaacaagtgcaacattccaaacaaggtcaacaaaaaaacagtcataatacttgtgtcagtactataagacagtttgagaaatattgattggaagaatctagttatgaatttcaatcatctgtaaactctaccatcaaagaatctgttttttatgtgtttcattaatggaaagtgggattttaaatcaaatgaagtgccataaaaatgcacctgaaagtataaacttcttaacatgaacaaatatagatctgctattatcataaacctgtgtttcatgtaactttctaaaaacgacgtttgggcatgcctacttactttaacatcatctaccttttgatgtccttttcacaatatttagacttgcttgctatttagaagataatatgtactaaggttttccatttccaatttcatatatgtttgctctgtactttttcttagtttttttgccagttgtgctcctggttcacatggtattgctgtaccagaacccttacaaacaccatggaaactgttctcactataattgctcttttctactatcctttggaaggttcaaagtctatgaacaggtaagaaaaattattgttaataattatgttcaaaattctacttttgaaaaatcttaaatatcaacatattgtaatgtctagtagaccccctaattttcatgagtcatgagaaccacaaattttcagttgatatattatagcagaaaacagataatactcaaacaggataattaaggagagtttaacaaaaggaatatttgcaaaggtttagacaatatttagaaaagccaataaggaaacaccatagtacccccagcatggttatagtaggaagtctgtattatctctaggccccaaggagcaaggagaagaaatggttactggaatctataaaaagctgtaattgtaagagagtgccccagcagggacaggcacagccagcctttagcaataatgaggagacagccagggaactaaataatcctgacccaactcttctgcctctcaacccaaaacagtcagaagccagaaagcaaggtagccactgatgctgtccattcaggtcagctttcctgcgtgcagactggataaaggctgaaggagaagagttttggaagggcaaataggaaatacttggactttatttggcttcctttaaactggggaaacaaataccacgcaatgggaacatgagtgaaggcacagaactgtaaatgggctccatttacagttacagttacagtatattcaaggcagattgtccagagtagttatagagtgttgtaggatgcatggaagaagataagaagaagggatgaggctggaatgagactttgaatttggattttattctgtaggtaatagggaaccatttgaggcgtttgagtagcatgacataatcaaatctgattttgaaaaacttcttttgtaatagcagtatttaggatatactgaaaggagaaaagccagaatttgggatctagttaaaattctagtatccattcttcctacacaaaaggttgttaggatgatcaaatcaaataagatcatttctgtcttagactctcttaactacaagaaaaagcattcactcaagttacgtatatgatgaggactttattttaaggctaaaagggaaaatgggcatctcaagccttgtggctaggactggaagaaaactgtagaatatctgagccacacaaatgaattgaaatgttatgcagaatccaaggcagttttggggaatggactgttttgttgtgcctttatatcccaaatagcctatgaatcctgccttagtcttccatcatttaggggcttagctagtctctccacttctgtttttgctagcaattacccagatttctccatatctcacgttcagcttgagagaatcgaattaggtccattaaatctcattgtctctatctggacataactttatttcacactggccagccttagattggctacctgggcccaggtgcccttccctaattcagtcaggaagcgcaagggtcacatggtacaaaaggactgctatataagcatttttccttgtataagcatgacagatactattccagacctgacaataaaatgacattttgcacactcctttaaaaaatgcaactattggccgggtgtggtggttcacgcctgtaatctccacactttgggaggccgagacgggtggatcacttgaggtcgggagttcgagaccagcctggccaacatggtgaaaccccgtctccactaaaaatacaaaattagctggatttggtggtgcatgcctataatcccagctactcgggaggatgagacaggagaatcacttgaacccaggaggcaggggttgcagtcagtcgaggtcacacgattgcactccagcctgggcaacaagagcaaaactgtctcaaaaaaaaaaaatttgtggagatggggtctctttaggttgcccagctggtgttcaactccgggatcaagtaatcctcccaccacggcctcttaaagcgttgggattacaggcatgagccaccaaacctggcctaaatttcaagctcatgtatcaaaatctggatttcaactttctcttgaaaaattggaagttctaatagtattttgggctaggattccttcatgacaataccatggttcaaacttagcctacatttctcatttttattttatttttttttttcgagacagtgtctctctctgtcgcccaggctggagtacagtggctccatctcggcccactgcaacctctgcctcctgggttcaagcaattctgcttcagcctcccgagtagctgggactacaggcgcgcaccaccacgcccagctaatttttgtatttttagtagagatggggtttcaccatgttggccaggctggtcttgaactcctgacctagtgatccagctgcctcggcctcccaaagtgctgggattacaggcgtgagtcactgcacccagccccatttctcatttttatagtttactgggtctctgtaagcatttgaatgtgttatccttgagcttacatcctcatcaacattacagaattcattcttttttttttttcttttttttgagatggagtttcattgttgttgcccaggctagagtgcaatggcatgatctcagctcattgcaacctccacttcccaggttcaagtgattctcctgcctcagcctcccaagtagctgggattacaggcacctgccaccacacccagctaatttttttctatctttagtagagacagggtttcaccattttggccagactggtcttgaactcctgacttcaggtgatccacccacctcggcctcccaaagtgctgggattgcaggcctgagccaccacacctggcctacagatttctttatagttatttttattagttaataggtatataatggtaatataggttgtcttattttgctttcttttaattttttacaggactaagtatttttccacataataatatactatccatagtcctcatgattaaattatcaaattgtctctttcaaccattagtttagagaagtcctgttaataaaaatctgtatttctatccatgatcatacagtttatacagtaggccttttatcagttgtatgcatatatatttcacttggctaaaattaactttcaaaacaaaattctaaatactctgagcccatcactgcctaaataatcctgtttctttaaatgctcatgctttttcttagagaaagcctctctttatgactttcttatagctccttaggagaaacttgatcatttttttttcaatcaagaaagtaattggcaaagttatgaggtaaaaagcatgctttttagcacacaagactggcattaagacatatgataacttcttatttgaaaatactagaattagaagatgagcactgaaaacggctttagatattaccttttttaaaagataagaaaaactaagacccagaaagcgtaagtaacctgcaaaagttaatatagctatttaggccaggcactgtggctcctgcctgtaatcccagcactttaggaggctgaggctggcggatcgcctgaggtcaggagtttgagaccagcctggccaacatggtaaaaccctgtctcccactaaaaatacaaaaaattagcctggcatggggattagcctgtaatcccagcactttaggaggctgaggtgggcagatcacctgacgtcaggagtttgaggccagcctggccaacaaggtgaaaccccatctctactgaaaatacaaaaaattagtcgggcatggtggtacacacctgtaatcccagctactcgggatgctgaggcaggagaatcacttgcacctgggaggcagaagttgccgtgagccaagatcatgccactgcactccagcctgggtgacagagtgagactctgtctcaaaaaaaacaaaacaaaacaaaaaaaagttcatatagctatttataccaaaaggaaaatgtcaaatcacagtgtaaatgatagataacttcaagttaatttcccacttgtcttatcacacattttcctcttatagtgtcaaatactcatccctggtggcacttgccttcataattcgtcccacagctgtcattctgtggacacctttgctcttcagacatttctgtcaagaaccaagaaagcttgatcttattctacatcattttttacctgtagggtaagtgtggcaataatccatccatttattttagtagcctacaaatcacagattacgaacaagattttacatctttcagttaattattttatcttctaatgtcaatgagaactcttagtccaaggaaatagaataatgcaaaacttatattttttatttatgatcctgattataactattttaatttgcttaactgagtgcttttgtaattatttctaacttagtgttttccaatgctttatttcctaaatatttctcacatatattttagagatacttgattcttttacatttgtataaggctttataattcataatgtgttttcacatattacctcataattttcataatacttcagtctaggcaatatatgtttttattttgtagtagagaaaacaggaggctcgcagaaatttaaaatgtattagtcaaagtcattgggctggttgctatactggtattgaaacccacatcttctaactacactatgagctcctaggatgagttgtatcccaagtatctagtagactaccccgaataattatttactgaagggatgactgcattctgactcttacaacagtaatctttttaatatacaatcatgcaccgcataatgacattttggttagcactggactgcatttatgacagtggtcccataagattatattaccgtattttagtgtactttagtttctctgtttggctatatatatttttttatttgagacggagtctcactctgtcacctaggctggagtgcagtggtgcattctcacttcactgcagcctccgcctcccaggttcaagtgattctcctgcctcagcctcccaaacagctgggattacaggcgcctgccaccacgcctggctaatttttttatttttagtcgagttggggtttcaccatgttggccagctagtctcaaactcctgacctcaggtgatccacccaccttggcctcccaaagtgctggaaatacaggcatgggccaccatgcccagcctgtttagctatagttagatacacagatacatagcattgtgttgcaattgcttacaatattcagcatactatcatgctgtataggtttgtagcctaggagcagtaggctataccatatagcctagatgtctgtaagctgtaccatctaggcttgtgtaagtgcactctatgatgtttgcacaatgatgaaactgcctaatgatgcagttctcagaatgtatccccattgttaagcaatgcatgactgtactagtattcactagtcacaagtatttttcgggtagcaatctgaaaaggactaaattatcttgcatctcagttgctactgttgtcatttctcagatgtattaataacattgcattaaatgtattcattcattcaggaattatttaatcctactatgtgccaggcagtgttccagatgtaggagatgcatcagtttaaccaaaaaaagtacctgccttcatgaagtttacattctagtagggagagacagacagctaaaaagataagagtaaatatatatttgtcaagtgatggtaatacagggaaaaataattgtgggataagaaggatagaatgccagtgcttggggtaatgggggagctgttatttttaaatagggtagttgggaaagatcaccatgataaggtgacactggagccaaaacttaaaggagttgagagagtgaaccatgtagttacttgatgagagagtattccaggcaaaggggccagccaagtactaagtatgctgggcatgttcaaggaacagcaaggagactgatgtggctaaaagagagtgagtttgggagaatgtaataatgaggtcagagagatagcaggggctcagttcctatcggctttaccactgagggagatagaaagcctttttaatctcatcagcagcatgataataacttattcatttaataagcatttaacctactttgtatccagcatttgataattcagaagtgagtaagatacagtgtctgctctcaaagtcaaagtctgtgggggaaaaagatataacaatacagatgctccttgactcagggttacatcttgataaactcattgcaggttgaaaatatcataagtcaggcaaggcacagtggctcacacctgtaatcccagtgccctgggagaccaggagttcaagaacaacctgagcaacataatgagaccccatctcaacaaaaaaatttaaaaattggccaagtataggtggcactaggcacgcctgtggtcctagctacttgggaggatgaggcaggaggatcccttcaacccaggagttcaaggttgcagtgagctatgatcattccactgcactccagcctgggaaacagagtgataacctgtctctaaacaaaataaataacaaagaaaatattctacgtcaaaaatgcacttaacacatctaacgtactgaacatcacagcttagcctaccataaacgtgctcagaacgcttacattagcctacagttgagcaaaatcatctaacacaaagcctatttcataataaaatatttgaatatctcatgtaattcattgaatactgtactgaaagtgaaaaacagaatggctgtatgggtaccattttaaagttgaaaaatcgtaggttgaatcatcatcagttagggattgtaattcttacccagtgatttaaagtgttctagtggttgggcacgatggctcacgcctataatcccagcactttgggaggctgaggcaggcagatcacctgaggtcaggagttcaagaccagcctggccaatatgatgaaaccctgtctctgctaaaaatacaaaaaaattagctgggcattgtggcacatgcctataatcccagctacttgggaggctgaggcaggagaaacgattgaaccccagaggtagacgttgcaatgaactgaaattgcaccactgcactccagcctgggcaacagagtgaggctccatctcaaaaataaaaccttacatccagattatatataaaacttttaaaaatctataagaaaaagataactcatagaaaaattattgaaaaggtttcatcaggtacttcaaaaaatattaaaatggccaataaatataaagagactcatttcatttgttatcaaggaaaaacaaagtaaagccaccatgaaatactactatactatacatccacccaaatggctaaaatgatgtggaacttatatattcctgtgggactgcaaactaatacactattttggaaaacttttaagtacttacaaaagctaaataaatacatagttgcacttacaacttagggcaggggtcaccagtcccaaggctgtggactggccccagtccatggcctcttaggaactgggctgcacagcaggaggtgagcaagcaagcaagcattactgcctgagctccacctcctgtcacattcttacagaagtgtgaaccctactgtgaactgcacatgcaagggatctaggttgtgctccgtatgagcatctaatgtccagtgatctgaggtggaacagtttcatccagaaaccatgccccactcccacccccgcaacctgtttgtgggaaaactgtctttcaagaaaccagaccctggtgccaaaaaggttagggaccgctaccttagggcccaccaattccaatcctaggtatatgtctaacagaaatgcacatatatggataccaaaagatgtgtaaaagaatgttcattgcagcactattcacaatagctggaaatggaagcacagtgtccatcaatagaaggaatacatacagtgtggtatacatagttacaatacacagtattgtaaaggaatgaactacagcacgcaaaaaaacttggttcaatctcacaagcacaatgactaaaggaatttagacatgagtacatatggtatgatcctattcttataaaattcaaaaaaagataaaactcatctatgttatcagaaattaggatagtggttacctttgggaagaggaagggttacctttgggttacttttggggaggaggtagggactgactgattggagggacaaggtggtgctgctaatactctttatcctgctctgtatggcaggtacacagttgtgttcatgtagtgatgattcatagagctttaccttcatagcgtatttttctgtatatgtgtttgttggaggcagtctctgagatggcctccagtgatcccatcctcctgctatttatgtctttgtataatcccctcccccttgaacatgggctagatttgtcgactcaattctaatgagtagaatacagcagaagggatgggatatcacttacaagactgggttatgaaaagactatggtggccaggcacagtggcttatatctgtaatcccagcattttgggaggccaatggggaagtactgcttgaggcccggagtttgagaccagttgggtaatatagtgagaccccatctctacagaaaatccaaaaattatccagtcatggcggcacacacctgtagtcctagttacttggaaggctgaggtgggaggatcacttgagcccaggaggtcaaggctgcagtgagccatgatcacacactactgcactccagcctgggtgacagagcaagaccctgtctctaaaaaaaagaaaagaatacataaataaaaagattatggcttccatcttgggtgcctgtctcactcactcttggctgacttaccctgggttaagccagttaattatgtcatgaggcagctttaaggaaacggccatatgttgaggaacttagccccaccagcaaccatgtgagcaaatttggaagctgatctctccacctgtaattgaaccttcagatgaaactgtagcccctgctaagagcttgactacaattcatgagcgacctcgagccagaggcacccagctaagcaacacctaggttcttgatccacaggaactatgaaatggtaaatattcatagtttaagttaacaagttttggggtaatttgttatacagcagtagtctttcaataatctttttattaatatattttttacaatattaatcgattatataatcttatctactgatctttttcagtagatacctttcaaaatgtgtaaatctatattcagttggtgaaactgtaaagcatttttatagtggcttttgatgcaaggcacgtacaaagccatatgctaatagtggattttcagcaagctccaaatgtgaatcactatgctatttttgtttttcagctttgttactttgagtttgtctctgatgattgatcgtattttttttggccaagtaagtaaaagtatattaagctaacagctatttttatttttaatccattaatactttagaacagaggcaaatgattttttaaatgatatgggatacattacaaaagacttctaggcatatcctaataagcctttggttcaatttgttgtgctttctacataaaagaattagtactcctagctaatattcaggagagtacattttaaggcagggaattattaagtgagcactgaatgttacctgttgctgtttctgtcattattgtcagctttacgctgtaattcaaattgtaatgttttcaaagctttatcttcacaggtaatatgtcacattgtaaagtaccacacagtccgaaaaatatgtctactatcctctttatctcttaactggatataaaacttggatggagctggaggccattattctaagtgaaataactcaggaatggaaagccaaatatcatatgttcttacttataagtgggagctaagctatgggatgcaaagacataagaatgatataatggactctggtgactcagggtggggaagggtgagagaggggtgagaaattcttatttcgagtacatattgggtacagtgtacattgcttgggtgatgggtggaccaaaatcctagaaatcacctctaaagaacttattcatgtaaccagaagccatctgtaccccaaaaacttgaaataaaaacacaaacttagactgccaaaatataagtttgattctcactttgaatctcaaaaatctagttttacaaattaacaaggaacacattaatacttaaagaagaaaaaataacagttaagaaggatttcatacagtcattaattaaaattattaggccaggcatggtggctcacacctataatcgcagcactttgggaggccgaggcaggcagatcacgaggtcaggagattgagaccatcctggctaacatggtgaaaccccgtctctactaaaaatagaaaaaattagccgggcgtggtggcgggcgcctgtagtcccagctactcgggaggctgaggcaggagaatggcgtgaacccgcgaggcggagcttgcagtgagccgagatcgcgccactgcactccagcctgggcgacagagcaagactccatcttaaaaaaaaaaaaaaaaaaaaaaaattattaatgtaaactattgcctggtttttagacttcaattctgatttaatgtcaaaattgtatcaatcccctaatgccaaagattactacttggcactaacacatttctatttatttttccttcaacggtgccagtggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttataggtaagattttatttgttcaaaaggctaaaattttttatgttaccaagaaatcaaattaaattcttcaaaaagtaaactttatgttttggaggtgccattaacttttgttagtgggaattatcttagaagatacaagtagtagtaattatggaggcactagagtgaatactttagatatgtagtttgcttaataaggattacactcaatttttaagaacttggactaattttatttgctttaaaaaaaaaaaaaacagaccaggcacagttgctcatgcctgtaatttcaatactttgaaggccaaggtgggaggattgcttgaagcaaggagttcatgaccagcctgagcaacatagcaagaccctctctctgaaaaaaaatttaaaattaccagggcatgatggcatgtgcctgtagtcctagctattggggaagctgaggcagaaggactgcttgagcccaggaatttaaggttgcagtgagctatgattgtgctactgcactccagtctgggtgacaaaacaagaccctgtctcagtcaatcagtcaatcaatactaccaaaattttaaattgaaggaccacagaaatacattctaaaataaaaatgtatgtatccttattccaaatttgactaatttcacttacttggattgaaatagaaatcccgtttttagaatgtaactgtactttgtaatttcaaattgacatcatattttatgattagttttaccatatcataatcaccttataactaaaaaataagatgaatttctgaagcaagaaattcagtctgaatacttagaaaataaatagatcaagttaaatatattttatattaaatatattactttctcaatctatcatataacatgataattaatattttttaataatatttgtttttattacagcatgttgagccacaaagaattcaggtttatttatccagttttaccattctgtatggtgttctgtggtaagtgcttttgtttgttatagaaaataaattatatagaaatagtctaaagacaacacatcctcattaaactatgtctattttcaactaggttaataaggaattacttaattacagattaattatattactgcaatattccctttttgtagtccaaatatcttttttcctatatcctctaaagtgagataaaaacataaagatcctagcccagtgcagtggtgtgcacttttaatcccagctactcagaagcctgaggcaggaggatcacctgagcccaggagtttgagaccagcctaccatatggcaagtccttctctcaaaaaacagacaaacaaaaaacccacataaatatccaatacccaaagcagtttttggtggtggtgtttctatttggtggtggtgtttctcactaaaaagtaaagtaacatgtctgtttttagattagctattttaagtttatggttaaactgtaagggtcttcattttcacaaaggaaaaatgtatttactgctgttgaaactagtttttaatgcttttacacacaaaacatttacacttttaaaactcactctaaggcatatgcaattattattattatctttttagacagagtctcactctgctgcccaggctggagtgcagtggcacgatcttggctcactgcaacctccacctccctgtgttcaagcaattctcctgcctcagcctcccgagtagctgggattacaggcatccgccaccatacccggctaatttttgtattttaagtagagacagggtttcaccgtgttggccaggctggtctcgaactcctgacctcaggtgatccacccgcctcagcctcccaaaagtgctgggattgcaggcgtgagccaccgcgcccagcctggcatatgccattttttaagtaattaactcctgattttattcaggccttttctccatttttccacagtcttaacatgtatttttttgtcacttacaaaaatccttacatgactcaattcaggaaaatctgggtttttacattggttggtttggaaaaattacgaattgaaactttattaacttcaagtttaattcggaataaatgactgttgacttccttcaaatattaagaccttaaaaaaaatcacagcgttgagagagaagaaatgactagccaactggaactggaggctggaaaaaacctagggagttacagttttcaaacttattttttacttaaaaaaaaagaaaaacattgagttaggcaatgtttgaccaagtatacatcaactcctacagatctgagatgtataatctcttcaatttaagaagataaacatacaaatataaaatcaaatattaaaaatctgtatttttgatacatctgaagttctgaaatcaaagcctcagtctgtcattactttacagtgtaaccacatacaaacgcaggcacatacaaaaatttagacatctaacagctatttggcaagccttaagaatagctggccccatttgtcagaggaaatctgttcataaatcactattcagatgttaaatggtttctgttctgttgggtttttttacagccacttgagtgtgtattataattaaatcaagcattggcagagtacaaaggcaaatgtttttgtgtgcctggaggggacggggaggttggttagtaacttggtttgatttctgttttcataaaccagatttttccagcattcctcttctgtgtcctgttgctttaccaagtatttacacaaagattgagttgtctgaatcctcattgccagtctaaaagattgaatctttaagtggcaagatccctgtaaccagggcctattcacagtttattgagataaaatgctgatgaggggtaaagagagccccttctaataggtaagaatcaccccttcttccatcctctgtctacttagaaggatccctaaaagacagcaacctagaaaaccccttgatctcctcacaggatgcattcttttcctccacaccctacctaaggttctagagtgggtcaaaaaactctaattcctaggagatttgtacttccactaacagtcagggctgtttaatgccaagaggttccaacagtaggatcagttctgtctagtgatgtcacctagacagaaatctctggacatttagaacagttctctttggagctcttgatgttttagtgacccagtttgaatctttcctaactacttgaaatcttgagttataccacaaatttcagccttattctgctttgtgtgacttgttttaacctatttttatgtaaacatgacaactctgtcagccattgctgtgtaaaaggccacctcaaaactgtagtggcttaaaactccatttattataatttacaggtctacatttcaactgggcagttctcatctccactgagctcacttacacagctgcagattgggtagatagctctattgacctaggctgggctctcatgtctggggttcaactagctgtaggccaagtcttctcagctcttctgagttttctcttcctccaacaggccagctagggcttgttcacttggcataggccgggttccaagagagggagcaaatatgcaaggccctttgagacaagggcttggaatttgcatactgtcacttccaccacattcttttcatgaaagcaagtcactgggccaggccagattcaagaggtggggaaataaatgccaacctcatagtgggatgggacacaggaagaaaaataattgcagcagttttttcagtctacggtaacttctcttgcctaatttgaatttcccttagtcctataaaataggactcaactctagaaaatatattttgtgactggctctgatctttagtgaattgttcaacaatgtgcctcattttccttatctgtaaaagaaaggtgatattttagcaacactaattaaattcttagtttgaatctctcatttgtgctgacagagttcagcacccactactgattctgagttgagtgtctgcttatctgtttttaccacagtggctaatatagacttctctcttactgggccactttgtttttccatattcttatctttttttttttttttttttttttgagacagagtctctctctgtcgcccatgctggagtgcagtggcgcaatctcagctcactacaacctccgcctcctgggttcaagagattctcctgcctcagcctccagagtagctggaattacaggcccatgccaccacagccagctaatttttgtatttttagttggggcttgaccatgttgaccaggctggtgtcgaactcctgacctcagatgatccacctgccttggcctcccaaagtgctgggattacggcatgaggcaccacagctggccccatattctaatctttttatcaaaattgcatatgtacattatttcagaagacattccacaaggaattaaaaaaaaaaattgttcccctgctctccctatttcctctccccaaaaacaatcagttaagcattctttcagctggttattttggtatttatctcgatatctctaaaacatttataatgccacttaaaggtctttgttttaggcattaactgttgaattctatcgaagatggaaagatggctttacttccttaacaaaatagcaacataaaattcttcctggccagctgccagtggctgacgcctgtaatcctagcactttgggaggctgaggtgggtggatcacctgaggtcaggagttcaagaccagcctggccaacagggtgaaaccctgtctctactaaaaatacaaaaattagctgggtgtggtggcacgcacctgtaatgccagctacttgggaggctgagacaggagaatcacttgaaccctggaggtggaggttgcattgagccgagatcggcaccactgcactccagcctgggtgacagagcgagattctgtctaaaaaaaaaaaattcttcttgataccttcatctgtgcccagtaccctcattatggttagtagttcaaagtctctctttcccagccccattctactgtatgtcccattccagaattgaaccaccttttgttgttcttatctaaacactgaaactaagctttctcaaagagtatttaaaaatagaaacagtaactcagatatctctctaattggtaaaatgtggtagggattttttttcttaacattaggtttcctgataattcttgtcaaaaccaggatggaatcagcaatgtacagtctcagatactcccatcctctctattaccgtgaaccttaccttggtaagaaggaacgtattagtgattgctggaaaatacagaatgccacgctagatatccaaaatttttaaagtgtgtatatcaagctaaataatacatgatgattaagagatatggctttataaaggaaccacctcatgaagtatcttcttatatgctcaggtttttagattttatcctgaagagtagtcaactgagatgtaatggattttaaacatttctgtaacagtagtctgatgaacatgatctgataggagcccagtgtatttttttattataaaaataaatgccgatggtacaaaaatagtgtgtcatcctcaagtcatctagtcccattccccagaggtaactattgttatcactttcttaagcagttcttccagaaattttctgtataccgactttcaagtatctttttgtaggcccagataacaggagcaaattaagtatttaggggtgatgtttagcatccagttagcaatgggttgttactatgtgaaaggaaggaacctatactttagtcactggggtacacacacagtcttaaatcttcagtgattgggatacacatcatttacgtggtggggatgatcactttctgaagctaggtcatttgagggtggattatttcagtgagaactccatctccaaatttgtgcgtgccattaagtagacttactggatgtcacctactggaatcttgttcatttgttttaaatattgatgaaacaatactactggtctataagaaaaccatggaccttaggcttctcttgtggttcactcagtctagcattggaactggaaaatctttccaacccttcctttagcaactcatttctgaaatcccctttggaagctttcagtgccagaaggtttaaaaacccctcagaggccttaaattcaggactcttgacttatactctaaagttgggttcttttctaacatgtgcacaagtcatttgatgataactgaaattataaagatattttctttatatgtcaaatgcatagtaatgcttataggatgctaaacatgtaaataaaggcagttctggctgggcgctgtggctcacgcctgtaatcccagcactttgggaggctgtggcgggcagatcacctgagtttgagaccagcctggccaacatggtgaaaccccatctctacttaaaatacaaaaattagccgggcatggcggcaggcacctgtaatcccagctacccaggaggctaaggcaggagaatcgcttgtaacccaggaggtggaggttgcagtgagccggtatcatgccacttgcactcccgcctgggcgaaagagcgagagtccatctcaaaaaaataataatcataaagacagttctattttaaataaggttttatccccaaacttcatttttaagttggaacctgaaatatttttttcttagaaataatactgtgacatgtagtaaggctcccagaatattacacaaaagctcatcggatccataatactgttgaagacaattttgaatggcaactgtttcagtatccactgtccccaagaaaactaagctatcacctgactctccctggcattgttcagctgttccttctcttcccagcattttctttatattacttctctaagtaatatggagattcagttctcactaaaatgatccatcctaaaatgagctaagctcagagagttaaaatcaccatcatgtaaggcaagcattacctaacttaagagacgctctgtctcaccagtactgaagatgctggaaacacaagcatgttatcttccagcattctacccagagtgctattttcacagtcttgatcaccaagtattcccattttgtgtcacccacctatactattgtattcctagtgccatagtttcttttttttttttttgagacgacatctcgctctgtcaccaggctggagtgcagtggcacgatctcagctcactgcaacctatgcctgccgggttcaagtgattctcctgcctcagcctgcctcagctgggactacaggcatgcgcctccacacctagctaatttttgtatttttagtagagatgggttttcacgatgttggccaggatggtctcgatctcttcacctcgcgatctgcccgccttggcctcccaaagtcctgggattacaggcgtgagccacagcccccggccttgaatgaacaaattattaataagtgaatcactttacacatgctcaccttgtaagtatcttcaaataattgagaacaaactgtatcttctcgggccttgctgtaggatgggcttgctgtagtttggacgtttgtcccctaaaccttagttgaaatttgatccccactgttggaggtggggcctaatgggagatgcttcgatcatgggggtggagccttcatgaatggcttggcaccatcctggagtagtaagtgagttctccttatattaggttccatgagagttcccccgagtgctggctgtacaaaagagcctggcaccttccactttcttgcttctgctctctcaccatgtgatctctgcacaaactgactccccttcaccttctgccatgagtggaagcagcctgaagccctcaccagtggatgcttcttgtacaacctgcaggaccatgagccaagtaaatataaattagccagtctcaggtattccagtatagcagtacaaacaaagacaaggctttaatgtagctttttgtatttgagcctactaaagtagatgttgttttagcctaccaacctaagttaagtgcttcaacttatatttggggatctgctgtgtctgtgattggggttattacagatggttgaacttttagaatcctattttttaatttattttgagacagtttcactctgttgcccaggctggagtgcagtggcgtgatctcggctcactgcaacctctgacaccacgcccggctaatttttatattttagtagagatggggtttcacctctgttggccaggctggtcttgaactcctgacctcaagtgatccgcctgccttgtcctcccaaagtactgggattacaggtgtgagctaccgcacctggccctattttattcatttttattttcgtagagacagggtgtcacccaggctggagtgcagtggcgtggtcatagctcactgtcccctcaaactcatgagcacaggtgaacctcctgcctcagccttcccagtagctggatctacaggtgcgcactatcacgcctggctaatttttttttattttaaatggagtctcactatgttgcccaggctggtcttgaactcctggcctcaagcaatcctctcatctcagctattttatttcaaataaagctagttctaattatcattccttttagtaggttcctcattttaccatttcaaacatcttataaatgtagatttaagtgataggcttagttttcttaatcttgctacatttttcaccacaccacttttcagattattctttaatcagaactatttcaagtagattaaaaaatactaggtgacatggacatgtgatattccaactcatgaggtatgaactgtggatgatattaacatattcataggaggaacaaaataaaaaacactgccttggtcccattcagtattgtactaacattttgggcaaaccaaggtttggatgaagaatacccaagttcaaaaagaactattatctagttctataaaaagagtgtatgtaaattatgaacaaaatgtcatgcttactaataagcttaatcttttccagtggaaaggcctgttctttgtattctcagtagatcctaatatgtccattaatagtggctgttgctgaagaaaaggactatcagaggggagagagacttttacttatccttttatacccgtctattcattctacttggttttttcctttggttttttgttttgttttgccccacagaataatccctttcataaatcaaaaaagaaaaattgttcagcatctccaaattgcctgactgtagtgggaaaacaaaatttcccactgttgtgggaaaaaaaatgtaagacatagcaccttttcttccactcatatacttacggaaaatctcccaggtgcccaatggcttattttcctaagaggacacattattgaaactcgtattacacactaaaataccaattattagtgcttgggagattaaagaggtaggtaaatggaataattaaaagtcctatttatttagcaactactatgtaccagggcagtcactggacattttttctaacacttgaataaggtactattatcccaatgaccagcaaagtaaaacgacttgtgctagaactggaattcaaatctggacctgttggactccataaccatcatctttccactatacctcaataccttttactagaaaaagtcaagacctagatgacagtagtgaatggtgaatggtcagagatatgacttattgcttatttcttatttgtctataacagtattacagtttttgctatttccattaaaaattacagatgtatttgcagttaacataacaaaagattgtcagtgttaaggttcaatatgtctatcttcatataggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacaggtaataaaagatgttccactatatgctgttaagaaactgaaactgactactttaaaattccctttcagattcctggatttgaattaattggtcactgatcaaatgataaattttaaactcccacatatttattcactgatggattttaaaaaccacttgaactgtgtcaaagaaaatgttttaaataaactttttttcttttttttttttttttgagacggagtctgttctattgcccaggctggagtgcagtggcgcgatctcggctcactgcaagctccgcctcccaggttcacgccattctcctgcctcagcctcccgagtagctgggaccacaggtgcctgccaccatgcccggctaattttttctatttttagtagagatggggtttcaccgtgttagccagggtagtctcgatctcctgacctcgtgatctgcctgccctggcctcccaaagtgcggggattacaggtgtgagccaccgtgctcggccgtaaactttattattctttaaaaacaatttacttacacctaattctgatttaaatcagtataaaacaatttgtaggtatctgatagtcttcttagtaaagaaactcatgtattacttaccttactacaaatctctgtgatacatctttacacaatttgaattaatcttaaaacatggattttaggccgggcgccgtggctcacgcctgtaatcccagtactttgggaggccgaggcgggtggatcacaaggtcagaagatcgagaccatcctggctaagctgggtgaaaccccgtctctactaaaaatacaaagaattagccgggcgtggtggcaggtgcctgtagttccagctactcgggaggctgaggcaggagaatggcatgaacccaggaggcggagtttgcagtgagccgagattgcaccactgcactccagcctgggcaacagagcaagactctgtctccaaaaaaaaaaaaaaaaaaaaacatggattttagtccagatttactactggattattgccctcatcttaaactagacttctttttttttttttttagatggagttttgctcttgttgcccaggctggagtgcaatggcgtgatcttggctcactacaacctctgcctcccgggttcaagcgattctcctgcctcagcctcctgagtagctaagattacaggaatgtgccaccatgcccggctaattttgtatttttattggagacagggtttctccatgttggtcaggctgatctcgaactcccgacctcaggtgatccgcccacctcagcctccccaaagcgctgggattacaggcgtgagccaccgcacccggccttaaactagatttttaatctctttggacatcagttgtctcacctgtaaaaaattagggaatgcgactagatgatattctaatgcttgaattaagtgtttctgggaaatatactaaaattgcctcaactatgtatggcctttaaaaagacatccatttgttcctgtgctttatttcaggaagctgtattagttactaattacccagtaatggtataggggcaaaggagccggatttcctacagaaaattatataccaggctgggcgttgtggctcacgcctgtaatcctagcactttgtgaggccgaggcgggcagactgcctgagctcaggagtttgagactagcctgggccacatggtgaacccctgactctactaaaatacaaaaaaaattggccaggtgttgtggcgcatgcctgtagtcctagctactcgggaggcggaggttgcagtgagctgaggtcataccattgcactccaacctgggcgacagagcgagactcaacctaaaaataaataaataaatacataaaatctataactatttaactcagtctggctttaaacaatctggagttaatgtctcctatgcacgttcaattaatttaattacagtggttatcattttaggggaatttaacacttggaatactcctatttaactaatcattaatgccagtaattaatatacagtttagaaaaatggagatcctagcaaaaaccacaggctaaaaggaagacatcaagtatcctttcaacttgaggattccctactatatgtatatgtggctgaaaaagggacattcactctccgtgctcacattagggataatactgaggagaacaggaatcctagatgtaccaagatgttctttatacttaactgtagtcagttgatgtcttaggctttgaatagttcaccaagttctccacaccttttcaaagcacacaagagaggaaagtctgatgcctattttgcatcagacttggaagtagagagcaacatctgtcccttgattaacatccaaataagtaatggctttactgtggcatagaaagactagagtaggccggcagctttttctgaggaatttctgcttccctttgaaacaagaccttcatttccaataaataaatcactattaggtcttgtgtacatttaatttttatgcatttcataaataaacctcctgcataattactaactccatttctaactggaaattttaaatgtttgtatcagtgaggtttaatttttcctaaggcaattataaacatggctttttgcatgacctaagtaactggcttaaattgtcataactggtattagaaatgaatccatcttttttatactctaatcttttttttgttttgagacagactcttgctctgtcgcccaggctggagtgcagtggcatatgatctcagctcactgcaacctccgtcttctgggttcaagaaattgtcctgcctcagcctcttgagtagctggaactacaggcacataccaccatgcccggctaatttttgtacttttagtagatacagggtttcaccatgttggccaggctggtcttgaactcctgacctccagtgatccacatgccttggcctcccaaagttctgggattacaggcataagccactgcacccggcctactctagtctttctatgccacaataaaaccattacttatttggatgttaatcagtggacatatgttgctctctacttctcaatcatcttaaataaaaaaaaaaaacacttcaaacttgccatgtggctgggcgtggtggctcacacctgtaatcccagcactttggaaggctgaggcgggtggatcacctgaggttaggagttcaggaccagcctggccaacatggtgaaaccccatctctactaaaaaaatacaaaaatcagccaggcgtggttggcgggcgcctgtaatcccagctacttgggaggctgagacaggagaattgctgggaggtggaggttgcagtgagctgagattgcgccattgcactccagcctgggtgacgagagcgaaactcttgtcttcaaaaaaaaaaaacttgccatataagtatgtgatccatcccctatcagagcagaaagggaagagagaaagaatcctttctgattatgatcacagtttcctactttatcaaatacacctatggagaattactctcctattaacaagttaacttacctggtcctgaggaccatttatgtttccggaacagaataccaatgctacagaatgttgagtccccctactgacctacttccctccttgaaatggacttctatgcactagtttgggcttataggttatactgctgctgctgcataggtacatggtataagaatcatgttttttttatctttgagaaaatgagttaaaggcttgcttcttcacttaactgcaacacagtttacagattcagatttcacattttgctaagtataaatgacatatcttaagactaatgaaaactttcatgttttacttgtatttattatggtaacttttcttttcatagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggtaagtaaacatgaaaaagaggaaaactcagtattttaattttaccccaggtttaggaaaccctcaggtaaatagataatataacctttttatggtctgtttcaacccacatttcataattagtcttttctccagtcaaaattagccccagttctgtaactatcaaagtattttacttcctataagttaattcttttattaagcaaaaagttgtagacagcaattagaataggcaattctaaaattgactgaaacagtactcagcaaaatgtagcctttatttacttaaacatttatttgcttctaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctcatggtgtagttttattgtttcttccacgatattcagatgtgcaaaaaatttcacaagaaaacaagtcagcaagctcttaagagggcagcaaattcttcacaagtcagagggctcttgaacccacaaaaagacaagaagtgagtgtaagattataaaatgttaatgatgaaattccagaacaatgtacttttctcaagctctgctgcaaatttaacacaaacatcagtgttaattacactttgtcatgtatgactgagcttgctttaagctcttacactgaaaggaagtctcatttcatgcacaaaatctgttgcatgcctggcttccttaataaaactacagttgaacatttccagtgtcaaaaaaaattcaacgaagctaaactacaggaaaatgcaggttagtagacttttaactaatgcttctgaggaataatataaagttatcaaactgatacttagaaacaaaagaaaagacattgtcatcttggtaatttcattagtttcaataccaaacattatacaaagcataaatttttctcttacagttgtctaatttaactcaattgtgaatcagtattgaggatcaaaaggtaattgccccaattctatttcaagatttgccatttgtcttccattagtgcgaccatatttatgccatttaccttcccttttataaggctgtggctgaaggtgcttctgctcttgttttcgatgcctggagttttcaatatttaccatacgttgctttttatcaggtcgactgaaagcagtaaacacatttttcatctatgttagagttcaatgtatttaaatttaaaacaattttaaatgttttctccattaatctatgatctgaacactgataaaagatattaaatatctgaattacaatcctagtatatccatataaaaataaaggagtctgtattagtttttttgtcctatagaaagaaaaaatagacaataactctactggcaaaaaagggaaacactcaaaagataacaaagaaaagaaatgtgacaataaaataatgagatgtgtttccattatttttcctcctttcctataaaaatcagtccctccccgctggctttatcactcagcagaaatacatacacatctctcacaaacaaagcaaaacaaaagtctcaactttttcttacagcaaaagctcacaacacctacaccgctttccttaatgtctatgatcaggcttccgtcactacttcactggaagtccatactgtcatcccctggccgcccagtttccaagccaagaaaacattttccgcacatcaactttttaaaaagcatgacacatttattccttttacttgagatggcttttggattttcaaggtaccactccccactcttgtccttagccttccctacaaccccatggatgttggtgttctcccaggagtctgataaatatacagtctcggcaaaagagatgaccatagaactaactgccaactaaccctctccacttgaatgtcagtagttacctccaaacacaattctcatctccaattacccttgccccaaaccttgaattccctatctcagtggtactactatccaacaacagatgacccaacccagaaatctagaagtcactgttactttctacttctccttcacaagaaatatcaatgttactattttccaaatgttttttcctttcctctcctactagtatagtcccagtttagatgttcatcagctcatgtctgtattatattgaccaccttctagcttcatacctttcccatcaatcctctaggctgctaccaatacattagtcccaccgtatccacggctttactttctgtgattgaggtttccgttacctgtggtcaactgtggtctgaaaatgttaaatagaaaatttcagaaataattcatcagttttaggcggggtacagtggctcacgactgtaatcccagcactttgggaggtagacatgtgtggatcacttgaggtcaggattt

SEQ ID NO: 16505 - DNA, 39498 bp, Human; identical to SEQ ID NO: 12410

SEQ ID NO: 16506 - DNA, 24193 bp, Human
ccttgagatctaatcatgtactttttttttttttttcttgagttggagtcacactttgttgcccaggctggagtgcagtggcacgatctcggctcactgcaacctccacctcctgggttcaagtgattctcctgcctcagcctcctaagtagctgagattacagacacctgccaccacgacctggctaatttttgtattttgagtagagatggggtttcaccatgttggccaggctggtctccaactcctgacctcaggtgatccacctgcctcagcgtcccaaaatgctgggattacaggtgtgagccaccgtgcctggcccttaatcatgtacttgtaatagtctagaaatattatggttattggaaaagtgaagttaactctcagcaaataaactgggagttaaaattggaattcctccacaggtctcattttagtaaggcactcagaaacaagtaatttcaaagcagcatagtactgggctcaagcgatcttcccgcctcggcctctcaaagtgttgggattacaggcgtgagccaccacacctggcttgagtgtctttagattcctcacgtaaaaggcagagagctaggagttaagtgcaggtggagagggtgcaggcacccggctcttttcgtttgttttgtttttgagacagggtctcactgttgcctaagctgtagtggcaaaatcatggcttactgcagcctcaacatcctgggctcaagtgattctcccacctcagcctcccaagtagctgggactacaggtgcacaccaccatacccagttaatttttgtattttttgtagagacagtgtttcatcatgttgctcaggctggtctccaactcctggactcaagcgatctgcccagctcagcctccaaagtgctgagattataggcgtgagtcaccgtgcccagctgagacacctggctcttacagctccagatgaaccctttcctgtgtgatcaccccactggcactccagactgaacaacatagcaagaccctgtcaaaaaaaaaaaaaagggggggggccacttgagtgtttctatttctatttatttatttaattcttttattttttggagacggagtctcgctctgtcgcccaggctggagtgcagtggcgcgatcttggctcactgcaacctccgccttccgggttcaagaaattctcctgtctcagcctcacaagtagctgagactacaggtacaggccgccatgcccgactaattttttgtattttagtagagacagggtttcacgtgttgcccaggctggtctcaaactcctaagctcaggaaatctgcctgcctcgacctcccgaagtgctgggattacaggcgtaggccaccgcagccggctcactgggggcgcagtaaatgccgatttcccttgggtatcttcatttctccttagagccgagctcggtgcgccgcgggcaggagtgggtggggcgacagtaataagagtaacagcaagcgtacacacggccttccaagtgtgccagacaccgctctaacactgaatccgcacaacccgaaaggcaggcctttttttttttttttttttttgctttttgttttttagagacgggagggtctccctgtgttgcccaggctggtctcgatctgtcggcctcaagcgatcctccggtctggggcccccacagtgctgggattacaagcgtgagccaccgcgcccggccaaggaagtcttaatgtacctcttttcagacaggaaaactaaagtgtagcgcggctaagtaacgtaggaagcatcaatcatgtttctggtcaaagaagcgaaccaagtcaattctcaggcagaagcagcggagattctccgcagccggcagcgcccagggcgcccggaacccagagagcgagaccgcgtgaaggaagtcccgccccgccccgtcctgccctggcctccaggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatggcggcagctgtggctgtggctggcggaggccgagcaggtaacggatcccgggctgaggggctgggccgggagggacgggcccgccccagcacgtgccgggctctgttccgggctgggcttagccaccccggagctgcggcccggctattttcagctgggtgttccctgtcctgaggagctgcggccccaggaaagcaagggcaggagatccgggagccgccacctgttgcctcacgtgttctcagtccgagagggttcgagacgcggaggaggctgggagaaattcagcctgtagtttcagggaattcattttggccatccccgcaggagtacgctgctaaccacagacaccgagcgcttgtttcgtactgttgtgctcattatttcactaatcttttcttgtgtaatccatgaagatcttgcaggcttgatggtgtttttcccacattgcaggggagaacaaagcccggacagcttgttgtttgccctagcccatccagctattaagaacggaactgggatttgaacctgggtgcactccagagcctgagctgagcacgtagccccttggttttccacagtgcctgtgtagttagtgacaggactggaatgcttgttttctaggccaccgtttctgcctcactggcctccgctttgcctcttaggagaagactccgggtaggggtttattaaacggggtttataatttcttttctaagggctgcatagagaacttcttagcccagcggtttcagaaatagctccagaagagttgaagcaaactgaaggtgatccagagagcgataatgtttctcctcaagtttcagaggaaagtgccacaacgagcaagttggcaatgccctctcaaacggcacagtaaacatggaaacaatttgacttcgggcctaggacctgtaccatggaactctccaaacaggaaactttcattctagattccctccctccccttatcactgccctccaaaatattgggcgatacactacaataatagcagacattcagatagtgccttctgagacccaggtcttaaccctttacacatggttgcttattaatcctccaaacaaccctgaagagtaggtatgaaatactatgactgtacctgttttacagatggaagaatgaagcatcaacttaataaactcttggcgtagatagcgatagtagtagaccttaatcatgtgttgtggtttgtgatgtactagtgtgtactctttctatttcatctgatattctattctgtagatgagggtagtggtactcaagactttgccagggtcgccaaagctagtaaatggcttcaagctggaattggaatgtagagtctgagtatgtgttctttgtgttggcctaaaatgcatacaattttggctttggattatctgttagggtgtcaaaattaccataaattgcataataacttagtagctaagaaaaaacttggagaataagagattaggaggaatgcagaaaatttgtagtaaggaaagtatgaattttgaaaagataaattgcttgaggggaggaagcagtatggccgtgctgccctctgctgctttgctttggaaggagcccagaggtgtcatgtcttctgtgactgtaaaggttccaggcagttctgccacatgtggctgccgagtacttgaaatgcagctagtgtgactgagaaactgactttttacttttatttatatatttaggttttgagactgggtctggctctgtcgcctaggctggagtgcagtggcacaatcttggctcgttacaacctctgcatcctgggctcaagctgtcctctcacctcagcctcccaagctggaactagaggtgcacgccaccacgcccggcaaatttttgtgttgttttgtagagatgggtctcactgtgttttccagtgcggtctagaacttctggactcaagcgatccaccgaccttggcctcccaaagatgtgagccaccatacctggcctgactttttacttataaatattttccaatactttttaattaatcaatttaaatttaaatagccatatctggctagtagctcctttcttggataaaaaagatctaagatgcaagatccttcccggagtcactgtttgcaagtttcaagtgaggtttaaatcagtttcaccactgtttgtattcagcccttggatctaagttccgagctgcctgtgggctgccagctattttttgcagcctaatttttccagtgatggatgaatgtaagacatcaatgtgtttattttctcatcaatatctcctggaattgctttcagttgcactcatttgctgtatataatttcctggcaaaactacttacagaatttctaaatttggtttctgtaaatccatctaagtaaaatggccaccatcatgccaagcactaaggattaagcaataaataaaacaaagctcctcaagaagtattcattctagagggaaatgacaggttaataaatatgtaaaaatgtcatgtggtgataagtgctgtaaataaaaccaagtgacacagagtgtgttttacattgaagtcagggaagacctctttgagaagatgacatttgattccagagagcagaatgtgtgagggagtgaaccaagcagaggtctcaggcagaaggaacagtcaagagcaggattatgttgttgttttatttattggagctttcttttttttttttttttggagacagaggcttactctgttgcccaggctggagtgcagtgccgcaatcttggctcactgcaagctctgcctcctgggttcaagcgattctccaacctcagcctcctgagtagctaggactacaggtgcacgccaccatgcctggctaattttttgtattttagtagagacagggtttcaccgttgttgcccaggctggtctgttggagctttgttatagtatactttaccatgattcattgagaagttctctcccaccccacctcgaccccactacccctggccagtgtactttcaacttggttgcctcaaattttaatttaagggttgggagatagggtagtgctgctaacatgaatcagttttttttccttggtgtcacttcattcaaataactgtgacactgagactattttattttattttgcctattctgcagacattgggtttgcctatcacagatgaacaaatccaggagatgaaatcaaacctggagaacatcgacttcaagatggcagctgaggaagagaaacgtttacgacatgatgtgatggctcacgtgcacacatttggccactgctgtccaaaagctgcaggcattattcaccttggtgctacttcttgctatgttggagacaatactgtaggcgcctgtgttgtttatacttaaaactcagtctctagaatctatttgtcaattttatttgatgttgtccagttgaggaagtgacactatagatcttttttttttttttgaggcagagtctccctctgtctcccagactggagtgcagtggcacggctcactgcaagctccgcctcctgggttcacaccattctcctgcctcagcctcccgagtagctgggattacaggtgcccaccaccacactcggctaatttttttgtatttttttagtagagatggggtttcaccatgttagccaggatggtctctatctcctgacctcgtgatccacccccctcagcctcccaaagtgttgggattacaggcgtgagccaccacgcccagccagatctttatttttaaaggtatcttggttgaaaacgctgaggaattttttcagcttttagtgtgcttccaatctaaactgtaagcaccaaatgacctctataaaataagacctacagatcctgcttatgcattggtttgctggatgtaagccaaggccttagcattttaatggctgaggtaatttttcaaaggaattttttttttttctttgagatggagtcttgctctgtcacccaggcgggagtgcagtggcatgatcttggctcactgcaacctctgcctcccaggttcaattgattcctgtgtctcggcctccccagtagctgggattccacgcgcctgccaccacgccgcctggctaatttttgtatttttagtagagaggggttttgccatgttggtcaggctggtcttgaactcctagcctcaggttatctgcccaccttggcctcccaaagtgctgagagtgctgagattacaggcatgagccactgtgcctggccttcaaaggacttgtgaaatcctttgaagacctttgaaggactctgaagtccttcaaagaccctgtctcaaaaaaaatactttgagacagggtctcgcttctgtcacctaggctggagtgcagtgacacgaacatggctcactgcagccttgaccttctgggctcaagtgattctcccacctcgggctcctgagtagctgggaccacaggcatgtgccactgcaccaggctaattaaaaaaaaattttttttttttttggagacagagttttgctcttgttgcccaggctggagtgcaatggcgcaatctcagctcactgcaacctctgcctcccgagttcaagcgattctcctgcctcagcctccctagtagctgggattataggcgcctgccgccacgcccagctaattttttttatttttagtagagacagggtttcactatgttggccagcctggtctcgaactcctgacctcagacgatctaccctcctcagccccccaaagtgctgggattacaggcgttagccaccacgcctggcaaatttttaaaatatttatagggacagtgtttcaccatgctgcccagaatggccttgaactcctgtgttcaaacagtcctcctgccttagcctcccaaagtcctgggattacaggagtgagccagcgtacctggcctagcttgtgctcttaatcagagtatacccatggaggttgaagttagattccagataaacgtccaatttgagaataagccagtaatttttaagttgcctcaaatgctttcttatttttttgagacggagtctcgctctgtctcccaggctggagtctcctgcctcagccttccaagtagctaggactacaggcgcccgccaccacacccggctaattttttgtatttttagtagagacggggtttcactgtgttaaccaggatggtctcgatctcctgacctcgtgatccacccacctcggcctcccaaagtgctgggattacaggtgtgagccactgcccctggcctccaaatgctttctttagtcttaaatgaaacataattaaaggcatctttgtgtaactggcgagtcagatagtgggagaagaacagtcttcttacttggaaaatcctttaaaaaagtacccagttgtgtggatgggctcaacaattaccgtttcatatcgacatgtgttggagctaactgaaatatgtacatctggagattaccttcctcacgagcagctttatgtttcctaaaccttgatattctgggtcattcctttccttgttagcaactgtaggcaagaaaaatgggggaggctgggcacggtggctcacacctgtaatcccagcactttgggaggccgaggtgggcggatcatgaggtcaggtgattgagaccatcctggctaacacaggtgaaaccctgtctctactaaaaatacaaaaaattagctgggcgtggtggcgggtgcctgtagtcccagctactcaggaggctgaggcaggagaatggcgtgaacccgggaggtggagctcgcagtgagctgagatcgcgccactgcactacagcctgggcgacagagcgagactcccatcttaaaaagaaaaaaaaagaaaacgggaggaaagtaatggaatgtgccatatggaagcttctcagaagctcaagccctcctctctgggaaaatagaaaccttgttgacttgcacattttccagtcattttttcttaattgagaatttttttaatattggagagacagtcttgctgtgttacacagactgatgttgaactcctggcctaagcagtccacctgcttcagcctcccaaaatcctgagaatacaggcatgcgccaccatgcccaaccttcagtcatcttagataccatgtaccttgggctttataagtataaaggttttgttccttacagatctcagtagtactgttaagctggtgtgcttttcaaacagtaatcaggaaagaacaacttgtgttagtattttctggcgtgcttagtgggttggtagtggtgatataggctggtagctgagcaacccagcctttctggccaaaaagtgttatgtaataatattgtttgagcaaagctgctaaatataagatcattgcattttctttcgtaggacttgattattcttagaaatgcacttgacctgcttttgccaaaggtaaggagttggcagatgtttcctaccaaccctagattccctatgttaggagataggcaccagttacaactaaatcaacacagtgtaaatttttacatagactatcattttttcaggtgaatgacaaccctatgtttaatctgtagaactaattgtttcttcttctcctttcttcttctcttcctccttctcctttcttcttcttcttgagccagagtctcattctgtcaaggggcgtgatcaaggcttattgcaacctccgcctcccaggctcagacagctctcctgtctcagtctcccaagtaggtgggagtacaggtgcatgccacctcacctggctaattttctgtagaaatggtttttgccatgttgcccaggctggtctcaaactcctgagctcaagggatccacccgtcttggcctttcaaagtgttgggattacaggtgtgagccaccgcacccagctgtctctttaaaagactaaatggtttttaaagcatagccttttttttttttttttttttttgagatggagtctcgctcagttacccaggctggagtgcagtggcacagtctcagctcactgcaagctccacctcccaggttcatgccattctcctgcctcagcctcccgaacagctgggactactggcacccgccactacgcccagctattttttttgtatttttagtagagacggggtttcaccgtgttagccaggatgatctggatcttctgacctcgtgatccgcccgtcttggcctcacaaagtgctgggattacaggcatgagccaccgcgcccggcccaagcataggcttttaaacgaagagagtgcaaccaaaggcatgttgctgggatatgtgggtcaggattatgattttgttctgtttttctgccgtggtcttaaaatagttcatgacattttaggtagtcaactcagttttcaaattttggttactgtgaactcttccaggcactttagggtacaaagatggaaggatatggctgctgcctttcatgagttagcggtctaattttatacaaaattatctgaaagttttgttcctaattatgtaatgaacacaacctgaattcaacctctttctatcacatgatctttcttgtagcttgccagagtgatctctcggcttgccgactttgctaaggaacgagccagtctacccacattaggtttcacacatttccagtaagtgataagattacttcttgtttatgtgcatatggctttcagctgcttcttgagttctctgttttccacagtaaccttgaggtgaagaatctgaaaacatgatttaaatataagtaatttgggatgcttataaggaatgagcctgatatccactgagagagtaaatctaacagttcatttgggaaacattgggaaatacatatcaagagccttgaaaaatattctttatgatagtaaacattagaaacaatctaaatgggccgggtgtggtggctcatgcctgtaaacccaccattttgggaggtcaaggtgggcagatcccttgaggttaggagttcaccaccagcctggccaatgtggtgaaacgctgtctctactaaaaatacaaacattagccagatttggtagcatgcctgtaatcccagctactcaggaggctgaggcaggagaatcacttgaacccgggacgcggaggttgcagtgagccaagatcgcaccactgcattccagtttgggtgacagagcaagactccgtctcaaaaaaaaaaaaaaagaaaaaaatctaaatgttcaataataagagaataagtaaggcatagtattcatacatccataggttggaataacatgcaaccatttaaatgatgcttacaagatctaatgtgcaaatgcacttaggtttgtgttatggtaacaaagacagtttataaattgcacaaaaattggttgaaagtacaccatgatgtaaatgttgattactctggtttatgagataataggaaaattaaatttctttctactttttgagttttgttttgtttttggagagggagtcttgctctgttgcccaggctggagtgcagtggtgtgattttggctcactctcactacaacctctacgtcctgggttcaaatgattctcccgcctcagccttcctagtagctgggactacaggcgcctaccaccatgcccggctaatttttttattgtttggagagatagggtttcgccatgttagccaggctggtctcaaactcctgacctcaagtgatctgcccacttgagatccgcccacctcggcctcccaaagtgctgggattacaggcgtgagccaccgcgcccggcctagacatttcatataaacagaatcgcatacaatatgtgaccttttgtgtctggcttctgttgctgttttcaatatccatgttgaatcagaacttcggttctttttatgactgaaaagcgttccattggttgtaccatgtttcatttacccaattgtcaacaactgatggacatttgggtaatttctactttttggctactatgaataatgctgccatgaacaagtccatgctaatttacttctttctttgcttacaccaataatctgttagcagttaacaaggaaaacagtaagattaattttggggatatactatagcttgtgatgtgcctcctatggacattcctagtgttacgccttgatgttcctagctgtcagtgtcattagcctaagaggaaagaaattccatttggaataggttaggttatctattagaaattaggctgggtccaggtgcagtggctcatgcctgtaatcccagcactttgggaggccaaggtgggtggatcacctgaggtcaggagttcaagaccagcctggctcacatggtgaaaccctgtctctactaaaaatacaaaaaaaaaaaaaaaaaaaattagccggacgcagtggcgcatgcctatagtcccagctacttgggaggctgaggcaggagaattgtttgaacctgggaggcggaggttgtagtgagccaagattgcaccattgcactccagcctaggtgacagagcgagactccacctcaaaaaaaaaaaagaaaagaaagaaagaaattaggctgggcggttaggctgggcagccgggcgcagtggatcgtgcctgtaatctcagcactttgggaggccgaggcaggtggatcacgaggtcaggaaatcaagaccagcttggccaacatggtgaaactccatgtgtgctaaaaataacacaaatagctgggtgtggtggcagatgcctgtaatcccagctactcaggaggctgaggcaggagaatcacttgaaccccggaggcagaggttgcagtgagccaagatcgcgccgctgcactccagcctgggcgacagagtgaaattccgtctccgtaaaaaaaaaaaaaagaaagaaattaggctggtcatagtgacttatggctgtaatctcggcactttgcggggccaaggcaggacgatagcttgaggcatggagttcgagaccagcctgggcaacatagggagaccatggctcttaaaaaaaataaagttagccaggtgtggtggcttgtgcctgtagttccagccactcaggaggctgaggcaggaggttggcttgagcccaggagattgaggctacagtgagctgtgattataccagcgtgtgccagcctggggtgacagagtgagaccctgtctcaaaaaagaaagaaattggacattagggcaacttattcataattatatattttgtttttttgttttgttttgagacagagtctcactctgtcacctagattggggtacagtggtgtgatctcagctcactgcagcctcagcttcccggattcaagtgattctcccacctcagcctcccaagtacctgggattacaggtgtgcaccaccacacttggccagtttttgtattttttgtagaaacagggttttaccatgttggccaggctggtctcaaactcctggcttcaagtgatccacctgcctcggcctcccaaagtgctgggattacaagcgtgagacaccgcacctggcctcgtaattatgttttatgttcagaaacagaccttcagtggcttgatttgggctttttttttttttttttttttttgacatggagtttcgcttttgtcatccaggctggagtgcagtggcacaatcttggctcaccgcagcctccgcctcctgggttcaagtgattctcctgcctcagcttcccgagtagctaggattacaggcatgcaccaccacgcctggctaattttgtatttttagtagagacggggtttctctgtgttggtcaggctggtctcaaactcccgatctcaggtgatccgccctccttggcctcccaaagtgctggaattacaggcatgagccatggcaccctactttgatttaggcttaatgctggaaacaaagccattagctgctgtgtttgagtcctctggttatgtgtgttgtgtagctgttctccatagcatgactattcctcactggatcttgactcctcacaaaggctttcctctacttccaatctagagcagccatcaccattaccttcatcgttcttttattcttttagcacttaaaatctcaataattaatcttgtttcttttttttcatttgtttttttgagacagaatctggctgtgtcgcccagtgcggtgtcacagtctcggctcattgcaacctctgcctctcaggttcgagtgattctcctgcctcagcctcccaagtagctgggattacaaacacccgccaccacgcccagttaattttttgtatttttagtagagacagggttttacctgtctctgttggccacgctggtctcgaactcctgacctcaagtgatccccccgtctcagcctcccaaagtgctgggattataggcatgagccaccgcgcctggcctaatcttgttttgttttctttttttactcgtttacaatgtaagcaagtgccactggacaaggaccctgtctgtgttattccttgttgtatttccaatagtaagagtacatcagatacttggcaaatattacacgagtatctaatgtatttcttaccaatgtctgtggatatagccatgaacaaaagggacattgtccctgcccttataataaattgtctcttgccgtgcatcacagtggttcatgcctgtaatcccaacactttggaaggctgaagtaggtggatcgcttgagacatagagtttgagaccagcctgagcaacaaagtgagaccccgtcactacaaaaaatttaaaaattagccaggcatggtattgcatgcctgtggtcccagctacatggaaggctgaggcagaaggatcacttgagctccagaggtcgaggctacagtcagctatgttcatgccactgcacttcagcttgggcaacagagcaagacccagtctagaaataataataatttaaaaattgcctcttgatgaagaaagtactatgctaatcgccttttagtttcatactccttgactatttgtaaatgacattgaatctccgtaacgattatttggttaaacattttatctcttgttttatctttaccagttactccctctcttacttaaattgttctccctccaaggggtaatggtggttattaaaagaagcaatgaaaccttgatgatttaaggtctcggtctgagactttcgtgtgttctctttgggttttcaggcctgcacagctgaccacagttgggaaacgttgctgtctttggattcaggatctttgcatggatctccagaacttgaagcgtgtccgagatgacctgcgcttccggggagtaaagggtaccactggcactcaggccagtttcctgcagctctttgagggagatgaccataaggtattctgaaagtgacctgcaggacacagaaactcaatggtggagcctaagagacaaggctgcctttgaggatgataggagagattgactgtgggatgggtggggtctttcgactagaaggaagttgtgggggttagggagcgagacctgggtaggatgacaggttgaggcattctcacactggacacatggattattataaggatgtgtcttttctttccaaggtagagcagcttgacaagatggtgacagaaaaggcaggatttaagaggtaggtaaatgggaatgtgttggcctccctgttaagttgatggaagtcctatattcagtatacctgcagatttgaccttacaatttttgcctttttcttcctttgttcttctacccatttttttttttcctgtctctatcctgggttttactttcttactatctggattctttttttttttttttttttttcgcctaatcgtcttgctgacatattttctggatttcattttattttattattgtttttgagacagggtcttactctgtcacccaggctggagtgcagcggtgtgatctcggctcacggcagcctccgcctcccagtttcaagcagtccttccacctaagccccctgtgactacaggcatgcctggctaatttttgtattgtttttgtataatttttgtattgttttgtagagaccatgttgcccaggctggtctccaactcctgagatcaagcgatccacctgcctcagcctcaaagtgctaggattataggcatgagccaccatgcctgacctgcattctctttttgtataatctataggaaaaaagaaaatgatttacttctggtttctttagaatacctttatccatgttgttaccatttttgtttctttacttagggcccccaacaggttaggctaaatctgaccatttccattgaggtccaccaggttccaccatggctccttctcccaggcatttctattgggctgtggccagacatgggcacgttgcaccatgtatccttcttgagtcaggccattgtcctgagtattagtgaaaagggtggaagaatagtttattccaggagcaagttaccactcaggtccactggttgagtataacttagcataccaataagaccaagcttttctttaggatgtgtttttccttgtttgacagagtcatgttttgaattattattattttataagagtctcccagtgatgcttaggctggccttaacctcctgagttaaagcagtcctcctccgttagcctcctaagtagctgggactacagtcatgcaccactgcaatggctttaaaatattttaacctaagtctctcttgtacttattcctagagctttcatcatcacagggcagacatatacacgaaaagtggatattgaagtactgtctgtgctggctagcttgggggcatcagtgcacaaggtgagtggtggcagcatgtggggtggggacaggagctttgggcaccacagacagactgaattaacctcagacttttacttaaccatctctctcaagcaatattttacattagttttaataatttgtggtctgtaaatgaaacccttaaggggaagactcgttttggcattttctttaaagttatctcaagcactgcaaaacatccatcttgttcagtggtatattaaattaatctttttttttttttcgagatggagtttcgctcttgttgcccaggctggagtgcaatggtatgatctcggctcactgcaacctccacctcctgggttcgagcgagcctcccaagtagctgggattacaggcatgcaccacaatgtctggctaattttagtagaggcagggtttcaccatgttggccaggctggtctcgaactcctgacctcaggtgatccacccacctcagcctcccaaaatgctgggattacaggtgtgagccaccgcgcccatcctgaattaatcttgtgattttctttccatgatgccttaagcagtgtttcacaaaagcgttttcatgctccttgaatttgtcatcccagtccttcgggaacagagaggagtcggagtaagatactctgcaggagctctttgggaggatgcgctggtcttcagctcagccacagcacacctaagagctcatctccttcatcagcctagtcacagctcccagactctactgcacactgacagtgtggggtgatgcttattcccctacctcccccagatttgcaccgacatacgcctcctggcaaacctcaaggagatggaggaaccctttgaaaaacagcagattggtgagtgctgtgtagagacctgtgagcacacattgctgctggaaggctgtggatgggggctgagagctcattcagcatgcttgcctactcactatcctctgaagtctctctgcctttgcatcttgtcctttttttacatgggcaggctcaagtgcgatgccatataagcggaatcccatgcgttcagaacgttgctgcagtcttgcccgccacctgatgacccttgtcatggacccgctacagacagcatctgtccagtggtttgaacgcacactggatgatagtgccaaccggtcagtggcacagggacatcacatacaccaagttgagtggaggtctgaaggagggacctagaagtaaaaggacatatttgagcatctctacagtctccttatccccaaggatcccagagtctagcagggaggcaaaaacataaaaaggacagtgtgataagtgttacaattggagtgtgtactgggtactgtggagcaaagaggaaggaatagtgtttgaggagtcagaaagcttcacagtagaggtgatgccttaagacttaagaaatacatgcatcttttaaagacaagatcgggagcattataaaggcacaaagcaggagaaaacacacttgagggagttactactacttgagtagccctggggaatgaagtcaacatgtgccaggaggtggggcaggacatggtcacagatagccagtttatgaaaggtcttctgggtcttttctgaaggcagatagatgtcagttgtggtgtctaggcacaatgacatcttgattagttatgagatgagtcagaaataatttgtaactactgttgaggtgccaacatgcgcatcattttctgttttatgtatatactcacttaaagcagattggcattactctcgcctgctcgcattttgctggaatttcttgagtggatacggatgtatagttaaacctagctttctgggatctgtgcataatccacgatttatctctggaaataagtcatgtgaactcattcagaagtcagccattgaatactttttagcaaggtgtgaccctgtaggtctgctgatttgcctgctaaaagaccctagcaacagtttggagagttggctgtaaggagacagggatcatgtcagaacaagttaggggctactttaaaagtctgaggccacattggtgcagtggccatgtaaatggagaggaaggatatagatccagagtcgaaggcagactggccagcccagccctggtggttgaccggagtgagtataaagagcttggtgagtggggcgctactgccatttactgaggcaggagctacaagggaggaatggcaggtatgtaatggtgagtaggaggaatgagaaagtggctgagttcagtttggggattgaggtacccatagatcaaccaggtggacgtctcactcagtaggtatgaggtctggcacttgagcaagtggtctggcctagaggtgacagatttgagggtcgtgaggttattggggtaatcataagattgaaggagattatccagagagtacagtcagtagggcaacttgttgggacacacactgcatttcactgaaattatttgtttaaagacatactgaatggctatttgttttctagacggatctgtttggccgaggcatttcttaccgcagatactatattgaatacgctgcagaacatttctgaaggattggtcgtgtaccccaaagtaagaagcctcaattcaaaagtaaagtactagggaggggttagaatgtgggagggagggtgctctggggtgtgttgagggagctgtattctgatccgataggcattcttcccacccgagctcatccttcagttcataagctctagggaactagctctgtggaattcatagacacattatagaaacagaaaaagaagtattttaaattgccttaaactatctagcagcatgaatcatcagctctggtgtgactaggcagagtagatgtctccatttgcctgtttttaagtacttgaggcagatgggttcatttctctcctatacttagctcttgaggctgagcactgatatgtaacaaataggggttttaagaattctttcaggccaggcgtggtggctcacgcctgtaattccagcactttgggaggccgaggcgggcagatcacctgaggtcaggagttcaagactagcctggccaacatggtaaaaccctgtctctactaaaaatacaaaaattagctgggcgtgttggcgggtgcctgtaatccgagctactcgggagactgaggcaggaaaattgcttgaacccaggaggtggaagttgcggtgagccgagatcgtgtcattgtactccatcctgggcaacaagaacgaaactccatctcaaaaaaaaaaaaaaaacctcttcctatgtggcaactttttttaagttaatatttcctttttaaaaatcaaaagtctgacagggcgcggtggcttacgcctgtaatcccagcactttgggatcacgaggccaggagatcaagaccatcctggctaacacagtgaaaccctgtctctactaaaaatacaaaaattatctggacgtggtggcgggcgcctgtagtcccagctactcgggaggctgaggcaggagaatggcgtgagcccaggagacggagcttgcagtgagctgagatcacgccactgcactccagcctgggcgacagagtgagactctgtctcaaaaaaaaaagaaaaaaaaaatccgaagtctgagttagtaagaaaactgaaaaaacatcatatagaataaaacaacttgttactctccataatgtggtagttagtgtctgtgctgtgcattttgtttgacatcctgctgtgtttatgactttaaccttgaggcacctttcttggtcattcaccgtatcttttcctataggtaattgaacggcgcattcggcaagagctgcctttcatggccacagagaacatcatcatggccatggtcaaagctggaggtagccgccaggtttgtaacccctcatgttcctggataagttgagagtgcacgtttggtcctgctctcttctccgtgaaggagagcagatgaaggtgtttatgtcattaccttcagtcacagtaatggtacagagcagtggccataatctgccatctatggagggtgattttggtgaactgaatttgttaaagtgaattacttaatcacttgtaggaaaagtccactcctagtgaaggaatgaggtctgacattctgtaggaaatgagcaggaaacgagcaaatgattcatgaggctttacagaagagggccagagcaaggtgggcatccatttcaggcttgtcctaagatgtgggcagagagttgagaagaccctggtacagatagacacaggaaccacctcagcctagaggggttttgtgtagagctgtgtagactgcatggatgggaagtatctgatgactttttaaaagtgttcaaacgccctgttagtagggaactgacaatacttcactgtcttcccaggattgccatgagaaaatcagagtgctttctcagcaggcagcttctgtggttaagcaggaagggggtgacaatgacctcatagagcgtatccaggttgatgcctacttcagtcccattcactcccagttggatcatttactggatccttcttctttcactggtcgtgcctcccagcaggtaagcttccaagaagcctcttttctgctgggctgcagaacctggggtactctctttgatgtttttgctttataggaggtatggtgggaatgggctagttagaagaaaatcagagcaggttgctggctaaaacttagatatttcggttttgtttctgttttgttttgtttttttgagacagagtctctcatccaggctggagtgcagtggtgctgagtgcagtggtgctgggattataggcatgagcccccacaactgaccaagataccgctgttttgagctgcctttatttctttgtgtagattttttggaattatcttttggtcttgagaatgtggtataatggacaaagaattaggttttattgtcaggtggatctgggttaaatcgtaacctctggcatttactggctgagaaggtaaaagtaaatatctcagtgttgtaatgattgaaatgcctgagtatatactaggtgctcagtatgtgttcaggtactgtatttaattctggggattttaaaatgaatagataggctgggcgcagtggctcacaccagtaatcctagcattttgggaggccgaggcaggaggattgcttgagctcaggagttcaagaacatcctgggcaacatggtgaaaccttgtctctacaaaaaaatacaaaaattagccaggtgtggtggtgtgcgcctgtagtctctgctactcagggctgaggcgggaggatagcttgagcctaggaggtcaaggctgcagtgagccatattcattcccttgccctctggcttgggtgacaaaatgagatcctgtcttaaaaaaaatacaaagatgaatagataatcctcatcttcagagagctcaaaacttagtggtgaatacttgtaaataggtcattatgataccaagcagtacgtgcaaggactgagggctaaaagactaaaactggaggtaggagaccaataaggaggctactgcaacgggccaagcagtagatgatgagagcttgagtgaaggcagtggtgagagacacagaccggggagggagaggaggttaagctcttggtggctacttgaagagggctgggaagcaggaggaaagaagctgtggtgatttttaggttggatggaaatggtgaaaccacctgagagaacacaggctgggccagtttgcgggaaaggttggtgagcatgtgggcatggtggttgaatcatctgtgtctaggcagaaattcctgataggcagttgaggaaaacaagctcagtgttggagtaaaagcttcatcaaattaggtttcagtggtatcccctgacattggaaaaggtattatctgctaatatcttaacattttcttttgtcttgtatttgctttcctctggcaggtgcagagattcttagaagaggaggtgtatcccctgttaaaaccatatgaaagcgtgatgaaggtgaaagcagaattatgtctgtagagttggaagagaattaaacgaaaatcattgttaattgctgaggcatgaaaattgtgttactataatgccttattttacctcgagaattgttaccttaaattagtacagcactttcttcttcccatggtgctttcctgtttctcagtctcacatttctcaacaaggcaaaaacaaagagcgttgaagttgactctgctcttgcatagtaaatgtagttcatacttgatctctgttctttcaaggcatattttccagctgcctcaagtttagtccttttcacgtgttcatttgcttgtaaagtagcaagaaatttctggtcctgtcttctaaaagtgaatttgatctaggtctagcaaaataacctggactcagtgattgagtcaatggtcagataccttttatttcggttatttttggctagtataagtgatgaagtttggaactacagtaaatacttaaaaaaaaaaaaaaaaagaaccaaaccctgatgtgaccatcaggctgattgagctgaagttgtgcccaagctcatttcatcttttgataaggcttatacagcagggaaatgctaattgagtatattgatttcatcagggccgctgacagtctttattccttgttgcatggattttgttgttgaggcttgctctgtcacccagactagagtgcagtagcacaatcttggctcactgcaacctccgcctctcaggttcaagcgattctccagcctcagcctcccaagtagctgggattacaggcgcctgccgccatgcctggctaatttttgtatttttagacgggatggagttttgccatgttgggcgggctggtcttgaactcctgacctcaagtgatccgcccatctcagcctcccaaagttctgggattatagacatgagccaccacacccagcctaatcttgttttctttttttacttgtttacagtgtaagcaagtgccattggacaagaacgttgtctgtgtcattccttgttgtatttccaatagcaagagcacatcagatacttggcaactaggcagtcttccagcttctgccactgcgcccgacttccttgttgcatggatttatagctgattgaagcaactgtagccaaagattgagttaattacctacctgccaggagagcactagtgttatttagcccattctcatcctacatatttttcggcatagatgaaaatgaaagcttttgtttatcagatttgcagatgacacaaaactgggagaattaacaagtatgtttatttggtaaaataagttttcatctctaacctaaatcggctgaaatgatgtgtcctaaactagaggaaaaagttaataaagatcaatgtaaataagttaatcttaaactcagtatgcaccagaactgagagaagactgttttaggaggtgttaatggttgtccagtgcccaaaaagccaccagaggcttactgctccgcactcttggcattacattcaattttggatacccagtctgaggaatagagatgaactggagagccaacctccaaaaagatcttgtggtggaggaatgttagggctctttatcctatacagaagaaaactcctcggcacttcaaatattgccaggtgcaggaagagtgacttgattgtgtgttgccccaagagacacactgagctcaatacccattactgagactggcttggggccagacattggaaccactgagattagcaacctacactcaatcccccaggtcaggcagaagctggaagactgcctcgttaggaatgttgtgagggagaggaggctgaatcggttccagttttatttaaaagtagccaggaaatcaggttgcgatgatgcgcatttacagtcccagctacttgggaagctgaggcgatagggtcacttgagcccaagagtttagtccaggctgggtgacagcgagcccttgtcacttaaagccaacctaagagaagagcttatccttttggaaaaacaatagaagacaattctgaaaaccaaattctgaacataggctagtatagcaagcaagcagggatagcatagagccatttgctcaacttccagaaagagttactctgttcatctctaaaaaatcttgaaaagggccgggtgcggtggtggctcacgcctgtaatcccaacactttgggaggccgaggcaggtggatcacctgaggtcaggagttcgagaccagcttgaccgacaaggtg

SEQ ID NO: 16507 - DNA, 17085 bp, Human
aatcaatcttagtccaacctcatcagaaaagctggaagggctctaagccctctaagagctagaaggaaccgaggaggtccccccatccagggctggccctcctcccatctctcactgggaccccatccttatggggggtggagtggatgattcattactatctagcatgctctttaaatatattcactaggggaaagattagcctggtttgttaacctcgattccaacagcaaaagtgactcttcaaagcatggtgaagcctggggtagtggcctcctcctagacccacattcaaatcctgtttcatgggcccccagaagtgtgatcgtttcagcatcatagcaggaagaggaaggcctgggaggcaggaaacctggtatggagaccccagctctgctcactcgctgtgcaaactagggccagcccctcctttccctcagacctcagtttcccgttattcaggataaggggttagacaggggtgattctaagggtcctgccagctctgacatttcagcatgtggatatctattctaaagtccttgaaacagttaagtccaattctccagatggaaaacaggtccagaaaaggcctggtctccagttccctcccttctcccttcgaacatgtcttactctctagagcaagattccaggcctgaaatatggcttcccaattacctaaggatgaagcctcaaatcttcggcctggcatttaaaagactccgtaatcttgttttacccaacctcacttcccattcttaggcctctcttctcaccatctcccaggtcactgccaagcctttgccaatgctgtaccccaggccttaatctttttcctgactctccttcaagatccagcttatccctgtgggctgagcatgcagtagatgctcaataaaattctcagcgagcccaaggccccctctcctgcactgcccttggcgtgttgaaatcaagtgggggccttgttttaatcatcattttcctagcttgtcgggcagcccagtccagggcctggcacaagggaccctcagcatccaataccagccaggattgggaggggctcagtgaccagccagttgggccaccccagctctttgccacaagagaaagttcagcctgggtttggactcagatcctggccccaccacttacaggctgcgtaaccctgagcaagtcactaacctcgcttttcctcaggttccacgttttaaatatggggagaccagctgtgcccactgtgggctgggtagtgaggattaaagaggaggatgcttgtacgggactagcactgggctggctcctaatgtgtcctgaatattacttgtcccgccctggccacccagtcccctcctctggtggaaggcacagcctgcccaaggctacgtctcaggttgggttcgattgtgtgtgtctgtgtagcggggctgtccccgagggtcggactcgatcctgcccggaccagtacaaggtgtggcccagcagaacgcatggacaggcagggctcggggcgggcgggacggctggggcggggctgggcggacccgcccctcggggcacgcggtctcccggcttctccgccagtatgtttgcttgcttttggggcccttctcaagccagatctctaacgtggatggagtggcgcgtttcagggtggggctatgacaatgcactgcctgtgcagccgccatcaccgcgccccctccaccggctccgcagtctcctgcccggctttcccttctccacctccatctctgcggcggtaaaatgcagcactcgcagagcgcctgcgcggctttcaggccgggcggcggcggcggcggtggctatttatagtaggtgacgtcaccttgaaatagaccgttagggccggcccgcccttcccccctcccactcccgccgctccccgccgcccggcctggccactctcactgcgcaggcgtcgtcccgtcctcccatcccccagcgcggccgcgtctcctccctcggcgttgtccgcggcgcgagccacagcgcgcggggcgagccagcgagagggcgcgagcggcggcgctgcctgcagcctgcagcctgcagcctccggccggccggcgagccagtgcgcgtgcgcggcggcggcctccgcagcgaccggggagcggactgaccggcgggagggctagcgagccagcggtgtgaggcgcgaggcgaggccgagccgcgagcgacatgggggaccgggagcagctgctgcagcgggcgcggctggccgagcaggcggagcgctacgacgacatggcctccgctatgaaggcggtgagcgcgccgggagcccgggcggctggccgggggggcctggcgttggggagggacggggatggccgcgggcggcgttcccctcccggccatgggcgacccggcgacccggctgggcgtggccgcccgcccgcccttagcccgcgcttcccgctcccgctgggcgccccgccacttcctgaggctgggcccagggtgggggatccgggagggtgcagttcgggatcgcgaaggcagccccggaaggggggcgggccggtcggggtcgccacatcttagttcggaacccggccgggggcagagggtgccctaggggacgcgaaggagccgcattcctcctagagcgtttcaccggacccgggggctccccctctcgtcttcctccgttccccaacttggaataaagaatcacctagtaagtggcgccctgtctcagctggttttctctgccacgacctgaagtctgcaattccgatctgttttgctctgctcgttcgaattgttctggttccatcttcccacgcctgggggtctggctttgtgtgcgaagacccctttcctgcagtctaggcgtggacgggggcgggagagtgggcggagggtgtggggccccactccacagccccaggtttgctgctgcgctgtctgcttggagattaaaatgaaacgtgacttctaggtgagacgaatctgtgtgtctttgcattcctgagaccctcataaatcgattctgcagcttctccggtggatgagtcgtgcccagccacaccctagcaaaataccgtgggtcacacaccacctgcatttctgagttccggttaccatctcactctctctccacgttattttacgttttctgtaaatgaatatttcctctccctgcgtcaaggtcacacagtggtagaacaactgcgaccaccaacctatgttcagtgtacaacctcctgagacctgggaggatccccttgaactccgccttagacttatacattcagaaattcgggcggtgagactcagacatctgcattgtaaccagctctcacaggcgatttttagctggcttaagtctgagaattactgcccatgattatagtaaatgtatcctttgctggccttttggagggagttccgaaaaaaaactgccaatacagaggctccctaaaatcttaagtcatttggaaagctcatttgaaggcttttgatgttaatatcagatgaaatatgtagttggggccaatatttaggattgttcaggtaagaaaggtgcttgaagagttgcctttcctctggtgtccttgttacacacataactgggtgtgtttggaaaccagcaacaccgttgcccgtatgttgatttgttggtgatcttgacttgagcactattagcatgctgttgtggtgaggcaggttttcttccagaccgggggacggtctaggtctggaggctgaactttatgtaattcagggggtcctttaaaagaaaatctaaaatatagttttgcatattttacaaaaatgggactgacgaatgcatttccttggaagggaccctgaaccttaattttctgtgggataaagctgcctctgtccacagcaggtcacacttaagcccctcctccccagtaactgagtggtgctgggattatgcaggctgaggcctctccacacattttcatgaagtggttgctcaccctctaagtgagacgtaaagactgcagtgttcggagccctttgggaaataaatgtggtgaaaagaaaggagggacgaggtttaaaggaaggggaaatggaggttaaggaaaaatggctagaaggtgtgttctggaacaatcagaaacctgaggcaacttgaaatgggggaaaaaggcaagaatggagagatgttaccagaacgaaatctagtttgagcagagaaaaagactggctttctagtaggcttgtaaaatgctttcctgcagcaagctacttgtgtccatagatcttctctggagggttaaggtagccttttgtaaaccaaaggaatctataatatctatatttgaaataattaatgagttggaaaagccacccagcgtagaagagtcaatccaagctttaattctgccatctcagaatggtgataaaccatttctcccccatcatctaaatggaatatattgtgcttatagatattttctttaaaagaaaaaaaagaatatattggaagggactggcaggggtcactttccctgctaacttggtgtttgtagattaaattcttaatgttactgggatgactcagtctctatgttattaatctcatcagccttaactaaggcttttggaaagggtgtaagtttcagtaaccctctgggtttacctgggctttcttcagggctggggaagggcaggtaagtagcctgctgtagggaggatggagcaggacacatgtgttaaggatatattctgatgccaccagtctgtaaccttgaaacttacatcttggctttaggtcctctgaagtataaaactagtgatgttgctgttattaacaagtcagttttgccttcagtcttctaacttgttttctgtttccttcataattaaaatgctcacttgataatactgccttcctgtaatgattgatgttcctcattctaccagcgtcacctggaggacagtgttggtaagcttgaagaaaaatcgtgcatactggaaacaatggtcttgcctcaaacctgttgagaacttctcttccctgcttctctccataatttgaagaagcaagaaatgtttctgaagtgaagcataaaggagtatcttcaagctctctctatctcatacctaccagcttgcatagagtataatagtgggaagaaatattgtgaaagattctagaacctaagtcctttctaggctaggcaattctaggctacacaattcgtagtctctgtaaataccatttgataactgaaataaacctataaagtgggattaaatgttagtccagaagactaagtgatttaaggaaagagggaaaataaccagatagatttctggtggatattcatagacagacataatttcatcatgtattatggccctaagtcatctattttatattaaaacatagatggtaactgtaaagttatcaaatgtaaaaattactgggctagcattgtgttttaacactgatacaccagttgattacagtgttgacagaaaacgggcagaaacacgtttaaagtacctgcagaatatatatatagaaatcttttttttttaatcagtgttgaccaggttggcctcgaacgtgtagcctcacctccccgagtgccagggcaaccggcctgagccacagcggctccctagaaatcttaagtgcaggaaacaaaactacagtttaaggaaacaggagtcggagaggaggggcatttggcccaaccactggcaaaaggctgttgttgcaacaactgtgagattctgggaagtggggaaatgagcaggtgctgtgtaaaagtgcacagctgactgccccaggtgagacagatcagtgtcacagagagtaggaggattttgaggtgtgattagtatttttttttttttcttaaagagatggtctcgttctggaacccaggctggagtgcagtcgtggcacgatcataattcactgtagccttgagctcctgggctcaagtgaacctcctgagcagctgggactacagatgcatgccaccgtgcccagctaattattaaattgtatagacaggatctctatatggtacccaagttggtctcaaactcctggcctcaagcagtcctcctgcctcagcctattaaagtgctgggattacaggagtgagctaccacacccaaccagtaggaaatcttaaagccacattgatactacagtttgaaatatgtaaaaactagggagctatgtttcccactaactgggcatttaaaatgtaatcgtctttgaggaaggaagaaggccctggattattcttgtaatagtttgaatttaaaaggtcctttcaggtgggcaaacagcttacgtggctttcttgcactgaaatagaaactgtagtccccatgtgggtttgggtccctgaattatccccagaagaacttccacagtccggaactgactcccttaaagaaaccaaaaatgtattttctttggtggggattttctttagttggtctttgtctgggattttatatcagtgacagactgtagcgtcacacttttccagaaatacggtttcggagagggtacccctaacgttttatgtgtgtgtgtgttacatttagcaagtttatataacatattttacttttttttttttttttttttttgagacagtttcgctcttgttgcccaggctggagtacaatggagcaatctcggctctctgcaacctctgcctcccgggttcaagcaattctcctgcctcagcctcccaagtagctgggattacaggcatgcaccaccatgccatgcccggctaattttgtatttttagtagagatggggtttctccatgttggtcaggctggtcttgaacacccgacctcaggttatccacctgcctcggcctcccaaagtactgggattacaggcgtgagccactgcgcttggttagaacttatttaactttttaggcacttggtaaacggtagctgttagtccatgtgtacttttttttttggtgggggggggagtcatgctctgtcacccaggctggagtgcagtggcaggatcttggttcactgcaagctccgcctcctgggttcacgccattctcctgtgtcagcctcccaagtagctgggactacaggtgcccgccaccttccatgtgtacattcttgtttaacaattcaggataggtactgttactcccctttacaaatgagactttcagaggttgattttctcatggtcaaacagctagtaagttgtgaattcaagattcaaactcaaatttagagctctcattttaaccactatgtaacaatgccccatgaggcaaagggataatatgtctagtatacattctggtatattaaccattgtcagcactggtgactgaaatccaagaactcttcataagtgggcttactaaacaaataattttatctgttgggtgcaagtcatttttttttttccaaatacgattaagaacaatctgccatttatgggttttagctacaacagagaaacataagagggaaactcacatatctggattttgcttgttctgaaggcttggaggccttttttttttttttttttttttttttttttttttttttgcttaacaaagtattgaatttgagtttctcctgagttaagaagtgcaggactatgttacattttatttggggtattttaagaaattatttcatattcttggcaccagttgtttctccatattgcctttaatgtatttttctccctgcaccctttagtatatttttatgcaggccccaaaatttctgtctctaggttgctggtaaaattcctcctagtgtccaagtggaggcagcttgtcttctgtcccagcattttggtgctcctcccgcccctactcctggctgcagtggcattcccttctgcggtggtgagtgttagcacttccaatgatccgaacctggcacagcttctgaagccttcaattcggatgcctctagggacagtagcatgcagtaatgccattcagatggtgttgtatttaatccttgccaatccccatgaaaatgttcagttatgtcaaaagcaaggcaaaaacagtctcttggctatacaagggtagctgttttatttgactaaaatttagcttagagtggatgttacttacccgaacttgcctgctctgagcttgaagtttagcctatttgtggtcttacagaattgcagcctcatcctggtgaggataaggggctcagcctgaccctggctggtgatgttcttgcacagtggcctgtaggacttggtctgttggtggatatctttccagcttggggcaggccaggcaagatcctcacttcctaagcattaacttgggaaagagctcagcaagctttcatccctctagctcattttttgtttttttgagacagagtcttgctctgtcgcccaagctggagtgcagtggcacagtcctggctcactgcaacttccacctcctgggttcgagcgattgtcatgtcccacccaagtagctgggattacaggtgcacgccaccatgcccagctaatttttgtatttttagtagagatggggtttctctatattgactgggttggtgtcgtactccctggcctcaagtgatccgcctgccttggcctcccaaagtgctgggattacaggtgtgagccatcacacctggcccctcaaaccctcaaactgacttttctcacacagacacacacacatacacgtacacacacacttctgccaaagaagcttaaaggttttatgatgtggttatgtttacttaatcatgagaatcatttactcatatcaaaagcaagctggttgatagcatgtaggtgtgggtagctataaaggatgagcccatagcatgtgtggagctgtgaaggatggcagcatattcgagtgaggtagcattacccctaacttaggcagctatggcctggcagctcgggggtggcatttttgtttgctcagtgttacttttgatgttggatgtttcccagattgagaactttaaattttcctaaatagtccctgtactgtttttggcagtggatctatttttactcacacacatagttttttgccttgtgagtagtgggtggaggcccttaggggtttttgggtaaatgaatagtgtcataggaagataagtgaatgatcagcaggccaggtcatttttgacatttagtaatgttgggggtagtcctggagcagagaaaatgtgtgaagtgagtgccctggggtggggactaggtgtagcccaaggctgtttggtcaggacgtgagtaaaactggctgacagggaagtccaatccttaaaagaaatggagaggagggcctttgtgcatgggaagagcccatcagtttaaggttgtccttcaggaagggtgtaagtaggattacagagggtgggaaggcaggcaggacacctagaaagcagagaggctgtgagcaggggtggcgaaacccctggtttgtggcccggtgaagactcagtgcctagtgtggctacactgagggaaggtgccgtgtggcagaaatgactgttgtaatcttggtgttagagcggaaagaggctgaaaactattgtctaggcctgtctgtaaaattctgtcttgttgttgcttcatgttcctgatttgtggagatgcagcaaatgtgatttcattagattttgcagatgatcttaggtagcatggtcggggcctggagagcatccattactctgtattgccacccggtgtttgcctctcagtacagtttatgactgaacttttcattagttctcctggctcctgtatttcggtatttgaagtgttgggaactggtgctaagtatcatccatcaagattggctatccatctttttgttttaatggactgtctgattttacatgggtctataattttccagtctgggaaaaactcagttttctttagttatctggtcaagtagtaagccatcttcatttcatgtttccttttgttaactgaattataacccaggagtattaaaaaatactgtatttaaatgtatccagttatttcctagttaggctctggctggggtattaggaacaatatttgcttgctgagatatgttagtcaccctcagctaatgctgatagtgattcattcagactggcaggcaaccagatgatttttacataaacactaatactcccagtaaatgatttttcttgtgaaggtgtcatcataaatactgcccagtagccttttttggcagcttattcctgatggagaaagaatatgcttacagatacacccaaacttcacgttagtaggaagccctgccacaccttttattggtgcacaggaaaaacgaaatcatggaacattggagctgaaggaggccttggagatcatttgggctaatcctgcttattttactttggatgtccaaaaaggttgtgatttgtttaaggtcacatagctagctcagactaaacttcagatgtcttgggtttaataattataccgccttttgtgttatgcaagcattctgtattatacatacatgtatttcagatttgcactcactttaaatgatatactctgggaagttaccttggtgtatctttgccagtttcacagaagcagctttgttagtcacaggaggaagtatattgtgactccttatggatattatttgtattttaatgccaaatggccttagtttaattactacaagatgaaaggagctctccaaattctgttgttgccttatgctttgttttattgaatattgctctagaaacgcaagtcattctagaggattcaagcattctgaaatttatcagaatatttgggatggaattttgattcagaagtgttgttcgttaaaagactaagtagttactcatctttttgtagttcataagtgtgatgattgggttttgacatgcaggtgtgagatgtgccaccctcaaaccttgttacaacatagacatgtgaccctctgatgtgggcaaaaaaagactaagttattaaatatttacaaagtctctattttccgtaagaaaatgtatgtaagtgtttaaaggcacttactggaggaggaaactagtggggttataggtgtttagctggatttaaggggagcatggattgtagattcatggtagactggggcagatcacagtgagaggtatggagactactaatgaatatgtgaggatgaataatgagaaccctggcttgaccagagtggaggcagcacccctggggaatggtcaggatagctgttagccaaagaccacactgaagaaagaagtgggtaggcaaaggagagacttaatcctgtgttaagggtttgtagcagaagagtaggggtcctggggacagggaaatggagaaattaagagtgagctggtatttttattttgtctggggcttgggggtagggaggactcagacaattgcttgttttactttgtgagaacttggcacgttttctgatttttacctgtaataatgattacacttgctgcttatgtccttgaaccactaattccccaaataaaccatcattgttcatgatttctgatactccactgctcagtcttctcaatccattttaagtgtgtctatttgaatatgctattgataactttccccaatgaacttggccttttccctctggaggttctgtccttacagattggtttaagtaataccttttttgtttagtgttttatggtttcctaagtgctttgctttcttttttttcattattgaaattaaagaccttttggataagcagagactgatttaataaaattaaagacctttaccagtaggtcatattaaggaatccctctactttagacgacacaccatcttttaagggcttgtgaaatgtcctgggtcaatttaggaagtcattttctttgcttgggcccagaccaactctgttagcaactctgttaggaactcttgttaggaaactctgttagtttcctagggggtgctgaacctagtacgacaaactggatagtttaaaataataaatgtattctctcatagttctggacgctagaagtttgaaagtgaggtgtaggcaggccacgctccctctgaaggctctagggaagaatccttcctaggcactctcccagcttctggtggcttctggcaacccttggtgttccttggcttgtagatgcgtcactccagtctttgcctccactgtcacatggcattcttcctgtgtgtgtgtcaaaatctcactatccttataaggacacctgtaattgcacttagggcacaccctaatgtccagtatgacttcatcttaactaattacatctgcaaagaccctatttccaaataagctcacattcacaggaacctagggtcagaacttcagcgtatcttttggcgggggatacagttcaaccactgcaaagtctaataatgctcttcctactaactgcatagctagttcacttgtagttggcatcatggagaactaagggaagttaaagcttgtgaaatttaactcttccacttaaaataattgatgcttccatccttgatgaccagagtttcctgtgaggtaggtcagagtacaacttgctgctgagtagctgtgcttcctttcactaggagctgggggtactttcatgtcacttatgaattgttcttcattttggtttgggagagggctgggagtatcagttagggttccatgtgtagccacacagggcgaagctctggccactggatctgtgtgatgttccatctgatctgtgaagccccaccatctgttaatgtgtatttgaggagtggttggttctttccagagtataaagctggaagcagagtctggaacacttccagtctgttgtctttgaacatttgacaaagggaccgtacgatcttactgttcagagtatctttttttttttttttttttcttttgagacggaggcttgctctgtcgctagctaggctggagtgcagtggcacgatctgggctcactgcaacctccgggttcaagagtttctcttgcctcagcctcccaagtagctgggactacaagcgcgtgccaccacgcccagctaatttttgtatttttagtagagatggggtttcaccatgttggccagaatggtctcgatctcttgacctcatgatctgcccgcccttggcctcctgaagtgctgggattacaggcataagccatcgcgcccggcctgttcagagtatcttttgcagaatggctgaagctcgaggttttcttcttcaccattatgtactgctgctgtacaaccttttcataattatccttagtcccattcctctaccaaggtgaaagcaacatcttatcagacccgaattatgaatttctcaagcccctatgattttctgttttgggtgccaagtatttatctcttctgttagactatagtctttcttcacatagggttcatgtctatattggttttatccatgggtggtttttattctccagagtgactgacctgttcgtaattccgttcttgagaaggattgttgattatgttgaagggaaggcttcttaccaagattttcagattttgctttcaatgtttatctttttggggttttgcaggtgacagagctgaatgaacctctctccaatgaagatcgaaatctcctctctgtggcctacaagaatgtggttggtgccaggcgatcttcctggagggtcattagcagcattgagcagaaaaccatggctgatggaaacgaaaagaaattggagaaagttaaagcttaccgggagaagattgagaaggagctggagacagtttgcaatgatgtcctgtctctgcttgacaagttcctgatcaagaactgcaatgatttccagtatgagagcaaggtgttttacctgaaaatgaagggtgattactaccgctacttagcagaggtcgcttctggggagaagaaaaacagtgtggtcgaagcttctgaagctgcctacaaggaagcctttgaaatcagcaaagagcagatgcaacccacgcatcccatccggctgggcctggccctcaacttctccgtgttctactatgagatccagaatgcacctgagcaagcctgcctcttagccaaacaagccttcgatgatgccatagctgagctggacacactaaacgaggattcctataaggactccacgctgatcatgcagttgctgcgagacaacctcaccctctggacgagcgaccagcaggatgaagaagcaggagaaggcaactgaagatccttcaggtcccctggcccttccttcacccaccacccccatcatcaccgattcttccttgccacaatcactaaatatctagtgctaaacctatctgtattggcagcacagctactcagatctgcactcctgtctcttgggaagcagtttcagataaatcatgggcattgctggactgatggttgctttgagcccacaggagctccctttttgaattgtgtggagaagtgtgttctgatgaggcattttactatgcctgttgatctatgggaaatctaggcgaaagtaatggggaagattagaaagaattagccaaccaggctacagttgatatttaaaagatccatttaaaacaagctgatagtgtttcgttaagcagtacatcttgtgcatgcaaaaatgaattcacccctcccacctctttcttcaattaatggaaaactgttaagggaagctgatacagagagacaacttgctcctttccatcagctttataataaactgtttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtgtcagcccatgtcaatcaagatgggtgattatgaaatgccagacttctaaaataaatgttttggaattcaatgggtaaataaatgctgctttggggatattatctctgtttggtcttgatttttcccccctcgaggaactgtttaaccagtcacaaattgtggtttgaatctctcaaacatggaagcatttgtagtacattatccaagttttcctcccctcattacattacatattttgcagcacacacataggattcatagattttaaatagttttctgtgaacccagctaacatagcctctctgatcaattttcctgataactggtgctttttaatgagcctcgcagaacaaaatgcagtcttccacagtatagcacctctgaaacattgtgggctctgtttaacttgagagtgtatttaacactgaaggtaaatacggagcttatacacgtcctcaagttttcttaataagatactaggggcacaacttgcacccctgaaatctttagtgattattgttaagcatttagtattctttaaaatagaaaagcaaacctcattgagttaaaaagcctaacctaccccttaaacacttgcttaaccccaatgtgtctctcgagcctcagcatcactggctgactgttcttgagtgaggtggtttccagctcctcacgatttttatcacctccagagtggcacctaggaatgaacgtttgttaggtgagttggttcagttacacagaacccttaaacgcctttttctatttgtttgtttttttgagatggagtctcgctgtgtcatccaggctggagtgcagtggcatgatctcggctcactgcagcttccacctcccaggttccagccattctcatgcctcagcctcctgagtaggtgggattacagacgccaccaccacaccaggctaatttttgtatttttagtagagatgaggttttgagtgttggccaggctgctctcaaactcctgacttcatgtgatccacccaccttggcctcccaaagagctgggattacaagcgtgagccaccgtgcccagccttaaacaccttcttgactaaagtttggcattagactgatggaaatggccatgacacaatctctgcccttgaatttatattgtggagcacataacttgtaagcatgtaagtttaacctgtttcttattctgaagtagagtatgagccccgccccccatgccggggccgatgaatacggctcaggaagcctgtttcaagttgacctaattttaagataaagtggttattgagtttcacttcagttagtaggtcaggtatttgaaagtcaacaagctttatatggctaatacttgcttttgataagcacgtagacaaaatgttgctgggccatggtggcgtgcgcctgtagtcccagctgcttgggaggatggagcccgggaggtcgaggctgcggtgagccgtgattgctccactgtaccccagcctgggagataggaagacctttttttttctctgtctctgtctctgatagcaagacctctctctctctctcttttctctctctgtctctctctctctcacacacacacacaaagggctcttacattttctttttttgtttgagatgggagtctcactcttgtcacccaggctggagtgcaatggcacgatctcagctcactgcaacctttgcctcccaggttcaagtgattctcctgcctcagcctcctgagtagctgggattacaggcacccactgtcgtgcccggctaattttggtatttttgtggagatggggtttcaccatgttggccaggctggtcttgaactcctgacctcaagtgatcctcccacctcagcctctcaaagtgctgggattacaggcatgagccactgtgcccggtcgcttttacatttgaaatgtcctttgcagttgctaaagcattcacatttacgtttcacagctgtcttctgaaaggttttgtcccactttacagatgaggaagctaaagtgcaaaggttgtggatctctggaatttatacagctggtaagctagaggacagcttccacccaagatttattcagaattttaacggccctc

SEQ ID NO: 16508 - DNA, 30537 bp, Human
taattttttgaattttcatagatcctcctgccttggcctcccaaagtgctgggattacaggcatgagccaccacacgtggtcctaatcttaaaattattattatttttttatagagactgggtcttgctctgttgcccaggctggagcgcagtggtgcaatcatggcctggcctccactccccccatgccaagcataacaggaggcaaccactagtcagtgggtggacattcttttggggagctgtccctgcccctttggaagtggataaagcccctgccccctgtggggtctgcaggctctccacccctgccaatgtctgtgatctgggggattgtgggctgagaagggattagtttagagggcgggcaaaagagctgggcagggcagaaagaggccccaggattttcaggcagagaagtcaaagggggatgaaaaggggaaaggagatggtggagataaagtgtctgcagctgacagccttgcccctgtcttcacttgtaaggaagtttgtttctttgatggtgataaacctggcatgtgaatgcctttccccagagaatgcaccacagaggagcacgtaacgttgtatacaatttcagggggcttactgatgcaacccctttgcagaaattttaacagtgagaaaattatgacagtgaaagtgatctgacctaaccgactccattttgcttctaacccccaaactgtccatattcattcctgggcataggccaaacttacagtctttttgtttgttttttgagacggagtttcgctcttgttgcccaggctggagtgcagtggcgcgatctcggctcactgcaacctctgcctccagggttcaagagattctcctgcctcagcctcccgagtaactgggattacaggtgcccgccaccatgcctggctaatttttttgtatttttagtagagacggggtttcaccctgttggccaggctggtcttgaactcttgacctaaacttctgatccacctttgcctcccaaaatgctgggattacaggcatgagccaccatgcccggcagcaaatttatagttcaactttgaaacaaagataacagccctctcccaaaataaacccctttcttgcctggggaccagactgcttttgtaagactaacaaattagccacgagattagaaattacggtttaggagtcatgcaggtagtggccacagattctaaacctccccagttgctcctagggataacatcactactgtaaaacctaagattggtgctcaagatatttttccgatcctgcactcaatggatccgctggcgatacacagattaagaaaccggatcatccggttttgtggcccccacccagagatccactcagcacaagaggacggcttccactccctatgattgcatctccgacctgaccaatcagcactctccactctctggcccctacccaccaaattatccttaataaaacccagtctccgaattttcagggagactgatttgagtaataataaaactccggtctcccattcagccggctctgcatgaattaaactcttattgcaattcctctgtcttgataaatccgctgtctgggaaacgggcaaaatgaacccatggggtggttacactgaccctctgctgcacatcccggacagccttgttaagaacccttggtaggctgggcatggtggctcacgcctgtaatcccagcactttgggagcacgaggcaggcagatcacgaggtcaggagatcgagaccatcctggctaacacggtgaaaccccgtttctactaaaaatacaaaaaattagctgggcgtggtggcagacgcctgtagttccagctactcgggaggctgaggcaggagaatggcgtgaacccaggaggcggagcttgcagtgggccgagatcgcgccactgcgctccagcctgggcgacagagcgagactccgtctcaaaaaaaaaaaaaaaaaaaaaaagaacccttggtattattgttccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgcctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcggtgagagcccggccaggcagggatagacgcgcgcggggtggggtgcaggcgcgggggccagggactgggtcgtgggggaggggctgagactcctcgcttggaatctgggggttagaggcggggcaggatcaaggcctagggaggggtctgggcaaagaatgggggaggtgagaaagggatgggtagggtctttgtcctggttgggaccgggctgtgatggggacctgatgaaagatggtgagaagggcaggtactgggccctggagagtgggagagggcagaagacaggaggagtggcccattcccaggcgtagcttgtgatttaacacccactgggggcttctggtagtcagctcctccgtcgggaagttctgtgggaaagagatgatggcaggggagcagtgggggatccccaggggccatggctgcacagaccctttgttcctccacctcgaactgtacaggtggggaaacggacctgagagggaatgggagttgtccaaggtcaccctccctgctgtgccgtggcagcaccaggtctgggacccaggcctgccaatgcgccatgcactttgcacccaactggtggcctcctgggagtgggagtctggctgggccatgtgctctcagcctgggcttttgtttgggccctgctctgggctgagctagggcttggcctccctgactggccctgggcagcccctcactccttggtccccacagccctgtacttcccccatctctgcatatatgaccctgcacagttatgacttggtgcttgtctgtctctctcactagaccatgatctcatttttctctgtttccccagcctcccaccctcagagggctcaggactgtgtatggtcaaggaatatttaccaaagaagtgaggccacctgttccccctcccccaacctgtgaaaaggaagcaaccatccctcctgccctgcagcccaggaatgaagctgcaaagttctgatagtgcctgccatgagatgttacagcacagagcagtggggcttttggacagctgggaaagaggagtggcataagcgccccacctagactgcccaataattagggataaagctgacaccgtgggaaaagcctagagtttgcctggcactaacagatctaactcagactttgtaggtggggtgacctcaggactctttaagcctcgggttcctcatctgtaaaatgggagtaatcaggatgtatctcatagggttgttgaggattaaagatgctgtggttggtcgggtatggtggctcatgcctgtaatcccagcactttgggaggccgaggcaggcagatcacttgaggtcagcagttcaagaccagcttggcaacacggcgagatcctgtctctataaaaagtacaaaaatggccgggcgcggtggctcacgcctgtaatcccagcactttgggaggccgaggcggtggatcacgaggtcaggagatcgagaccatcctggctaacacggtgaaaccccatctctactaaaaatacaaaaaattagccgggcgcggtggcaggcgcctgtagtcccagctactcaggaggctgaggcaggagaatggcgtgaacccaggaggcggagcttgcagtgagccgagatcctgccactgcactccagcctgggcgacaagagtgagactctgtctcaaaaaaaaaaaaaaaaaaaaaaagtacaaaaatttcaccatgttggtgaaaacgtgtctctactaaaaatacaattagctgggtgtgatggctcacccctgtaatcccagctactaggaagctgaggcaggagaatcaattgaacccgggagacagaggttgcagtgagccgagatcacgctactgcactccaacctgggtgacagagcgagactccgtctacaaaaaaaaaagattccgtggttgtgaagtgtctagcacttgacgaacatgcagtaagtgttgctccttaacccctagcctatgtttcaagcaatttctgcatgtgacccacataatgttgaggctcaaagggctctgggaagatcatcttttatgagccctttgttttccagataaaaatatcaagattggggaagggatagaatggattggtggtaaaaccatttgtgtggcaaacacccagaggccgtaaaaggagcatgggtctcagagtcagcctgctgcccctcactcagtgaccctggatgagttgctgaacctccgtcagcctcagtttccttttctgtaaagtggggatgttggtgttttcggcaggattgctatgaagccacttgaattaatgtttatcaagtccctcaaggactgtcttgcagttacttataccttaattccacattggatacctgagaacactctgtcctgctgcccctcaggctgccccatatctctccagagtcactagtagggccagcagcagcccttctggcctgtgaggtttgggggcaatgaggctgctggggtggggatggagtgtgggctttgaaatcagatggacctgggccaggcaccattgctcacgcctgtaatcccaacacttcggtaggccaaggtgggaggattgcttgaacccaggagtttgagaccagcctgggcaacatggcgagatcctgtctctataaaaaatacaaaaatttggccaggcacagtgggtcatgcctgtaatcccagcactttaggaggctgaggcgggtggatcacctgaggccaggagttcaagaccagcttggccaacatggtgaaaccccatctctactaaaaacacaaaaattagccaggccaggcctggtgactcccacctgtaatcctagcactttgggaggcccaggcaggcggatcatgaggtcaggtattcaagaccagcctggccaacatggtgaaaccccgtctttattaaaaatacaaaaattagctgggcatggtgtgtgcgcctgtaatcccagctactctggaggctgaggcaggagaatcgcttaaaccagggaggtggaggttgcagtgagctgagatcgcaccagtgcactccagcctgggtgatagagcaagactctgtctcaaaaaaaaaaaaaaaaaaaaattaggcatggtggtgtgttcctgtattcccagctattctggaggctgaggcaggagaatcgcttgaactggggagctggaggttgcagtgagccaagatcgcgccactgcactccagcctgggcaacagagggagactccgtatcaaaaaaacaaaacaaaacaaaacaaaacaaaaaaacatgccgggtgcgttggctcacacctgtaatcccagcactttgggaggccgaggcgggcagatcacctgaggtcaggagttcgacctggccaacgtggtgaaaccctgtctctactaaaaatacaaaaattagttgggcgtggtggcagatgcctgtaatcccagctacttgggagactgagacaggagaatcacttgaacccggggggcggaggttgcagtgagctgagatcgtaccattgcactccagcctggggaacaagagcgagacttcgtctcaagaaaaaaaaaaaaaattagccaggcatggtgacacatgtctatagtcccaactactccggaggctgaggcaggagaatcccttgaacctgggaggtggaagttgcagtgagccgagatcgtgccattgcactccagcctgggcaacagagtaagactccatctcaaacaacaacaaaaattagccagacgtggtggtgctcacctgtggtctcagctacttgggaggctgaagtgggaggatcatttgagtctgggagatagaggatgcagtgagccatgattgtgtcactgcactccagcctgggtgacagagtgagaccctgtctcgaaaaaagaaaaaaaaaatagaagaaaaaagaaagatgaagctgagctaggatcaaaacctggatttgtccagagcttgtgctcataagcactagttctgctgttggtgttaaggatggaaaggacccctgatccctgagtgaagtcactctgggtcaaggtctacctttttttttttttttgagacggagtctcattctgtcagccaggctggagtgcagtggcgcgatttcggctcactgcaacctctgccctctgagttcaagcgattctcctgcctcagcctcccaagtagctgggattacaggcgcctgccaccgcacccagctaattttttgtatttttagtacagacggggtttcaccatcttggccaggctggtcttgaactcctgaccttgtgatccacccgcctcggcttcccaaagtgctgggattacaggcgtgagccaccacgcccagcctaaggtctaccatttcttttgtttcatacttttcagctttcatcattttcatgcaagaatgtcttagctcctctttcattcatttctcaaacttggactgcattctcaccatgtgcccagcactgctccaagcataggggatacagcagggatacaacagaacagacaaggattctgccccgctagggctgcctccagtttagagactgacaataaacaaagcacataataagccaaaaagtatagtgtttttttttgtttttaatttttagtagagatgaggtcttgctatgtttcccaggctggtctcaaactcctgggttcggccgggcatggtggatcatgcctgtaatcccatcactttgggaggccaagtcaggcagatcacttgaggtcaggagttcgagaccagcctgaccaacatggtgaaaccccgtctctactaaaacatacaaaaattagccgggtgtggtagcacgcacctgtagtcccagctactcaggaggctgaggcaagagaatcgcttgaacccaggaggtggaggttgcagtgagctgagattacgccactgcactccagcctgggcaacagagtgaaactccatctcaaaaaaatacaaaaaaaaaaaaaggccaagtgtggtagctcatgtctgtaatcccagcactttgggaggctgaggcaggaggatcacctgaggtcaagagttcgagaccagcctggctaacatggtgaaaacccatctctactaaaaataaaaaattagctggatgtggtggcacatgcctgtagtcccagctacttgagaggctgaggctggagaattgcttgaacctgggaggcggaggttgcagtgagcccagatcacgccactgcactacagcctggacgacagactgagactccatctcaaacaaaacaaaaaaaaaaaaacaactcctgggttcaagcaatccttccctcttgcgtcagcctcccaaagtgctgggattataggcatgagccactgggctaatcctagtatagcgttttagaacgtgctctggaacaagatagagagcaggaagagagggcttggggaggtcaagggtaggagaacattgtaatttcactgagaaagtgacatttgtactcttgcagatgtacccttggggatgctggcttggagttcaaaccctcctctgagatctttgacaagctccttcttggattttacctgtagaaaacagctttagggatgggctccaccaccctgctcatttgacagatggggaaactgaggcccacaggcaggaaggattagagtagtgggaagagacgggagcccatcagagctcctgaagtttccagtgttccagcccctaatctctttcttcagggctggctatttgactgatatttatcttggtcagtgctgatgttaataaattactctgtctagtcctttctagagcaaaggtcttggttgataaatagtaggagctgctctcctcactgcccatctccctccaggggaagcagcccctctacattaaaaccaaaggtcaggtccctcagtgcccaacctgaggtggggattggctttcaaggaaagagcgctgggttcttaactctgccctctgattttctgtgcggccttgggcaagtcccttaaactctctgggcttctttccattttatcctcgcgagaatgggaatactaatagtaccaatactataagatcattgcatagaatcagtgagatcctgcaactgaaaagtacatcacagatccctggcttagagcctcccttattctggtccaaaaacttcacagaccgcactacccatctaatgataattgtctttttttttttttttttttgagacagagtttcgctcttgtagcccagtctggagtgcaatggcacgatctcagctcactgcaacctccgcctcccgggttcaagtgattctcctgcctcagcctcccgagtagctgggattacaggattgcaccaccatgcccagctaatttttgtatttttagtagagactgagtttcaccatgttggccaggctagcctcaaactcctgacctcaggcaatccgcccgcctcggcctcccaaagtgctgggattacaggcatgagccaccgcaccaggctgataattgtctttttgctaatgaagcagatgcatgtacaatgatcgagagagttcatgaattcagaaatgcttaacacactttaaaatctttataaaaaattacaatgaataaagaaaaatttagccatctcctattcctctttcccaggtaagcagtattaacagtttgggacaagtaatttattttcttttctttttctttctttctttttctttcttttttttttttttttttttttttttgtgaagatggagtctcactctgtcatccaggctggcgtgcagtggcgtgatcttggctcactgcagcctccgcctcctggattcaagcagttctgcctcagtctctcgagtagctgggactacaggcacacatcaccactcctggctaatattttgtatctttttttaagtggaaatggggttttgccatgttgcccaggctagtcgtgaactcctgagctccagcaatctgcccgcctcagcctcccaaaatgctaggattacaggcatgagccaccatgcccagcctctttttttgttttgttttgttttgttttgttttttgagacagggtctgctctgttgcccaggctggagtgcagtggcccgatctcagcttgctgcaacctccgcctcctgggttcaagcgatcttcccacctcagcctcctgagtagctgggactacaggcgcacttgacactcgaccacacctggctaattttttttttttttgagacagagtttcactcttgttgcccaggctggagtgcaatggcctgatctcggcttactacaacctccacctcctgggttcaagcaattctcctgccccagcctcctgagtagctgggattacaggcatgcaccaccacgcctggctaattttgtatttttagtagagatggggtttctccatgttggtcaggctggtctcaaactcccgacctcaggtaatccacccgccttggcctcctaaagtgttgggattacaggcgtgagccaccgtacccagcaatttttttatttattgcagagacagggcttcagactcctgagctcaagtgatccgcctgcctcggcctcccagagtgctggaattataggcgtgagccaccatgcccggcccatttctcatttttatgcttatacaaacatatcaccactttggcccagcgcagtggctcatgcttgtaatcctagcactttgagaggccgaggcaggtggatcatgaggtcgagagatcgagaccatcctggccaacatagtaaaaccccgtctctactaaaaatacaaaaattagctgggcgtggtggcacacgtctgtagtcccagctacttgggaggctgaggcaggagaatcacttgaacccgggaggtggaggttgcagtgagtggagatcataccactttactccagcctggcgacagagcaagactccatctcaaatacaaacaaatgaacaaaacaaaacaaacatatcaccactttaagattatttttaaaaagaaattttttttttttttgagacatggtctctgtcacccaggctggagtgcagtggcctgatcatagttcattgtagccttgatttcctgggcttcatgcgatcctcctaagtctctcaagtggctgagactacaggcatgtgtcaccacacccggctaattattgtattttattttattttattttatttttttgagatagagtctcactctgttgcccaagctggagtacagtggcaagatcttggctcactgcagcctcaacctcccaggctcaagtgatcctaccacctcagcctcccaagtagtgggactacaggcacataccgtcatgcccagctaattttattttttgtagagacacggtctcacaagtttccccaggcttgtctcatggcctcaagcaatcctcctgcctcagcctcccaaagtgctgggattacaggcataagccagtcatatttattattttttttgtagagatggagtctcattttgttgcccaggctgatcttgaactcctgggctcaagtgatcctctgacctcagcctcccaaagtactgggattacaggcatttagccatcgtgcccagctgattttatccgtcccaatggctgctccatattttggaaaaaattgattgattttttatttgcaagacatttgtccttttttttttttttttttttgagatggattctcgctctgttgcccaggcgggagtgtgatggtgcgatcttggctcactgcaacctctgcctctcaggttcaagcaattctcctgcctcatgctcctgagtagctgggattacaggtgcacaccaccacgcctggctgatttttgtatttttagtagagacagggtttcgccatgctgggcaggctggtctcgaactcctgacctcaggtgatctgcctgccttggcctcccaaagtgctgggattgcaggcgtgagccatcacacccagcctaagacatttgtctaaccacataaaagtcttaaaaagggatagggcagccgagtatttgtattgtaaaaatacgaaaattacctggatgtggtggtacgcgcctgtaatctcagctactcaggaggctgaggcaggaaaattgcttgaacccgggaggccgaggttgcagtgagccgagatcgcaccactgcactccagcctgagcaacaagagcaagactctgtctcaaaaaaaaagaaaagaaaaaaagaaaagaaaggatagggcttcctgtgacctcacttggaaaaaacaaaagagaaaaaagaaaaaagggataaggcttgctgccactcagggatccctcttgccaggctccctggctaggaattgtctccattgggagacttccttttcaggcctggctgcaagctgcaccaaggctgtggagcgggaagattggtagtctcaaaataagcacccctgcctcctgctgggaccttgggtatgtgtttaggatgggagtgcagttctggtccagtaggagctggcagcagaccctccactgcccttaaccacagtgctcatgggcaaagcacataatcatattcattgatcattcattcattcattctcagtatcctatggagatgggcagagcaggtgttggctggatgagtgaatgcatcttgctttgcagtgccttttactccctctatctgccaaaccagtcctggggactgaccagctcatctcctcctctgtagagagtctgcccaggttgccagaagcagagttaaggctagttcacctgggctcttccagagacccctcctataattgtgtcccaaggcccatttctcctagtggactatgagctcctcaaggacaaagcttatttgtatttggctttccatgtgtggggtcagggtggggacatgggccaagtgcactgtgagagtgctggggaggacggtgagagcagtcttctcgttagaggggacagaacttgtacagaaagcacagagtagcagatcctggtgtgttcagggaagagcacacctggagagtgaggtgtacaggtgagggggcaggaggggaggctgacaagttaggttgggttgtcaagggctttgggcatgatgcaaggtggatttggggttgatcctcttggcgagaggctggagttatatgacccaagtagaggacctcttggaagggggatgaagtggaggcagggaggctagagagagaagtgggaggtggggctgcctctcctggcgtcctgaggctctgcaaagcttcaagaagccaactgggcagctggaatatctgtagaaaggagctggctccaatagcatttcacagtctggagctgccacaggactccgtggccctgttcccagaaatgtgggtcactggtctaggggagcaggacatccaagtggatggaattgctggggctcccccaacctccgcgcgtccccctcaactcctctgtcctgcagtttctattccaaggacaatgaaggcagctggttccgctccctctttgttcacaaagtggatccccggaaggatgcccactccaccctgctgtccaagaaggaaaccagcaacctctataagatccagtgtgagtggctgctgagctgaccaatttctgccctttcaggggctctgggggcctgtgaggctccaggaaggagatgggagggtctggaatgtcctcagctgtcctgggacccctggccttgatgggctcccctcaccccaagttcttccctgtgtacacaccctacctcacttcttgttctctgtcctctgttgcagttcacaatgtaaagcctgaatacctggatgcctacaacagcctcacgtgagcaccctgcatccatacatcccatcccctgcttgggtggggaacacactttcagcaaatttgcggaacatcctccaccctgttcttttctgtagaaatccaggagatgtagatttcttttatttctgcctttttctttctttctttctttctctctttctttttttttgagatggagttttgctctcgttgcccaggctggagtgcaatggcgcgatctcggctcactgcaacctctgcctcccaggtacaagcgattctcctgttccagcctcccaagtagctcggattacaggcatgcgccgctaagcatggctaatttttttgtatttagtagagacagggtttcaccatgttagtccggctggtcgcaaactcctgacctcaggtgatccacctgcctcggcctccgagtgctgggattacaggcatgtgccactgcgtttggccccattttctttctttctttttttttttttaagagatggtctccaggaggcggaggttccagtgagccgagattgcgccattgcactccagcctgggcaacaagagcaaaactctgtctcacacacaaaaaagagagatgggatctcactttgcttcccaggctggtctcaaactactgggctcaagcaatcctcctgcctcagcctcccagtgttgggattacaggtgtgagccactgtgcccagccaggatgtaaatttcagtgtcggaagtcctgagggcctcttgcctagcttctgcattttagagatggagagtctgaggcccagccccagggtctgtttgaactgagtttgaacccttatctcagaggccctggtggctatgtgaaccctgcccctctctgcacctcccccacagggaggctgtgctgcccaagcttcacctggatgaggactacccatgctcactcgtgggcaactggaacacgtggtatggggagcaggaccaggcaggtaaggcgctcacctccctagtgccattgccactgcccagccctggcctccagcacctttcacacctggctgttctccactccctctccacaacagcacctggtggggctcttactaaaacctcatcacctcactcccctgctcaaatacctgtcctggctcccctgtgccctcaaggtgacccgtgaagcctgtgactccttcccggccctgcccccagcctcatggcaccaaatcctccatgcctcgctgtgctgtcccacccaggactcagttcctcagattgacagtttcactctttagttccagactactgctcattctctttcttctgccttaagcattatttcttgtttgcctgctttacctggatcactgtcttttattctttttttttccgagactgagtttcactcttgttgccccaggctggagtgcagtagtgcaatctcggctcactgcaacctccgcctccccagtttaagcaattctcttgtctcagcctcctgagtagctgggattacaggcatgtgccaccacgcccagctaattttgtatttttagtagagacgggatttcaccatgttggtcaggctggtcttgaactcctgatctcaggtgatccacctgcctcagcctcccaaagtgctgggattacaggtgtgagccaccgcacccggccttttttttttttttcttttttcttttttgagacagggtctcgctctgtcacccaggctggcagatagtggcacagtcttggctgactgcaacctccacctcctgagttgaagatattctcctgcctcagcttcccgagtagctgggattactggcctgtgccaccaggcctggctaattttgtatctttagtagagatggggtttcacatgttggtcaggctggtctcgaacttctgacctcaggtgatccacctgcctcggcctcccaaagtgctgggattacaggagtgagccaccactcccggcctttttttttttttttttttttttgagacagggtcttgctctgtcacacaggctggagtgcagtggcataatcttggctcactcgagcctcaatttcccaggctcaagcagtactcccacctcagcttcctgagtagctgggactataggtgcgctccaccatgctcggctaatttttgtgttttttggtagagacggggtttctccatgttgcccaggctggtcttgaattcctgaactcaaatgatcctacctcctcggcctcccaaagtgctaggattgtagacatgagccaccgtgcctggcctttcagttttattcatttttaaattttcatttatttatttatttttgaaaccaggtcttgttacccagtggggagtgcagtggtgtgatcacagctcacacagccttaacctcctgagcttaagcaatcctcctacctcagcctcctgagtagctgggaccacaggtgcatgccacaatgcccaactaatttattttaaattttttgtagagacgggatctccctatgttacccagggtggtctcaaactcccgggctcaagcgatccttccactttggcctcccaaagtgctgggagtacaggcatgagccacagtgcctggactattcacttttctattttggcatagatgtcacctcctcctggaaggctgccgagatttcctccacgcgggctgggtcaggcaccttccttagctctccaggcctcagtaattacctcctcacgccctgatcatgtacccctatagctgcctgtttagttgtctgtctccatatatgggtgaatccccaatatgcagcacatatttgtggaataaataggagttcttcttgtctgagctggtgtcttacagtcccaggggcacccctagcatgccccatcccagcctaatagacacatcaaagttggcaccagctataagaacccacacatgaatttggctgactcacagcatctcagccactcaaagggacctcaaattcagacccacactgtccaaaatgatagccactaaccacatgtagttatttatttatttatttttttgagatggagcctcgctctgtactgtcacccaggctggggtacagtggtgcaatcttggctcactgcaacctctgcctcctgggttcaagtgattctcctgcctcagcctcctgagtagctgaggttacaggcgtgtgccaccacacttggctaatttttgtatttttagtagaaacagggtttcaccatgttggtcaggctggtcttgaactcctgacctcatgatcctcccgcctgagcctcccaaagtgttgggattacaggcatcagccactgcgcctggcctatttatttatttttttgagacagcgtctcactctggtttcccaggctggactgcagtggtgcaatcacagctcactgcacccttgacctcccgggctcagatgattctctcacctcagcctcccaagtagctggaactacaggtgtgcaccaccacagccagctaattttttatatttttagtagagacagggtttcgctatgttgcccaggctggtcttgaactcctggactcaagcaatccgtcagccttggcctcctggactactgagattacaggtgtgagccactgcgccctggcctcacatgtagctattgaaatttatattagttaaaattacataaaatttaaagttcaagctgtgtgccaaggtgctcacctgtagttctagctacttgggaggctgagttgggaggactgcttgagcccaggagttcgaggccgtgattgaataccatcacacctatgaatagccactgcactccagcctgggcaacacagtgaggaccctgtctctaaaaaagaaaaaattcaggactgaatatggtggcttatgcttataatcccagcagattaggaggctgaggtgggaggaacacttgaggccaggagtttgaaaccagcctgggcaacatagtgagactttgcttctataaagaaaatacatattaaaaaaaaaaagaagaaaagattttaaaaaagaaaaaattcagtttcttagtcatactagctacatttcaaatgctcactcatacacacacaggctcatgcagaaagtacttttggacagtactggtttagagtgtctgcatagcacagccataacagatggtcctctaaacttcccttgaacactcctagccatgaagagttcacttgtaagccaatctatttcatcctttgacagccctgataatcgtgtctttgaaaataatctgtgacctgcagatagataggtgtatctccttaatcaattatttggtttccgtaacagacattaacatattatttatgttttatttttattatttccatttagaaacagggtctcactatattgcccaggctggagttgaatttctgggctcgggcaatcctcctgagtagctgggactacaggcgtgtgccatcatacctggctagacactgatatgtggctaagggaataagagaaaagcaaattgccttcagtttcagccactacagctttcccattttaagcttgacttgatcagctccagcagtattccttgaattctcttaagcatttgctagttgtgaaatgaactctgagggatgggatcctgactttttcttttttttctttttcgagaccgagtctcactctgttgcccaggctggagtgcagtggcgtgatctcagctcactgcaacctctgcctcccggattcaagcaagttctcttgcctcaggctcccgagtagctgggactacaagtatgaaccaccatgcctggctaatttttgtatttttagtagagatggagtttcaccatcttggccaggctggtctcgaactcctgaccacagttgatccacctgcctcggcctcccaaagtgctgggattaaaggcgtgagccactgcccctggcctttttcttctttttatttttctgtttgggacagggtctcgctctgtcacccagtttggagtgcagtggcatgatcatagttcactgtaaccttgaactcctaggctcaggcgatcctctcacctcaacttctcgagtagctgggaccacagacatgcaccaccatgcctgggctagttgttttgttttgtttgtttgtttgttttgtagagatgaggtcttgctatgttgcccaggctgatctcagactcctgagctcaagtgctcctctcctgcctcagcctcccagagtgttgggattacaggcctgagccactgcgcctggctgatcctgactttttaaagcataccctacattttttgtaccttgaagttcagtccctcacatagtcagctgaatcatgttgagctgtacgctgggagtagggttcaagaatctacattttaataaacttgtaagaaccattgatccatctcctatggagagcaccacagttgttagacaattccttcttcttggctgggcgcggtggctcatgcctgtatcccagcactttgggaggctgaggcaggtgcatcacctgaggtcaggagttcaagaccagcctggctaacaaggtgaaaccctgtctctactaaaaatacaaaaattagctgggcgtggtggcatgcgcctgtaatcccagctacttgggaggcataggcaggacagtctcttaaatccaggaggtggatgttgcagtgagctgagatcacgccaccgcactccagcctgggtgacagaaaaataaagaaaattccttcctcttgccaatgatgctgtccttgtaacttttctccgttaatccgttttccacaggtcattcctggttttggtagatttccatccatacagtacttttgccatttcctttgggaaaaagacctttaaaccatagggtcaggccattttgcagatgggaaaatcaaggcacagatggagtcaaaaaacaggtgaaggtcaggctggggatggggatgggaagttacagagtctgagtttctagactgctggcagccagctgcccttagctctagcttgcctgtgtgatcccctggggaccttcctccgctgatgggcccagccatgctcccaggatggcaaaactgttcctttcttctcctccacaattaattaggtttctttgttactaggaattagattagtttcctggggtggccagcataccgcaaactgggtggcttaaaataacagaggtttatcctgtcacagttctggaggctggaagtcacaaatcaaggtgttgacagggctgtccttcctcctaaggccttaggggagaacccttccttgcctcttccagtttctggggattgctggaaactcttagtgttccttggcttgtagacttgtcattctaatctctgcctccctcgtcacatgctgttctctctgtgtgtctctgtcttcacatagtgttctcctgtgtccagatctcccacttctgataaggacactagtcactggactcagggctcacctagtataatctcatcttaggtcgattatacccacagagacctatttccaaataaggtcacattctgaggttctgggtgggcataaattttgaggggacattgttcaactcagtgcagataatatgatttttatttatttttatttttatttatttattttttgagacggagtcttgctcttttgcccaggctggagtgcagtggtgcgatctcagctcaccacaacctttgcatcccaggttgaagcgattctcttgcctcagcctcctgagtagctaggattacagatgtgcatcaccacgcccagctaatttttgttttagtagagatggggtttcgccatgttggtgaggctggtctcaaatttccgacttcaggtgatccacctgcctcagcctcccaaagttgattatttatttacttgagacggagtctcaccctgccacccaggctggagtacactggcacaatcttgactcactgcaacctctacctcctgggttcaagcgattctcctgcctcagcctcccgagtaactgggattataggcatgtgccaccacacccaactaattttttttttttttttttaagatggagtctcgctctgttgtccaggctggagtgcagtggcatgatctcggctcactgcaagctctgcctcctgggttcatgccattctcctgcttcagcctcccgagtagctgggactataggtgcccgccaccacgcctggctaattttttgtatttttagtagagacggggtttcactgtgttagccaggatggtctcgatctcctgacctcgtgatccaccttcctcagcctcccaaagtgctgggattacaggcgtgagccaccgtgcccggcccaggatttttataaattctaacagtacaaagagttttccatgcaaagtaagcttccctcctgcccgaggccccacaggcctccattctgtgtcccaggggcatctactgtcaatctctttttttttgagacggagtttcgctcttgttgcccaggttggagtgcgatggcacaatcttggctcaccgccacctctgcctcccaggttcaagtgattctcctgcctcagcctcccaagtagctgggattacaggcatgcgccaccacacctggctaattttgtatttttagtagagatggggtttttccatgttggtcaggctggtctccacccacctcagccccgcaaaatgctgggattacaggtgtgagccactgcgcctggtctactgtcaatctcttaagtcgccattaagaggtgatgcataaattagcatctctggatgtccttgccacctcaacacatgaggtagcataccacacatcctcttctgttccttggttccttttttcaattcactgtcttggaatgttccatatcagcccatcagttctcccctgttcttttgttcagctgcccctctaaggcctggtggtcttccttatgcatgccactgcttccagggtacaggacacatctgatcttcttgttgctatttaaggaaggtggggtgggaacattattcccattttcaagatgagaacattgaggcctagagcagtccaaggctgctgggcagagctggagctcaaatccaggtctcctagacttgtgtctagggtcatcccctccccagcatggtcttccaccaaggcagagggaactcagggagtcttgctgctacagggaaccaggccaccccgcctcccccgtccccaccacttagccaaccttggggaggtcatctgctgggggtcccagcagctcactgacctatacctctcacccccaacagtgcacctgtggcgattctcaggtggctacccagccctcatggactgcatgaacaagctcaaaaacaataaggtatgttagtgtccactcagcacacctctctggatgtgggatgcagcccagccctgttctggggactactctgctaccccatgaggcacactgtcaggatggagcgcacttcctggtagccatgcctttaccaccatgcccacaggagtacctggagttccgaagggagcggagccagatgctgctgtccaggagaaaccagctgctcctcgagttcagcttctggaatgagccacagcccagaatgggtcccaacatctatgagctgaggacatacaagctcaaggtgcctccctccgacagaccccctcctgccccccaatttccctgctgcaatgctgctttgcagctgccccaacacctagactggggcttctggcttctccctccctatgggctcagagcagagttgtatacacatgtgtgcaaacatgcacaccaggtgtgtgtcagggcctgtgaatgaggccaaatggccgctgcagcttgggaggtggggagacagggcagtttcccttccttgccaagctgtgatgctatgaatctgaggtgggggctcattcccatcatccctttggttctctttcagccaggaaccatgatcgagtgggggaacaactggtaagtggcagcaccaagactggggttgggggaggcgtaccctgctcacctgccccaccaaggcccctggtgggccaccttttccagggccatatcacagggaactctttaccttctgcccctcatggatctgggagaaggatccaaccaggaggtgaggatctcctagaaggttgtgacccctccgttggtagaacaccccgccatcagtcctttctctcagcatcccggaggaccgtgggttccacctaggcccctcctgtgaagtgtggccaaggaatcagcctcagtaccctctgcaccagccctggcttctgccccatattattgtgccttctccagggctcgggccatcaagtaccggcaggagaaccaggaggcagtgggcggcttcttctcacagataggagagctctacgtggtgcaccatctctggggtaggttgaggaccttccaggagccttttgttagttctctttctctgtcatcactctctgtagccaatggggttgtattagtgtcctcatagaacttaatgttctagcaggagacactatcttagatgtaaagtcacaaaaagatcaatttcagattacaaataatatttatagaaaataggcaaggagtctgggagcggtggctcaagtgtataatcacgacactttgggaggccgaggtgggcaaatcacaaggtcaagagatcgagaccatcctggccaatatggtgaaaccccatctctactaaaaatacaaaaattagctgggcgtggtggcgcatgcctgtagtcccagatactcgggaggatgaggcaggagaatcagttgaacccgggaggtggaggttgcagtgagctgagatcacgccattgcactccagcctggcaacagagcgagactccgtctcaaaaaaaaagaagaaaaaaaaaaaaggcagggagagatgatggtgaaaaacataggggatctacattggtctaggtagacaaataatgcctctctgagggagtaaaatgtaagctgagagctaaaggatgagaaggagccagctgtgaattgctaggcaaaagcattccaagtagacagagcagcacatgcaaaggccctgtggtggggaaaggccttcggggttttgaggtgtggcaaggaggccagtgtggagtgagtagggaagaatgtggggagatggaacaggagagggggaatgagttgggatttattgtaaatgcaatgagagactatttgtttcaaatagcagtgacacgacctgatttttgttctagtatgatttctctggctgctgtctgctttgttaagagtgcttggtaggcgagcaagagagaaagcagggcttcaggaagccattactctagttcaggcaggaggggatggggcagtgggatgctgagaagtccacagaagatttgttagtctagaggtggaaccaacaggacttgtggatgaattgtctgtgtggggcaagagaaggagaagggcattccagaagagctcccaggctcgtgcttgagctgctgtgtgtcatctcctgagtctgggaggtctagggaaggagcaagtcagtggggtcaggagcgtaattttggcccttggaattgttactttttttttttttctttgagacacagtcttgctctgtcacctaggctggagtgcagtagtgtgatctcagctcactgcaacctccgcttcccgagttcaagtgattctcgtgcctcacgctcctgagtagctgggattacaggcatgcagtaccatgcccaactaatttttctatttttagtacagagtttcgctatgttggccagactggcctcgaactcctggcctcaagcagtccaccagcctcggcctcccaaagtgctgggattataggcatgagccaccgcacccagccggaagtgttacactaaaaatgctgacacaccaaagtagagatgtcaagtaggcagtagatggatataggagtctggagcccttgggagtgtttgcgactagaaatataaatgtaggcaatattaacatatgtactgattggatggatgattaaagcagacagtgtttgctaatagtctgagggaggcatctagggaggaggagacagcagtgcagggtttaggggacagtgggaagagggccctgtgctgggtaagggatccagtcctctgtgcctgaggaatgagcctgtgcctttctcacagcctataaagacctgcagtctcgggaggagactcgaaacgctgcctggaggaagagaggctgggatgaaaatgtctactatacaggtgagtgaagcctttggaggtcttctgctgagaaccctgtctgaggatggaatcctctctgcaaggagatctagtctttcttgattacctccagtgatggggaactcacttttaagacaatgagttaatgggtttctatccaagtggcacactccataggataccagcaggcctaggtgagtactctaggggatgataacatagccagggccacgcctctgcctaggagatgtggattagcaaacgcccattgtgaccttgggcatggttctttacctcgctgaggctgttccctcgtctgtaagatagtgatggtgatagtgcttctgtcagagggctataacggaagattctacaaactattttattattttatattttattttattttatttatttttgagacacagtctcactctgtcacccagggtggagtgcagtggcatgatcttggctcactgtagcctccgcctcccaggttcaagccattctcctgcctcagcctcccgagtagctgggattacaggcgtgtgtcaccatgtccagctaattttgtatttttagtagagacggggttttatcatgttggccaagctggtctcgaactcctgacctcaggtgatccgcctgcctcggcctcccaaagtgctgtgattacaggcatgagccaccacatctggcccacaaactcatttatgaaaagtgctttctccagtgtctgtcacaaaggaagcatgcaggaaatgtttttgaataaggtttttgtttttgtagagatgcagtcttactatgtcacccaggcaggtctcaaactcctgggctcaagcagtcctcccacctcagccttccaaagtgctgggatcataggcatgagctactgtgcccagccttgaacaagttttttgctcaaggtgtttgccactttgctaggaacctgaaaccacctagagtcagtgggtgttaattaagccctcactgtgtgccgggaactgtggtaggtaggtggttgaggggcacataaatgaacaagagcctgtccttgccattgagaagtttacagtgatcacttaccaggtggtatgagggagaatgtgtctgctgaaggagttagcaggagccttgctattcagtgtggtcccagctgggtatggtggctcacaactgaaatcctagtactttgggaggccaaggcaagaggatcacttgaggtcagtagtttaagaccagcctgggcaacatagggagaccccatctctacaaaacattttttaaaaattagcaggacgtggtgtttcccatctgtagtcccagctacttggaaggctgaggtgggaggatcacttgatcccaggagtttgaggctgcagggagccatgattgtgccattgcactccagcctgggcaacagtgagaccctatctcaaaaataaaaaataaaaataataaaaaacaagacaagcacagtggcttacacctgtaatcccagcactatgaagttgaggtatgtggatcaattgaggccaggagttggagaccagtctcggcaacatggtgaaacctcgtctctactaaaaataaaaaaaattagccaggcatggtaactcaagcctgtaatcccagctactcgggaggctgaggcacaagaatcacttgaacccaggaggcggaggttgcattgagccgagaacctgccactgcactccagcctggaagacagagtgagaccctgtctcaaaaaaaacaaaaaacaaaaaaaatcaagtgtggtcccaactgacagtattggcatcccctgggagcttgttaagaatgacaaatctcggctgggcgcagtggctcacgcctgtcatcccagcactttgggaggctgaggtgggcagatcacctgaggtcaggagttcaagaccagcctgaccaacatggagaaaccctgtctctactaaaaatacaaaattagccaggcatagtggcacatgcctgtaatcccagctactcgggaggctgaggcaggagaatcgcttgaaaccggaaggcagaggttgcagtgagccgagatagtgccattgcactccagcctgggcaacaagagtgaaattccatctcaaacaaagaaacaaacaagaataacaaatcgcaggcttcctgcaacctaccaaatcagaatctgcacattaacaagaactgccaagtgatttgtatgcacattaaagtttgaaaagctctgagctggaggaaagagtctaacctcctggatgacctggagctgaccttctctaggctgcaccctctctatctgtaaaacgaggcagttggtctaaatcagtgtttttcttttctttttttttgagacggagttttgctcttgttgcccaggctggagtgcaatggcctgatctcggctcacagcaacctctgactcccaggttcaagcgattctcctgcctcagcctcccgagtagctaggattacaagcatgtgccactacgcccggctaattttgtatttttagtagagagagggtttctccatgttggtcaggctagtctcgaactcctgacctcaggtgatccgcctgtcttggcctctctaagtgctgggattataggcacaagccaccatgcctggccaacaggtaactattaaaatttaagaaaatgttattctcatcaccaccaaactcctgtcttatcccataatttgagggatctggtgctcttcatgggcccttccacgagggcaatgggacattcctgtcgcagcatctggggcctcctcctgcccactcaaaggccagcatgtgtgggtggggccaggggaggttgttggcttgcttgagccccctgtgtgacctctgccttctctctccgcagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatatttactataaatcagtgtcttttcttcatctgcaaggaactttagcaggtgcctgaggcagggcacagtagagctggtgggcttagtcccacatggcagatctaccctcctggagggtactgtgttcttgagctattctcaacagtcagtactggttgggtgcagtggctcacgcctgtaatcccagcattttggaagtccgaggtgggcagatcacttgagtgaggtcaggagttcaagaccagcctgggcaacatggtgaaaccctgtctctactaaaaatacaaaaattagctgggcatggtggtgcatgcctgtaatcccagctacttaggaggctgaggcaggagaatcctttaaaccctggagtcggagtttgcagtgagcggggattgcgccactgcacttcagcctgggtgagagagcaaaactctgtctcaaataaaaataaaaataaaaaagagccagtattttcctccttgctcctgggaaggagaaggaactggccccgtacaaccagggattcaggacacgtgttactagctccagatgaggatttacacgaaaaaatcctgggccttgtttgtacagttcatgccaggggtaggaaatacctgaagctttcaaatactgcgttagagttgtgactctgtcctgggcaagtcaggcctaaaatggagaaactggtgatgcactcctcaaaaagccaagtgtaaaatgaggttaatgccctccctgacttgttgccttcactggcgtggcatattatggtaaaaataataattaagaagtaaggttatgcaggcaaatcctctagcgccgaaatcttccccgccgcgctaccaggttctttcgtgttatcttggacataacacaacattaattcaactactcggtggagcgcccactagctgctggacactctcttaggccctgggcacagtgaacgagaagcatgtgtctttgtttttacagtctcaccacgccaccacctccctcgggggcctccgcgctgagcttccggcctctacgcctcgcttccggtcggccgccccttccttacttccggttctctatggtgcgcgggcaagctttgctccgcctccggcagtggcttactcccggtgccaggttcttggagctgtgaggtgaggaggggacaagggcagtggggctgggagatggggcggggctgggcgctccgggactgaggtgctgatcgcccaaagggcgcccctgggctggggtctgacccggcttctcctccctcactacccgcggtccccggcctctcggcgctgcgctgttacctcatccgaaaagtgttcgctgcagcatcctcaggcttcacgttggagcctcttgattgtggtaatgtagcctgatgggggtgggggtggtggtgatggtaacagctcacatatatcgtgctcttcggtgtgccaggcactctactgtgttgccaaagtcaggatttcccacacttaagcctttcaggtccggtctttgtaggctttgccagatcaacttaccacctctactaccgtttattaaaaatttgtttgtttgtttgttttagtatttattgataattcttgggtgtttctcgcagaggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaaggagcatgctgccttcaagcttctgtttaacaaagcacatcttgccccgcccttaatccatttaaccctgagtggacacagcacatgtttcagagagcacggggttgggggtaaggctatagaccaacagcatcccaaggcagaagaatttctctcagtacagaacaaaatggagtctcccttgtccacctctctccacacagacacagcaacaatccgatttctctatcttttcccca
